United States Patent 7,413,875 (ESTS AND ENCODED HUMAN PROTEINS) - sequence listing, part 2

SEQ ID NO: 6641 - protein, 131 aa, Homo sapiens
MCSYIWRTTFFLHLRIYDVGMQLKSQQNEFQKVKKQLSHLQDELKIKYRQSYIFSQRLSEYKYFWNKTLSLLTFTKRELTSIKNEVYDNYQNWTSLKGAVFLQIKSISETALTEIDILNKSLTVSREIKYA

SEQ ID NO: 6642 - protein, 54 aa, Homo sapiens
MSDTSESGAGLTRFQAEASEKDSSSMMQTLLTVTQNVEVPETPKPQRHWRSQRM

SEQ ID NO: 6643 - protein, 70 aa, Homo sapiens
  UNSURE 62: Xaa = Pro,Arg
MSDTWSSIQAHKKQLDSLRERLQRRRSRTRGTWIYGIQRQHCLQPSVVTAQCLLHPPLGPKXRQLQQFLN

SEQ ID NO: 6644 - protein, 67 aa, Homo sapiens
MWSVGVIIYVSLSGTFPFNEDEDIHDQIQNAAFMYPPNPWKEISHEDVDLIQYNTYILGCLSSHCTA

SEQ ID NO: 6645 - protein, 134 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMGL

SEQ ID NO: 6646 - protein, 65 aa, Homo sapiens [sequence omitted]

SEQ ID NO: 6647 - protein, 75 aa, Homo sapiens
MADRKRVYKQVMVCESTVKTRRWCTVGGCLPSHHFFLFLSQGLALLPKLECSGGTLTHCDLHLSGSAILPPQPPE

SEQ ID NO: 6648 - protein, 109 aa, Homo sapiens
MEGSGEQPGPQPQHPGDHRIRDGDFVVLKREDVFKAVQVQRRKKVTFEKQWFYLDNVIGHSYGTAFEVTSGGSLQPKKKREEPTAETKEAGTDNRNIVDDGKSQKTYSR

SEQ ID NO: 6649 - protein, 57 aa, Homo sapiens
MHQTKGSSEDARVHGFLEDKFSTADTNIRTSMYLLGDTRTVLRTQNLEAKPPAFYAS

SEQ ID NO: 6650 - protein, 96 aa, Homo sapiens
MEALSRAGQEMSLAALKQHDPYITSIADLTGQVALYTFCPKANQWEKTDIEGTLFVYRRSASPYHGFTIVNRLNMHNLVEPVNKDLEFQLHEPFLL

SEQ ID NO: 6651 - protein, 98 aa, Homo sapiens
  UNSURE 64: Xaa =  * ,Trp
MAASAARGAAALRRSINQPVAFVRRIPWTAASSQLKEHFAQFGHVRRCILPFDKETGFHRGLGXVQFSSEEGLRNALQQENHIIDGVKVNLFLCQIHT

SEQ ID NO: 6652 - protein, 76 aa, Homo sapiens
  UNSURE 25: Xaa =  * ,Leu,Trp
MRFGMGENTKSKNFRNYLSCSLTAXMRKQSSDSPRYSRARDRTQGSRLSGQYTCHWKSWWHGKNVPFGVKQLWIHN

SEQ ID NO: 6653 - protein, 72 aa, Homo sapiens
MMHNSAGPVAHTQRPTQCKKTVFHTPMISSPTKQQHPFPSPLPTKLSIKTLASEFSAKLILVITPVLPLGWP

SEQ ID NO: 6654 - protein, 51 aa, Homo sapiens
MLPWQSSASNPTACSRSPGKNLWRPRGCMSTARPYHTDGSARPAPSLTSVP

SEQ ID NO: 6655 - protein, 61 aa, Homo sapiens
MTDYGEEQRNELEALESIYPDSFTVLSENPPSFTITVTSEAGENDETVQTTLKFTYKKIPR

SEQ ID NO: 6656 - protein, 61 aa, Homo sapiens; identical to SEQ ID NO: 6655

SEQ ID NO: 6657 - protein, 61 aa, Homo sapiens; identical to SEQ ID NO: 6655

SEQ ID NO: 6658 - protein, 61 aa, Homo sapiens; identical to SEQ ID NO: 6655

SEQ ID NO: 6659 - protein, 61 aa, Homo sapiens; identical to SEQ ID NO: 6655

SEQ ID NO: 6660 - protein, 61 aa, Homo sapiens; identical to SEQ ID NO: 6655

SEQ ID NO: 6661 - protein, 61 aa, Homo sapiens; identical to SEQ ID NO: 6655

SEQ ID NO: 6662 - protein, 61 aa, Homo sapiens; identical to SEQ ID NO: 6655

SEQ ID NO: 6663 - protein, 61 aa, Homo sapiens; identical to SEQ ID NO: 6655

SEQ ID NO: 6664 - protein, 61 aa, Homo sapiens; identical to SEQ ID NO: 6655

SEQ ID NO: 6665 - protein, 61 aa, Homo sapiens; identical to SEQ ID NO: 6655

SEQ ID NO: 6666 - protein, 60 aa, Homo sapiens
  UNSURE 18: Xaa = Ala,Asp,Gly,Val
  UNSURE 28: Xaa = Ala,Gly,Ser,Thr
  UNSURE 15: Xaa = His,Gln,Arg
  UNSURE 23: Xaa = Lys,Met,Arg,Thr
MSPHLFICPLTLPWXFRXSAKAXCCRRXQNSVRKGAAQRASEEWRPRLQVGVMAQTPTGI

SEQ ID NO: 6667 - protein, 53 aa, Homo sapiens
  UNSURE 44: Xaa = Cys,Phe
  UNSURE 36: Xaa = Glu,Lys
MARDIPRFPSRMKTSFPENTKCSPTSHPACIYQKRXHLMLAVCXWNQKLFSIL

SEQ ID NO: 6668 - protein, 69 aa, Homo sapiens
MDLKNIVPNEIRQTEVIEDYYLLYLNYGGQNTAIHILQEDVYTKDTHSTERVPWWGEGGEAETLKGVSY

SEQ ID NO: 6669 - protein, 103 aa, Homo sapiens
MQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 6670 - protein, 65 aa, Homo sapiens
  UNSURE 49: Xaa = Asn,Ser
MEKPYREATWSGGDMRMCREGEESSCLIILPEPRHQPSLPTCSTSEDAXVPPGKWILWPQSRSCS

SEQ ID NO: 6671 - protein, 58 aa, Homo sapiens
MDHQEGQETLIISRQLTLTLRDTFSLGECGNAGGKMQLKISGTGHHPVPTRGCTRGED

SEQ ID NO: 6672 - protein, 96 aa, Homo sapiens
MSWHPQYRSSKFRHVFGKPASKENCYDSVPITRSVHDNHFCAVNPHFIAVVTECAGGGAFLVIPLHQVRTPPGPNSSLEAGQDRGKVERAWVSRKS

SEQ ID NO: 6673 - protein, 55 aa, Homo sapiens
  UNSURE 10: Xaa =  * ,Ala,Cys,Gly,Ser
  UNSURE 36: Xaa =  * ,Asp,Glu,Phe,Leu,Val,Tyr
  UNSURE 3: Xaa =  * ,Asp,Glu,Tyr
  UNSURE 7: Xaa =  * ,Gln
  UNSURE 21: Xaa =  * ,Glu,Gly,Trp
  UNSURE 25: Xaa =  * ,Ile,Leu,Met,Arg,Trp
  UNSURE 15: Xaa =  * ,Leu
  UNSURE 38: Xaa =  * ,Lys
  UNSURE 42: Xaa =  * ,Lys,Asn,Tyr
  UNSURE 26: Xaa =  * ,Phe,Ile,Lys,Leu,Asn,Tyr
  UNSURE 28: Xaa = Ala,Asp,Asn,Thr
  UNSURE 8: Xaa = Ala,Cys,Gly,Ser,Trp
  UNSURE 29: Xaa = Ala,Ile,Met,Thr,Val
  UNSURE 37: Xaa = Ala,Leu,Ser,Val
  UNSURE 24: Xaa = Ala,Phe,Leu,Ser,Val
  UNSURE 17: Xaa = Ala,Val
  UNSURE 2: Xaa = Arg,Ser
  UNSURE 23: Xaa = Arg,Ser,Thr
  UNSURE 11: Xaa = Asn,Ser,Thr,Tyr
  UNSURE 6,33: Xaa = Asp,Glu,Gly,Lys,Asn,Arg,Ser
  UNSURE 13: Xaa = Asp,Glu,His,Leu,Gln,Val
  UNSURE 40: Xaa = Asp,Glu,Ile,Lys,Asn,Val
  UNSURE 4,31: Xaa = Asp,Glu,Lys,Asn
  UNSURE 16,22: Xaa = Asp,Ile,Asn,Val
  UNSURE 9: Xaa = Cys,Ser
  UNSURE 43: Xaa = Glu,Gly,Lys,Arg
  UNSURE 19: Xaa = Gly,Trp
  UNSURE 32: Xaa = His,Ile,Lys,Leu,Asn,Gln
  UNSURE 35: Xaa = His,Lys,Asn,Pro,Gln,Thr
  UNSURE 5: Xaa = His,Pro,Gln
  UNSURE 12: Xaa = Ile,Leu,Met
  UNSURE 27: Xaa = Leu,Gln
  UNSURE 18: Xaa = Leu,Pro
  UNSURE 39: Xaa = Lys,Asn
  UNSURE 41: Xaa = Lys,Asn,Thr
  UNSURE 20: Xaa = Lys,Leu,Met,Gln
  UNSURE 34: Xaa = Phe,Leu,Pro,Ser
  UNSURE 14: Xaa = Pro,Ser
MXXXXXXXXXXXXXXXXXXXXXXXXXXXXCXXXXXXXXXXXXXQNIIIYGTILVL

SEQ ID NO: 6674 - protein, 121 aa, Homo sapiens
MNSSEVDSVMSSINPNTSGILLEGFLNIVRKKKEAQRYRNEVRHIFTAFDTYYRGFLTLEDFKKAFRQVAPKLPERTVLEVFSQSLILPTVHLLCHSDLSVGAMRPSFFRIILSAMKNSIC

SEQ ID NO: 6675 - protein, 55 aa, Homo sapiens
MGRVIRGQRKGAGSVFRAHVKHRKGAALAARLDFAERHGYIKGIRELCHRYLPQP

SEQ ID NO: 6676 - protein, 61 aa, Homo sapiens [sequence omitted]

SEQ ID NO: 6677 - protein, 51 aa, Homo sapiens
MLPESWIWTSFWTAYDKDEDPYSSQLKLDRIFKSNEASSLDISTGFALRRN

SEQ ID NO: 6678 - protein, 56 aa, Homo sapiens; identical to SEQ ID NO: 6275

SEQ ID NO: 6679 - protein, 85 aa, Homo sapiens
  UNSURE 75: Xaa = Arg,Thr
  UNSURE 85: Xaa = Asp,Asn
MISSHCNLHLPDSSDSPLSASQVAGITGIHYHAWLIFVFLVETGFHHVGQAGLQLLTSGDTPTSASQSAGIIGVXLCPASFVYLX

SEQ ID NO: 6680 - protein, 56 aa, Homo sapiens
MLSPEAERVLRYLVEVEELAEEVLADKRQIVDLDTKRNQNREGLRACRRISASLKM

SEQ ID NO: 6681 - protein, 65 aa, Homo sapiens
MEGHFVPRRPRHPREDVKRNDPFRVITGWRWSFMTKMKVNMMWKIQRWKQQAKDAGAERWNLGYS

SEQ ID NO: 6682 - protein, 54 aa, Homo sapiens
  UNSURE 38: Xaa = Glu,Gly
MAPPSGMIRVTAGRGSFEWRPAGGDPNRRAGRRPFSRXGPIWRKSSRLVKLGGR

SEQ ID NO: 6683 - protein, 91 aa, Homo sapiens [sequence omitted]

SEQ ID NO: 6684 - protein, 77 aa, Homo sapiens
MSNNSKSYLCFIIHHCEPLSPCFFIFAYLEREGFNFNLLKLLNSGFSLQDEEFHCILFRTSSLSDFPCALCFLVKLI

SEQ ID NO: 6685 - protein, 90 aa, Homo sapiens
  UNSURE 63: Xaa = Ile,Met
MLIPQLKESLQTLMKVAAQNLIQNTNIDNGQKSSDGPIQRFDKCLEEFYALCDQLELCLRLAXSACHRVVTVPSTLQRWCPQPPSPTHAA

SEQ ID NO: 6686 - protein, 59 aa, Homo sapiens
MAASQQQASALPQLLVYRVLVRLAARVPSSSRNRQHNWWALPERPPAATATGLRSCAAL

SEQ ID NO: 6687 - protein, 86 aa, Homo sapiens
MQEKFRHNIAYFPQIVSVAARMLKVARLLEVPVMLTEQYPQGLGPTVPELGTEGLRRWQDLLQHGACPAAGAGQSAPAALCAALWH

SEQ ID NO: 6688 - protein, 71 aa, Homo sapiens
MVFEVFEVFLEFTCWRLQLTERPGLDCASCSSRTKDISWKCMRPRICDRNGSSHVRYAPWKDLEIRNLSEH

SEQ ID NO: 6689 - protein, 79 aa, Homo sapiens
MCPENGSCVPDGPGLLQCVCADGFHGYKCMAPGLVLTAYVLRDSGSHHSIRLHSALGDPAPKSQDFMNYIGLTIDLRSI

SEQ ID NO: 6690 - protein, 97 aa, Homo sapiens
MKWCQEGRFWLHIMKPSLNTCFFTNRRPSVEVSEPFSLEIFKRWVDNCPSQALCKEIYHGRAMETELLIQGQSSKWQSWGVSPGSFVPESVLLVTLL

SEQ ID NO: 6691 - protein, 50 aa, Homo sapiens [sequence omitted]

SEQ ID NO: 6692 - protein, 136 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYIKVKYDSV

SEQ ID NO: 6693 - protein, 66 aa, Homo sapiens
MYSFVTLHIDEVWTFSVPITQVMNIVPKRKKGLPQWLKENGTRVRQFLLGLGEPANSFTYNQEQTD

SEQ ID NO: 6694 - protein, 76 aa, Homo sapiens
MDIRPNHTIYINNMNDKIKKEELKRSLYALFSQFGHVVDIVALKTMKMRGQAFVIFKELGLIHKCLETATRISILW

SEQ ID NO: 6695 - protein, 70 aa, Homo sapiens
  UNSURE 26: Xaa = Ile,Met
MTVGKSSKMLQHIDYRMRCILQDGRXFIGTFKAFDKHMNLILCDCDEFRKIKCVRGESLSFWPHCLFVKL

SEQ ID NO: 6696 - protein, 66 aa, Homo sapiens
MEVDAPGVDGRDGLRERRGFSEGGRQNFDVRPQSGANGLPKHSYWLDLWLFILFDVVVFLFVYFLP

SEQ ID NO: 6697 - protein, 59 aa, Homo sapiens [sequence omitted]

SEQ ID NO: 6698 - protein, 110 aa, Homo sapiens
  UNSURE 61: Xaa = Phe,Ile
MFSLPLNCSPDHIRRGSCWGRPQDLKIAAPAWNSKCHPGAGAAMARQHARTLWYDRPRYVXMEFCVEDSTDVHVLIEDHRIVFSCKNADGVGLYNEIEFYAKSELQGLPG

SEQ ID NO: 6699 - protein, 65 aa, Homo sapiens
MLSALPGWGPAHLQRPLLGPASCLGILRPAMTAHSFALPVIIFTTFWGLVGIAGPWFVPKDPTAE

SEQ ID NO: 6700 - protein, 68 aa, Homo sapiens
MGNLCGCIQGDSKKPSKKRVKRKPYSTTKVTSGSTFNGTYSGITHWLLEKDSTGNLELNCWLLSGEPP

SEQ ID NO: 6701 - protein, 54 aa, Homo sapiens
  UNSURE 24: Xaa = Asp,Glu,Gly
  UNSURE 2: Xaa = Leu,Gln
MXAHQHPFLQQLAKTGGWAMFPSXHLAHSSWTERKLPLKRGWGSFPGGVQARRK

SEQ ID NO: 6702 - protein, 61 aa, Homo sapiens
MKVMFSFGNTDRRFKTGQFKCQLQTKENNGRENTGHSEIGAASELSRKMFLMNLRKTIAPP

SEQ ID NO: 6703 - protein, 60 aa, Homo sapiens
MVAHAVVPSSWDWRSPPPCLANFLYFQWRWGFCHVGQAVLELLSSGDPTVSASKVLGLQA

SEQ ID NO: 6704 - protein, 75 aa, Homo sapiens
MSDNEDNFDGDDFDDVEEDEGLDDLENAEEVSIQPQAPTSAAQAPNRLTGRPGECRDPPLWGRPQPTRSESPHHT

SEQ ID NO: 6705 - protein, 104 aa, Homo sapiens
MTWRMPKRKARRMSRSSPLGATAANQKRITTPYMTKYERARVLGTRALQIAMCAPVMVELEGETDPLLIAMKELKARKIPIIIRRYLPDGSYEDWGVDELIITD

SEQ ID NO: 6706 - protein, 104 aa, Homo sapiens; identical to SEQ ID NO: 6705

SEQ ID NO: 6707 - protein, 104 aa, Homo sapiens; identical to SEQ ID NO: 6705

SEQ ID NO: 6708 - protein, 104 aa, Homo sapiens; identical to SEQ ID NO: 6705

SEQ ID NO: 6709 - protein, 55 aa, Homo sapiens
MKDFHFSESRSRRGNFLEFLRMPNHIFITLLWKSMPLHRKSNSGTTKNFQWECLV

SEQ ID NO: 6710 - protein, 52 aa, Homo sapiens [sequence omitted]

SEQ ID NO: 6711 - protein, 53 aa, Homo sapiens
MACECMASASRTHLLFPCSGQTPAGPCVCAPCCSLQLPARVPAKTSTLGKSLR

SEQ ID NO: 6712 - protein, 52 aa, Homo sapiens
MTTLVLDNGAYNAKIGYSHENVSVIPNCQFRSKTARLKTFTANQIDEIKDPS

SEQ ID NO: 6713 - protein, 64 aa, Homo sapiens
MFPVSSGCFQEQQETNKSLTLLRCSQRDTSPLMDGQTWAGSVSLNHPPLPQLPTTDTSDDTPGK

SEQ ID NO: 6714 - protein, 83 aa, Homo sapiens
MSGPNGDLGMPVEAGAEGEEDGFGEAEYAAINSMLDQINSCLDHLEEKNDHLHARLQELLESNRQTRLEFQQQLGEAPSDASP

SEQ ID NO: 6715 - protein, 69 aa, Homo sapiens
MKWTQHVKTILSRSLAVKENRECIISRAWWLTPIIPALWEAKAARSPKVLKNIQTQSRQATFATTWRFV

SEQ ID NO: 6716 - protein, 142 aa, Homo sapiens
  UNSURE 78: Xaa = Pro,Thr
MSLRCGDAARTLGPRVFGRYFCSPVRPLSSLPDKKKELLQNGPDLQDFVSGDLADRSTWDEYKGNLKRQKGERLRLPXWLKTEIPMGKNYNKLKNTLRNLNLHTVCEEARCPNIGECWGGGEYATATATIMVGPASTSMALV

SEQ ID NO: 6717 - protein, 52 aa, Homo sapiens
MWTSLQGCRITWQQAFFKASNPLRRERECMPRIFHNLTPEVISHMSVWFHLM

SEQ ID NO: 6718 - protein, 55 aa, Homo sapiens [sequence omitted]

SEQ ID NO: 6719 - protein, 72 aa, Homo sapiens; identical to SEQ ID NO: 6446

SEQ ID NO: 6720 - protein, 60 aa, Homo sapiens
  UNSURE 49: Xaa =  * ,Leu
MIGAFLKNSLISSEGIKSCFWNLQHQISLQETNRLGCNTVGETDINFFXNIKLPACNPSY

SEQ ID NO: 6721 - protein, 77 aa, Homo sapiens
  UNSURE 38: Xaa = Asp,His,Asn,Tyr
  UNSURE 67: Xaa = Leu,Val
MPVVPALWEAEGGGSRGQEIETILANMVKPLSTKNTKXYPGVVVGACSPSYLGVPRQENFVNLGGGXAVSRDRATAL

SEQ ID NO: 6722 - protein, 84 aa, Homo sapiens [sequence omitted]

SEQ ID NO: 6723 - protein, 111 aa, Homo sapiens
  UNSURE 3: Xaa = Ala,Pro
  UNSURE 2: Xaa = Ala,Ser
  UNSURE 5: Xaa = Lys,Thr
  UNSURE 66: Xaa = Ser,Trp
MXXFXGTLKRLIGDAAKNQVAMNPTNTVFDAKRLIGRRFDDAVVQSDMKHWPFMVVNDAGRPKVQXIIQGRDQKLLSRGGVFYGSDKDEGNCRSLPWEDCYQCCGHSASLL

SEQ ID NO: 6724 - protein, 50 aa, Homo sapiens
MEIPPTNYPASRAALVAQNYINYQQGTPHRVFEVQKVKQASMGGYSRKRT

SEQ ID NO: 6725 - protein, 53 aa, Homo sapiens
  UNSURE 38: Xaa = His,Gln
  UNSURE 39: Xaa = Phe,Ser
MKFHNVCLLEAYNWVKARRPVIRPNVGFWRQLIDYERXXLGSRQLKWYRHLMA

SEQ ID NO: 6726 - protein, 56 aa, Homo sapiens [sequence omitted]

SEQ ID NO: 6727 - protein, 58 aa, Homo sapiens
  UNSURE 21: Xaa = Cys,Phe
MNHVSLVLPRLECSGTILAHXGLCLGFKRFCCLSLPSMDYRTNGRKDFWKQLLVSDPL

SEQ ID NO: 6728 - protein, 50 aa, Homo sapiens [sequence omitted]

SEQ ID NO: 6729 - protein, 51 aa, Homo sapiens
MEMDGSISSRGPHPPSPSPRSCMILHSSIIQFWVINMKRLIDLIVKKVGKC

SEQ ID NO: 6730 - protein, 89 aa, Homo sapiens
MFPERVRSAAGATFDLSLFVAQKMYRFSRAALWIGTTSFMILVLPVVFETEKLQMEQQQQLQQRQILLGPNTGLSGGMPGALPSLPGKI

SEQ ID NO: 6731 - protein, 89 aa, Homo sapiens; identical to SEQ ID NO: 6730

SEQ ID NO: 6732 - protein, 64 aa, Homo sapiens [sequence omitted]

SEQ ID NO: 6733 - protein, 53 aa, Homo sapiens
  UNSURE 6: Xaa = Pro,Arg
MPGIIXYCAAPHSCPPGPHLRPLEAEDLTLLPSSPATWDPHLCCLLPFLRGSA

SEQ ID NO: 6734 - protein, 55 aa, Homo sapiens
MKRSEGTSSRCRGHQLWDTLSFLSGPASWDRPGQQGWCCFLQWPQVSPRRCWPGP

SEQ ID NO: 6735 - protein, 55 aa, Homo sapiens; identical to SEQ ID NO: 6734

SEQ ID NO: 6736 - protein, 118 aa, Homo sapiens
  UNSURE 7: Xaa = Lys,Thr
MWRLRCXAKDGTHVLQGLSSRTRVRELQGQIAAITGIAPGGQRILVGYPPECLDLSNGDTILEDLPIQSGDMLIIEEDQTRPRSSPAFTKRGASSYVRETLPVLTRTVVPSRQLLPLY

SEQ ID NO: 6737 - protein, 72 aa, Homo sapiens
  UNSURE 70: Xaa =  * ,Cys,Trp
  UNSURE 71: Xaa = Ala,Asp,Glu
  UNSURE 55: Xaa = Ala,Asp,Glu,Gly,His,Ile,Lys,Leu,Met,Asn,Pro,Gln,Arg,Ser,Thr,Val
  UNSURE 64: Xaa = Gly,Arg
  UNSURE 42: Xaa = Gly,Trp
MNIAFYTSRTDDILLHQDVDLVCISIPPPLTRQISVKALGIXEECGLREGSNIGXCFREGDSSXYYRSSXXR

SEQ ID NO: 6738 - protein, 69 aa, Homo sapiens
MLNSMNLLSDAVLDCPCCISIISLFSFSLYYYNCSFYMKARKLKLEEHLSATCQFCVSVLYVCVNFPLK

SEQ ID NO: 6739 - protein, 104 aa, Homo sapiens [sequence omitted]

SEQ ID NO: 6740 - protein, 69 aa, Homo sapiens
MGSGTFQFSRNIVVSLGGYISSFGTKTSEPTQHKVMRMGSRNFSSGSLKITHPGRYHQPRYETTPAVLW

SEQ ID NO: 6741 - protein, 140 aa, Homo sapiens [sequence omitted]

SEQ ID NO: 6742 - protein, 64 aa, Homo sapiens; identical to SEQ ID NO: 6313

SEQ ID NO: 6743 - protein, 58 aa, Homo sapiens [sequence omitted]

SEQ ID NO: 6744 - protein, 70 aa, Homo sapiens
  UNSURE 63: Xaa =  * ,Ser,Tyr
MTLMASETGKERRKTEACAHCCSMCTKSSRAEGPSLQPRSEVGTENSPTAQRCGRAQRSSQSXWRKGSRD

SEQ ID NO: 6745 - protein, 71 aa, Homo sapiens
  UNSURE 36: Xaa = Gly,Val
MKSEAKDGERESLQTAFKKLRVDASGSVASLSVGEXTGVRAPVRTATDDTKPKTTCASKDSWHGSTRKSSR

SEQ ID NO: 6746 - protein, 60 aa, Homo sapiens
MGSVRGAPSRGPLECDALLAAGGRLLPGDSTVWDPAGERDHWCLLRRLQEKTGHTSLRLH

SEQ ID NO: 6747 - protein, 67 aa, Homo sapiens
MYYNIAMDLKEIFQTTKYTSEKEEGTPWNEDCGKEKPEEIQDPAALTSDAEQPSGSRSLFLIQTLKT

SEQ ID NO: 6748 - protein, 104 aa, Homo sapiens
MKSCQKMEGKPENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 6749 - protein, 77 aa, Homo sapiens; identical to SEQ ID NO: 6140

SEQ ID NO: 6750 - protein, 104 aa, Homo sapiens
  UNSURE 98: Xaa =  * ,Asp,Glu,Tyr
  UNSURE 92: Xaa = Asn,Ser
MEPEREGTERHPRKVRESRQAPNKLVGAAEAMKAGWDLEESQPEAKKARLSTILFTDNCEVTHDQLCELLKYAVLGKSNVPKPSWCQLFHQXHLNNVXFLFCRE

SEQ ID NO: 6751 - protein, 136 aa, Homo sapiens
  UNSURE 35: Xaa = Arg,Ser
MSSEPPPPPQPPTHQASVGLLDTPRSRERSPSPLXGNVVPSPLPTRRTRTFSATVRASQGPVYKGVCKCFCRSKGHGFITPADGGPDIFLHISDVEGEYVPVEGDEVTYKMCSIPPKNEKLQAVEVVITHLAQAQA

SEQ ID NO: 6752 - protein, 113 aa, Homo sapiens
MKGLYFQQSSTDEEITFVFQEKEDLPVTEDNFVKLQVKACALSQINTKLLAEMKMKKDLFPVGREIAGIVLDVGSKVSFFQPDDEVVEVLSRLGAVAHVCNPSTLGGQGGRIT

SEQ ID NO: 6753 - protein, 112 aa, Homo sapiens [sequence omitted]

SEQ ID NO: 6754 - protein, 61 aa, Homo sapiens [sequence omitted]

SEQ ID NO: 6755 - protein, 86 aa, Homo sapiens
MAADLNLEWISLPRSWTYGITRGGRVFFINEEAKSTTWLHPVTGEAVVTGHRRQSTDLPTGWEEAYTFEGARYYIKQGLAVAQAGA

SEQ ID NO: 6756 - protein, 68 aa, Homo sapiens
  UNSURE 65: Xaa = Cys,Ser
  UNSURE 66: Xaa = Pro,Arg
MSGHSLARTLLLYLRNMTFLFQRMMMMMTNRNYRKEKALTEENGDALSFSAFPISRKARGRPSAXXVW

SEQ ID NO: 6757 - protein, 69 aa, Homo sapiens
MYVGTMGGRVCFLSWFFPCYFPIEVNACLYFLSKRSRWQNRKLKSPVLGFKKPKNFREIKGFSVMDRLP

SEQ ID NO: 6758 - protein, 117 aa, Homo sapiens
  UNSURE 92: Xaa = Ala,Val
  UNSURE 94: Xaa = Asn,Thr
  UNSURE 96: Xaa = His,Asn
  UNSURE 91: Xaa = Lys,Arg
  UNSURE 93: Xaa = Phe,Leu
  UNSURE 95: Xaa = Pro,Ser
MGGCPVRKRRRNGSKEGNHHSTQPKRNKRNPIFQDSQDTEVFSWSDNERSSSRINIPERASGPEGNLNQIVTEPDANFPQFLHEGYVPMPXXXXXXINQTLKEAHFNSLQQRGQAPT

SEQ ID NO: 6759 - protein, 91 aa, Homo sapiens [sequence omitted]

SEQ ID NO: 6760 - protein, 139 aa, Homo sapiens
  UNSURE 4: Xaa =  * ,Trp
  UNSURE 3: Xaa = Asp,Glu
  UNSURE 8,37: Xaa = Glu,Gln
  UNSURE 32: Xaa = Gly,Arg
MAXXQEVXITEEKPLLPGQTPEAAKEAELAAXILLDXGQTHSVETPYGSVTFTVYGTPKPKRPAILTYHDVGLNYKSCFQPLFQFEDMQEIIQNFVRVHVDAPGMEEGAPVFPLDIRPISGPACRHDPLRPAVPKFLLQ

SEQ ID NO: 6761 - protein, 56 aa, Homo sapiens; identical to SEQ ID NO: 6178
  UNSURE 26: Xaa = Ser,Thr

SEQ ID NO: 6762 - protein, 202 aa, Homo sapiens
  UNSURE 133: Xaa = Ala,Gly
MPERVAPSAQVQQVAARGGAGGGGGGGGGWGGAGGKCCDAVPGRGRRVEAEYQFPSGKAAMAIFSVYVVNKAGGLIYQLDSYAPRAEAEKTFSYPLDLLLKLHDERVLVAFGQRDGIRVGHAVLAINGMDVNXRYTADGKEVLEYLGNPANYPVSIRFGRPRLTSNEKLMLASMFHSCELFDQNLKLALEVAEKAGTFGPGS

SEQ ID NO: 6763 - protein, 56 aa, Homo sapiens; identical to SEQ ID NO: 6178
  UNSURE 26: Xaa = Ser,Thr

SEQ ID NO: 6764 - protein, 52 aa, Homo sapiens
MLSLSRCSLCIFENFLKCSLEQGEVSNLHLFGIEYNPECVTFVLHKGNQPHS

SEQ ID NO: 6765 - protein, 55 aa, Homo sapiens
MFNRYFVFKTGIQHSQPSSDTLLLEVLKQVKVSDMVEDKLDLPEEDITARVNVYV

SEQ ID NO: 6766 - protein, 89 aa, Homo sapiens [sequence omitted]

SEQ ID NO: 6767 - protein, 111 aa, Homo sapiens
  UNSURE 105: Xaa = Ala,Pro
  UNSURE 108: Xaa = Gly,Val
  UNSURE 87: Xaa = Phe,Val
  UNSURE 104: Xaa = Pro,Ser
MISQFFILSSKGDPLIYKDFRGDSGGRDVAELFYRKLTGLPGDESPVVMDYGYVQTTSTEMLRNFIQTEAVVSKPFSLFDLSSVGLXGAETQQSKVAPQQCSQXXRPXQSL

SEQ ID NO: 6768 - protein, 89 aa, Homo sapiens [sequence omitted]

SEQ ID NO: 6769 - protein, 68 aa, Homo sapiens
MDTSRVQPIKLARVTKVLGRTVSQGQCTQVRGIHGRHEPIHHPQCKRPRARGRRAHPFGVRARSPELR

SEQ ID NO: 6770 - protein, 58 aa, Homo sapiens
MVQQNYCFLRCMCSKSQYTHLYNFFLQNLIPNLIFLKIAHVSHVYNMLKYFNCDLKTE

SEQ ID NO: 6771 - protein, 115 aa, Homo sapiens
  UNSURE 85: Xaa = Ile,Asn
MSGGLAPSKSTVYVSNLPFSLTNNDLYRIFSKYGKVVKVTIMKDKDTRKSKGVAFILFLDKDSAQNCTRAINNKQLFGRVIKASXAIDNGRAAEFIRSETTLINLSVMNVGKVDT

SEQ ID NO: 6772 - protein, 97 aa, Homo sapiens [sequence omitted]

SEQ ID NO: 6773 - protein, 68 aa, Homo sapiens [sequence omitted]

SEQ ID NO: 6774 - protein, 54 aa, Homo sapiens
MISQFFILSSKGDPLIYKDFRGDSGGRDVAELFYRKLTGLPGDESPVVMRQRLQ

SEQ ID NO: 6775 - protein, 78 aa, Homo sapiens
  UNSURE 51: Xaa = Ala,Pro
MLSLQQLSGKKQSRVALKERTVSIVLSQEIERKFTSLLLSSSRCLYLGGCXFCLQMGQVAEGWLKQQTHLNSPILQSL

SEQ ID NO: 6776 - protein, 61 aa, Homo sapiens
MLKTASGPSALINNPGHGLTDSFHPESEDHGGAILNSAQRRLPGILMSRSHCSQCDKHSSN

SEQ ID NO: 6777 - protein, 88 aa, Homo sapiens [sequence omitted]

SEQ ID NO: 6778 - protein, 56 aa, Homo sapiens; identical to SEQ ID NO: 6178
  UNSURE 26: Xaa = Ile,Asn,Ser,Thr

SEQ ID NO: 6779 - protein, 135 aa, Homo sapiens
MVLESVARIVKVQLPAYLKRLPVPESITGFARLTVSEWLRLLPFLGVLALLGYLAVRPFLPKKKQQKDSLINLKIQKENPKVVNEINIEDLCLTKAAYCRCWRSKTFPACDGSHNKHNELTGDNVGPLILKKKEV

SEQ ID NO: 6780 - protein, 57 aa, Homo sapiens
MMILQLNNLQMSGREACGGLGVCQQHPTGGAEGESGVSKNRTEPSDKTSRKRGNEAG

SEQ ID NO: 6781 - protein, 69 aa, Homo sapiens
MLSQLGSARTDLSKAFLSRDSSSPLPFNSSSNRYNSCDSCSIKWLWQQQQHKQLSYIIIGIQAASQKVK

SEQ ID NO: 6782 - protein, 108 aa, Homo sapiens [sequence omitted]

SEQ ID NO: 6783 - protein, 83 aa, Homo sapiens
MACAQTGSGKTAAFLLPILAHMMHDGITASRFKELQEPECIIVAPTRELVNQIYLEARKFSFGTCVRAVVIYGGTSWDIQFDK

SEQ ID NO: 6784 - protein, 55 aa, Homo sapiens
MMEGVVTKGHGYWVKFEIVGQLYFQASELRQNIHRKVSSVIFFSPKLRFHEIIYI

SEQ ID NO: 6785 - protein, 50 aa, Homo sapiens
  UNSURE 27: Xaa =  * ,Trp
  UNSURE 11: Xaa = Ala,Gly
  UNSURE 35: Xaa = Lys,Arg
MQMLKLDKENXNRPRRAGRSRPKKQSXRTAASSWXEEQQALQKKLKGTEG

SEQ ID NO: 6786 - protein, 63 aa, Homo sapiens
MINFGEEPPESKIEKKYALYRGRSATNQHCPHLILRLPHCPVTQITRAQTPRILPSNAANRPR

SEQ ID NO: 6787 - protein, 54 aa, Homo sapiens
MDFGFQNILFLAIMSAFYLHIILEYSSANSKRPRLSFKNRGKIPWKNGTEIFVS

SEQ ID NO: 6788 - protein, 70 aa, Homo sapiens
MPVVPALGRPRWADHLRSGVRDQPGQPGEAPPSLLKIQKLAGYGGGCLWSQLLGRLRRENHLSPGGGRLQ

SEQ ID NO: 6789 - protein, 59 aa, Homo sapiens
  UNSURE 3: Xaa = Asp,Glu
MRXKGLFGFHNYLLILCLPDFKIKLFAISFFFSSHKTFGHLQSLFLKSYAVIQTVYSFC

SEQ ID NO: 6790 - protein, 85 aa, Homo sapiens
MWNTGASDDAVSCSVMLEVLRVLSTSSEALHHAVIFLFNGAEENVLQASHGFITQHPWASLIRAFINLEAAGVGGKELVFQTAYD

SEQ ID NO: 6791 - protein, 62 aa, Homo sapiens
MGISRDNWHKRRKTGGKRKPYHKKRKYELGRPAANTKIGPRRIHTVRVRGGNKKYRALRLYS

SEQ ID NO: 6792 - protein, 50 aa, Homo sapiens [sequence omitted]

SEQ ID NO: 6793 - protein, 63 aa, Homo sapiens
MIERIWCTRRTWPEQAERYDEMVESMKKVAGMDVELTVEERKPPMLLAYKKCDWEARRSLLGE

SEQ ID NO: 6794 - protein, 86 aa, Homo sapiens
  UNSURE 10: Xaa = Ala,Pro
MSWFRRPNWXKQAERYDDMAACMKSVTEQGAELSNEERNLLSVAYKNVVGARSHLGGSSQVLNKRRKVLRKNSRWLENTEKKLRRS

SEQ ID NO: 6795 - protein, 95 aa, Homo sapiens
MTELPPTHPIRLGLALNFSVFYYEILNSPDRACLAKAAFDDAIAELDTLSEESYKDSTLIMQLLRDNLTLWTSDMQGDGEEQNKEALQDVEDENQ

SEQ ID NO: 6796 - protein, 98 aa, Homo sapiens [sequence omitted]

SEQ ID NO: 6797 - protein, 76 aa, Homo sapiens
MNTETCAIPTNTLLFSSFIAVTQRKPKTATYSGSQELLKCFPQWLKHFTFPPAMHKSSSFSTFLPIFIFCFFLELL

SEQ ID NO: 6798 - protein, 208 aa, Homo sapiens [sequence omitted]

SEQ ID NO: 6799 - protein, 73 aa, Homo sapiens
MKKKTHKVKEDKKKKKTKNFNPPTRRNWESNYFGMPLQDLVTAEKPIPLFVEKCVEFIEDTGLCTEDSTVSAE

SEQ ID NO: 6800 - protein, 62 aa, Homo sapiens; identical to SEQ ID NO: 6791

SEQ ID NO: 6801 - protein, 93 aa, Homo sapiens
  UNSURE 24: Xaa = Ala,Pro
  UNSURE 27: Xaa = His,Gln
  UNSURE 17: Xaa = Ser,Thr
MEELVGLREGFSGDPVXLQELWGXCPXIRRAIQGGLEWLKQKVFRLGEDWYFLMTLGVLMALVSYAMNFAIGCVVRGFSQSITPSSGVLESRS

SEQ ID NO: 6802 - protein, 86 aa, Homo sapiens
MSQLKRREYICPFLTFVSFKPSKNWMMPDYISEGGSLLGLWTQMLISSEKTLTDMPEIMFYQLSGHPLTQSSGDIKLAITPRKRND

SEQ ID NO: 6803 - protein, 61 aa, Homo sapiens
MDHITLWMDHIWLIHMPTSGCFLGIMTNTDMRLVFFANGLLKGVLKGYDTAICTFHCLESS

SEQ ID NO: 6804 - protein, 114 aa, Homo sapiens
  UNSURE 106: Xaa = Ser,Thr
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMVSRSPVPPCRXPVPASRPT

SEQ ID NO: 6805 - protein, 97 aa, Homo sapiens
MAGELQGTQAPSLRRTGLTSQDSGVNPNNSARGREAMASGSNWLSGVNVVLVMAYGSLVFVLLFIFVKRQIMRFAMKSRRGPHVPVEQCPQGLERGD

SEQ ID NO: 6806 - protein, 93 aa, Homo sapiens
  UNSURE 17: Xaa = Gly,Arg,Trp
  UNSURE 6: Xaa = His,Gln
  UNSURE 84: Xaa = Phe,Ile,Leu,Val
  UNSURE 8,16: Xaa = Ser,Thr
MAGELXGXQAPSLRRXXLTSQDSGVNPNNSARGREAMASGSNWLSGVNVVLVMAYGSLVFVLLFIFVKRQIMRFAMKSRRGPHXPVGTMPPRT

SEQ ID NO: 6807 - protein, 62 aa, Homo sapiens
MRTQLRHTSRKSPLSSPQCCVMQIPFTACLPASLPPSLFPFFLPSFFECYFFPSLNCNTDIW

SEQ ID NO: 6808 - protein, 129 aa, Homo sapiens
  UNSURE 120: Xaa = Ala,Gly
  UNSURE 129: Xaa = Gly,Ser
  UNSURE 111: Xaa = Lys,Thr
  UNSURE 65: Xaa = Phe,Leu
MGISRDNWHKRRKTGGKRKPYHKKRKYELGRPAANTKIGPRRIHTVRVRGGNKKYRALRLDVGNXSWGSECCTRKTRIIDVVYNASNNELVRTKTLVKNCIVLIDSNTVPXVVRVPLCAXPGPQEGSQX

SEQ ID NO: 6809 - protein, 64 aa, Homo sapiens
  UNSURE 61: Xaa = Ala,Pro
MAVSARRNLEAGGRGARAALQVSCALLSPQDKEKKKKESILDLSKYIDKTIRVKFQGGREXVES

SEQ ID NO: 6810 - protein, 101 aa, Homo sapiens
MLPRRIKHKGELSLVCIAEQRISSLQFASLREPHPDLVEMTLHDLDFKLDTVIREDLSCHLWGEDTMLYEKKSEREAVVKSEVTFPRSPKWCSETCSHRWM

SEQ ID NO: 6811 - protein, 98 aa, Homo sapiens
  UNSURE 96: Xaa = His,Gln
  UNSURE 88: Xaa = Met,Arg
MQKQGCDCECLGGGRISHRVRTRRFTCTAIPWPMVLPSTPFQLRKSKPSTPTTRSPGLTTATEHSQPGACCLQQPLQSPRLCLHSSCXAGLLLLRXLW

SEQ ID NO: 6812 - protein, 125 aa, Homo sapiens
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMAYGPAQHAISTEKIKAKYPDYEVTWANDGY

SEQ ID NO: 6813 - protein, 56 aa, Homo sapiens; identical to SEQ ID NO: 6275

SEQ ID NO: 6814 - protein, 99 aa, Homo sapiens [sequence omitted]

SEQ ID NO: 6815 - protein, 71 aa, Homo sapiens [sequence omitted]

SEQ ID NO: 6816 - protein, 56 aa, Homo sapiens; identical to SEQ ID NO: 6275

SEQ ID NO: 6817 - protein, 56 aa, Homo sapiens; identical to SEQ ID NO: 6275

SEQ ID NO: 6818 - protein, 77 aa, Homo sapiens
  UNSURE 32: Xaa = Ala,Thr
  UNSURE 35: Xaa = Ile,Val
MVLAFLSKIRLECSGMISAHCNLHLPDSLASXSRXAGITGVHHHARLTFLFLTGTGFHHVGQAGLELLTNMEEPRLY

SEQ ID NO: 6819 - protein, 51 aa, Homo sapiens
MSHLLYTPKWLKTQIPPSGIFNSSQGYQKSCFWTHNKPWSSKFGIKEMRRG

SEQ ID NO: 6820 - protein, 56 aa, Homo sapiens; identical to SEQ ID NO: 6275

SEQ ID NO: 6821 - protein, 55 aa, Homo sapiens
  UNSURE 13: Xaa = Ala,Pro
  UNSURE 15: Xaa = Glu,Gln
MQWRDLGSPQPPXSXGSSDSPASASQVAGITEHEMMPQLITNSAEAVTDTIIFIS

SEQ ID NO: 6822 - protein, 71 aa, Homo sapiens
  UNSURE 52: Xaa = Met,Arg
MVPTLWARTTDAPHLSLVPPRTTAALRRENNTQRGHRLKTQTRREDGHVNNXQRLKFCAGNQGMPRATRSG

SEQ ID NO: 6823 - protein, 124 aa, Homo sapiens
MAAVLQRVERLSNRVVRVLGCNPGPMTLQGTNTYLVGTGPRRILIDTGEPAIPEYISCLKQALTEFNTAIQEIVVTHWHRDHSGGIGDICKSINNDTTYCIKKLPRNPQRGRNYRKSESNNMFI

SEQ ID NO: 6824 - protein, 69 aa, Homo sapiens
MRSLGLTEEQLRQQLTEWQDLHLKENVPPSLLLLSRTFYLIDVKPKPIEIPLSGRMKTLYSRHQLHHHP

SEQ ID NO: 6825 - protein, 57 aa, Homo sapiens
MDCQKGGNMANGSCLDLKSEESSSAHFDSDGIYQSMFVDMINPKEKVRLMNRRTGVL

SEQ ID NO: 6826 - protein, 103 aa, Homo sapiens
MGQQSSVRRLKRSVPCESNEANEANEANKTMPETPTGDSDPQPAPKKMKTSESSTILVVRYRRNVKRTSPEELVNDHARENRINPDQMEEEEFIEITTERPKK

SEQ ID NO: 6827 - protein, 53 aa, Homo sapiens
MRLSKTKKHVSRAYGGSMCAKCVRDRIKRAFLIEEQKIVVKVLKAQAQSQKAK

SEQ ID NO: 6828 - protein, 57 aa, Homo sapiens
MVLLESEQFLTELTRLFQKCRTSGSVYITLKKYDGRTKPIPKKGTVEGFEPQTTSVC

SEQ ID NO: 6829 - protein, 80 aa, Homo sapiens
MSVPGPSSPDGALTRPPYCLEAGEPTPGLSDTSPDEGLIEDLTIEDKAVEQLAEGLLSHYLPDLQRSKQALQELTTKLYC

SEQ ID NO: 6830 - protein, 74 aa, Homo sapiens
  UNSURE 43: Xaa =  * ,Lys
  UNSURE 42: Xaa =  * ,Phe,Ile,Lys,Leu,Met,Asn,Tyr
MKRENKSFLRLMGAGKKEHTGRLVIGDHKSTSHFPNRGKKTXXINEELESQYQQNYGTVNLSGKISATLWTWLQ

SEQ ID NO: 6831 - protein, 51 aa, Homo sapiens
MGGSGFLRLPPLKQSKLSIMEHSYPKAKAFSTLQEMKASVTHPATVEIEQH

SEQ ID NO: 6832 - protein, 63 aa, Homo sapiens
  UNSURE 23: Xaa = Ile,Lys,Met,Asn,Arg,Ser
MTFKASLGTSYVPDTAIGSGDNXSVQETTVSKKQDFPSKSLLGKPARPADKHSCTGGEPAEAA

SEQ ID NO: 6833 - protein, 55 aa, Homo sapiens [sequence omitted]

SEQ ID NO: 6834 - protein, 100 aa, Homo sapiens
MPKKFQGENTKSAAARARRAEAKAAADAKKQKELEDAYWKDDDKHVMRKEQRKEEKEKRRLDQLERKKETQRLLEEEDSKLKGGKAPRVATSSKVTRAQI

SEQ ID NO: 6835 - protein, 82 aa, Homo sapiens
  UNSURE 71: Xaa =  * ,Ala,Cys,Asp,Glu,Phe,Gly,His,Ile,Lys,Leu,Asn,Pro,Gln,Arg,Ser,Thr,Val,Tyr
  UNSURE 70: Xaa =  * ,Asp,Glu,His,Lys,Asn,Gln,Tyr
  UNSURE 67: Xaa = His,Gln
MFIAALFTIAKTWNQPKCPTMIDWIKKMWHIYAMEYYAAIKKDDFMSFVGTWMKLETIILSKLSQGXKTXXPHVLTHSNLYL

SEQ ID NO: 6836 - protein, 71 aa, Homo sapiens [sequence omitted]

SEQ ID NO: 6837 - protein, 54 aa, Homo sapiens
MDGEPTWCPGKPVYTKEMPTGSGKLPNPSVILQQRPLLLARFETMFNLATSMSQ

SEQ ID NO: 6838 - protein, 66 aa, Homo sapiens
MWGQVRRKKLGASKNLVTQNPDPTRRNTGSHFMASCLCDGPCSWGTLRLGGPRDPVGSVALNLSQH

SEQ ID NO: 6839 - protein, 148 aa, Homo sapiens
MGPEAGLLHSSDDAGGAPATRNCLPDHSGHRPTPPRSHRHHRQENLGSIKPSSRSTKATSTTMAGDGRRAEAVREGWGVYVTPRAPIREGRGRLAPQNGGSSDAPAYRTPPSRQGRREVRFSDEPPEVYGDFEPWWPKKGPRWENEPG

SEQ ID NO: 6840 - protein, 99 aa, Homo sapiens
METAVRGMPLECPPRPERLNAYEREVMVNMLNSLSRNQQLPRITPRCGCVDPLPGRLPFHGYESACSGRHYCLRGMDYYASGAPCTDRRLRLGAGSNRL

SEQ ID NO: 6841 - protein, 89 aa, Homo sapiens
MQVDLGCNFFVDTVVPDTSRIYVALGYGFFLELTLAEALKFIDRKSSLLTELSNSLTKDSMNIKAHIHMLLEGLRELQGLQNFPEKPHH

SEQ ID NO: 6842 - protein, 125 aa, Homo sapiens
MATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTYGTHRFS

SEQ ID NO: 6843 - protein, 51 aa, Homo sapiens
MLGLPLGWLRIMKDRSSASLCGSSFWTPSLWELVFDFKWHVALPCFSDLEK

SEQ ID NO: 6844 - protein, 56 aa, Homo sapiens
MLQELNFGAYLGLPAFLLPLNQEDNTNLARVLTNHIHTGHHSSMFWMRVPWWHQRT

SEQ ID NO: 6845 - protein, 65 aa, Homo sapiens
  UNSURE 31: Xaa =  * ,Leu,Ser
  UNSURE 22: Xaa = Lys,Asn
  UNSURE 65: Xaa = Phe,Ile,Leu,Val
MPPWRPAAPGPPRTPVGRGWRXTPFPCDSAXGAPRCPTEHAPSRPSRCGFWSSCHLLGFGGHQGX

SEQ ID NO: 6846 - protein, 135 aa, Homo sapiens
MATKCGNCGPGYSTPLEAMKGPREEIVYLPCIYRNTGTEAPDYLATVDVDPKSPQYCQDELHHSGWNTCSSCFGDSTKSRTKLVLPSLISSRIYVVDVGSEPGPQSCTRSLSPRTSMPSANWPFSTPATAWPAGK

SEQ ID NO: 6847 - protein, 58 aa, Homo sapiens [sequence omitted]

SEQ ID NO: 6848 - protein, 56 aa, Homo sapiens
  UNSURE 45: Xaa = Ala,Pro
  UNSURE 44: Xaa = Lys,Arg
MPPRLDNFCIFSRDGVSPCWSSWSPTPDLKSSARVGLRKCWDYXXEPPHSTPNHPF

SEQ ID NO: 6849 - protein, 52 aa, Homo sapiens
MKISFRSLVSRIIYQSQREKSAIFLSKSLEKQSFCLVIERSQQSCSVKDQRW

SEQ ID NO: 6850 - protein, 56 aa, Homo sapiens
  UNSURE 46: Xaa = Lys,Arg
MAAVGSLLGRLRQSTVKATDLHSAACTHPPGELTAAGPHSLVCTAXLMHDSTPCCW

SEQ ID NO: 6851 - protein, 112 aa, Homo sapiens
MAAVGSLLGRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSE

SEQ ID NO: 6852 - protein, 78 aa, Homo sapiens
MAAVGSLLGRLRQSTVKATGPALRRLHTSSWRADSSRASLTRVHRQAYARLYPVLLVKQDGSTIHIRYREPRRMLAMP

SEQ ID NO: 6853 - protein, 77 aa, Homo sapiens; identical to SEQ ID NO: 6140

SEQ ID NO: 6854 - protein, 61 aa, Homo sapiens
  UNSURE 53: Xaa =  * ,Arg
MKLFPQKRGSRQVVSSPLKIIVADKYRECNKLEKSLSLGTKPVVPLRDRPGKXASGWRMGG

SEQ ID NO: 6855 - protein, 86 aa, Homo sapiens
MPLIRNGQILAVFVRKTDGSCRLTMDSQILSKVMSTTASAMPDMVLIHIVKFQNQKMIQKDCSGCLVSEEIVYPVWIVSYFLSTKL

SEQ ID NO: 6856 - protein, 111 aa, Homo sapiens
MAFPEPKPRPPELPQKRLKTLDCGQGAVRAVRFNVDGNYCLTCGSDKTLKLWNPLRGTLLRTYSGHGYEVLDAAGSFDNSSLCSGGGDKAVVLWDVASGQSCANSGATQGR

SEQ ID NO: 6857 - protein, 79 aa, Homo sapiens [sequence omitted]

SEQ ID NO: 6858 - protein, 104 aa, Homo sapiens
  UNSURE 76: Xaa = Ile,Asn,Thr
  UNSURE 75: Xaa = Phe,Leu
MASWLYWGTWVNPVGSMYIQKIVNQTYLFIGSILICATVLQMKSNEHICSKQAKLCTFGLWENWKIAVYLIYIYXXSVGLWENWEIAVSLHIFYFCFAKSAFIK

SEQ ID NO: 6859 - protein, 56 aa, Homo sapiens
MQEDCLRQIVRDQPGQRGVTSSLQKISWVWWCTPVVPATWEAEAGGLLGTGGLRLQ

SEQ ID NO: 6860 - protein, 59 aa, Homo sapiens
  UNSURE 38: Xaa = Gly,Trp
MPDKAKLAERATSHLCNLPPPAGRFVFASCEEPRRHHXHKSTHLYLFVWNITHVCFYNK

SEQ ID NO: 6861 - protein, 54 aa, Homo sapiens
MAAVAAASAELLIIGWYIFRVLLQVFRYSLQKLAYTVSRTGRQVLGERRQRAPN

SEQ ID NO: 6862 - protein, 64 aa, Homo sapiens [sequence omitted]

SEQ ID NO: 6863 - protein, 60 aa, Homo sapiens
MGFKKNVPNQNNLICIRLSTYPNSVIVTDLNYYYFLTYHQECSGRLGAVAHACNPSTLVG

SEQ ID NO: 6864 - protein, 72 aa, Homo sapiens
  UNSURE 69: Xaa = His,Gln
  UNSURE 72: Xaa = Ile,Lys,Leu,Pro,Gln,Arg,Thr
MVEKQESENSCNKEEEPVFTRQDSNRSEKEATPVVHETEPESGSQPRPAVLSGYFKQFQKSLPPRFQRXRNX

SEQ ID NO: 6865 - protein, 132 aa, Homo sapiens
MAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 6866 - protein, 53 aa, Homo sapiens
  UNSURE 48: Xaa = Lys,Gln
MTSRKKVLLKVIILGDSGVGKTSLMNQYVNKKFSNQYKATIGADFLTXGGDGG

SEQ ID NO: 6867 - protein, 109 aa, Homo sapiens
MPTGKQLADIGYKTFSTSMMLLTVYGGYSAVSESTTISSGAGPSARPQKNRRPQESCRTGGLFLLSREAQGMLWRDFTCHHFQVNRTRALMVFKPCWKKVPMVSLVLPV

SEQ ID NO: 6868 - protein, 57 aa, Homo sapiens
MPTGKQLADIGYKTFSTSMMLLTVYGGYLCSVRVYHYFQWRRAQRQAAEEQKTSGIM

SEQ ID NO: 6869 - protein, 57 aa, Homo sapiens; identical to SEQ ID NO: 6868

SEQ ID NO: 6870 - protein, 87 aa, Homo sapiens
  UNSURE 42: Xaa = Arg,Ser
  UNSURE 85: Xaa = Arg,Thr
MPGFSRAPRWVALPPQDTGLGPPLQNRFEAKQWHVAVQLSRXLSRDPIQDLTFYVVVIVLPPEAPLGCDHFSDFYFDENILMTLXSF

SEQ ID NO: 6871 - protein, 146 aa, Homo sapiens
MAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASFVLLVI

SEQ ID NO: 6872 - protein, 94 aa, Homo sapiens
  UNSURE 77: Xaa = Asp,Glu
MGWTNARLCCQHPTPEMSLPPPHRTCKKAAPEPCSLPISPPIKNISWSRLTKPKCGLQSSCSSITKESKGGFGTEAXSHLHIQPLPVQTPVVFQ

SEQ ID NO: 6873 - protein, 53 aa, Homo sapiens
  UNSURE 5: Xaa = Asp,Glu
MQVPXCLSPASTPVNDHRSLIHNHCAWRLEYGVVNGIQKGRSTVAWDFLVLLL

SEQ ID NO: 6874 - protein, 129 aa, Homo sapiens
  UNSURE 121: Xaa =  * ,Gly,Arg
  UNSURE 127: Xaa =  * ,Leu,Ser,Trp
MHTSLPDIYAAGDICTTSWQLSPVWQQMRLWTQARQMGWYAAKCMAAASSGDSIDMDFSFELFAHVTKFFNYKVVLLGKYNAQGLGSDHELMLRCTKGQEYIKVVMQNGRMMGAFLIGETXFRRNIXKT

SEQ ID NO: 6875 - protein, 71 aa, Homo sapiens
  UNSURE 64: Xaa = Ile,Asn,Ser,Thr
MNPKIQETQRAPRRINIDSGQVQWLTPIIPALWEAEVGGSQGHEIKTSLTNMVKPVSTKNTKIXWAQWHAL

SEQ ID NO: 6876 - protein, 73 aa, Homo sapiens
MAASMHGQPSPSLEDAKLRRPMVIEIIEKNFDYLRKEMTQNIYQMATFGTTAGFSGIFSNFLFRRCFKVNMML

SEQ ID NO: 6877 - protein, 88 aa, Homo sapiens
MTGSGVDARTASSGSSVWEGQLQSLVLSEYASTEMSLHALYMHQLHKQQAQAEPERHVWHRGRVMRVEKAPLMKGERAPGPPVYPSLC

SEQ ID NO: 6878 - protein, 52 aa, Homo sapiens
  UNSURE 28: Xaa =  * ,Lys
MRMYYFYNKRKFLKEKKLKKKKASLVRXGMVFSSLRHVNDKGLFKKQKNTAI

SEQ ID NO: 6879 - protein, 51 aa, Homo sapiens
MVLQMRKQSPEKGSDLLGTTVLFTQATFQASAMCCPQDGEGTILNILPLIS

SEQ ID NO: 6880 - protein, 59 aa, Homo sapiens
  UNSURE 40: Xaa = Ala,Asp,Glu,Val
MPMSVEEGPECQGPVVDRRCPRCGHEGMAYHTRQMRSADXGQTVFYTCTNCKFQEKEDS

SEQ ID NO: 6881 - protein, 93 aa, Homo sapiens
MKRQGKVVPEPMRCIYGEGYVRSCDAEEHSYFQATAGQEGNHHDFVPFRIGISSVKQKQSQNEGSSGVMGTADDIKSLKLRIVNCLWVGLESS

SEQ ID NO: 6882 - protein, 104 aa, Homo sapiens
  UNSURE 13: Xaa = Asp,His
MDTTTGLGTLLKXPRTEQCGRAFQVREGAGAVRQCRAGHHAPAPRLLETLTWLSETQESFLVASSEYPCSSNLNECHNLYFFYILQLSEKVNFDKFPATGLFCA

SEQ ID NO: 6883 - protein, 64 aa, Homo sapiens [sequence omitted]

SEQ ID NO: 6884 - protein, 112 aa, Homo sapiens
MKRIPQNPRYQHIKSRLDTGNSMTKYTEKLEEIKKNYRYKKDELFKRLKVTTFAQLIIQVASLSDQTLEVTAEEIQRLEDNDSAASDPDAETTARTNGKGIQVSSRRALSSS

SEQ ID NO: 6885 - protein, 126 aa, Homo sapiens
MSVMDLANTCSSFQSDLDFCSDCGSVLPLPGAQDTVTCIRCGFNINVRDFEGKVVKTSVVFHQLGTAMPMSVEEGPECQGPVVDRRCPRCGHEGMAYHTRQMRSADEGQTVFYTCTNCKFQEKEDS

SEQ ID NO: 6886 - protein, 66 aa, Homo sapiens
  UNSURE 21: Xaa = Glu,Gln
  UNSURE 22: Xaa = Leu,Arg
MTQHNQHLQTENTQPRAQALXXADPKSSLQACSLVPGPREHRFAALTFILPCTERSRCLFPGLRGK

SEQ ID NO: 6887 - protein, 67 aa, Homo sapiens [sequence omitted]

SEQ ID NO: 6888 - protein, 54 aa, Homo sapiens
  UNSURE 12: Xaa = Ala,Gly
  UNSURE 42: Xaa = Ala,Pro,Ser,Thr
  UNSURE 8: Xaa = Asn,Thr
MNFQENVXLAMXLVHHPDLHLFLQQGSAVRRHRTSPHKSPAXPSAIALRPDKCN

SEQ ID NO: 6889 - protein, 117 aa, Homo sapiens
MKPGKAGLEEPLEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 6890 - protein, 78 aa, Homo sapiens
MPVHSRGDKKETNHHDEMEVDYAENEGSSSEDEDTESSSVSEDGDSSEMDDEDCERRRMECLDEMSNLEKQFTDLKDQ

SEQ ID NO: 6891 - protein, 50 aa, Homo sapiens
MDISTRSKDPGSAERTAQKRKFPSPPHSSNGHSPQTHQQAPLKRKRNLAY

SEQ ID NO: 6892 - protein, 57 aa, Homo sapiens [sequence omitted]

SEQ ID NO: 6893 - protein, 75 aa, Homo sapiens
  UNSURE 51: Xaa =  * ,Ala,Glu,Gly,Lys,Leu,Met,Pro,Gln,Arg,Ser,Thr,Val,Trp
  UNSURE 25: Xaa =  * ,Tyr
  UNSURE 8: Xaa = Ala,Glu
  UNSURE 30: Xaa = Ala,Gly
  UNSURE 50: Xaa = Ala,Ser,Thr
  UNSURE 34: Xaa = Arg,Thr
  UNSURE 44: Xaa = Glu,Lys
  UNSURE 40: Xaa = Glu,Val
  UNSURE 59: Xaa = His,Asn
  UNSURE 18: Xaa = Ile,Thr
  UNSURE 37: Xaa = Lys,Arg
  UNSURE 21,29: Xaa = Lys,Gln
  UNSURE 7: Xaa = Lys,Thr
  UNSURE 47: Xaa = Phe,Leu
MARSRLXXTSTSRVQVIXLPXPPEXLVLXXPATXPGXFFXFLVXTGXHCXXPGQSRTPXLVIRPPWPPKVLGLQA

SEQ ID NO: 6894 - protein, 61 aa, Homo sapiens
MLTGRHMVRDVSCKNCNSKLGWIYEFATEDSQRYKEGRVILERALVRESEGFEEHVPSDNS

SEQ ID NO: 6895 - protein, 76 aa, Homo sapiens
MFGVYDNIGILGNFEKHPKELIRGPIWLRGWKGNELQRCIRKRKMVGSRMFADDLHNLNKRIRYLYKHFNRHGKFR

SEQ ID NO: 6896 - protein, 95 aa, Homo sapiens
  UNSURE 28: Xaa =  * ,Ser,Tyr
MAAEAFGANWERSTRFLEHGQRRQEQAXIRGFESYGSSSYGGAGGYTQSPGGFGSPAPSQAEKKSRARAQHIVPCTISQLLSATLVDEVFRIGNV

SEQ ID NO: 6897 - protein, 100 aa, Homo sapiens [sequence omitted]

SEQ ID NO: 6898 - protein, 53 aa, Homo sapiens [sequence omitted]

SEQ ID NO: 6899 - protein, 69 aa, Homo sapiens
MMGTYGNLLSLVGEWLSKLWYIHTMGYDSTIKRNCPDFTTMQYMHDFKLPNLMSSPGWSGGTNHRPLTS

SEQ ID NO: 6900 - protein, 54 aa, Homo sapiens
MVASGCCHPRGLRKASLETWRGPDLRAASRSCHSTSWFPLRMWLYPSPRRSGTV

SEQ ID NO: 6901 - protein, 70 aa, Homo sapiens
  UNSURE 42: Xaa = Gly,Ser
MIFFSFETVCSVAQDGVQCSGAILQPPPLEFKRFSCLSLPSXWDYRRAPPHPDDLFKCKMPSTQKIKESA

SEQ ID NO: 6902 - protein, 89 aa, Homo sapiens
MKEIGSNCLNNEFNFFKRHICDANKEGMFLFRAARKLRQFLKMNSTGDFDLHLLKVSEGTTILLNCTGQVKGRKPAALGEANQQQFGRK

SEQ ID NO: 6903 - protein, 63 aa, Homo sapiens
  UNSURE 15: Xaa = Lys,Gln
MLNRLVQTQVREERXRKHILAAHQIIHSYTESMVQKKLTEGEQDEASNAAMLLEKETQNENNS

SEQ ID NO: 6904 - protein, 62 aa, Homo sapiens [sequence omitted]

SEQ ID NO: 6905 - protein, 62 aa, Homo sapiens
MIRSKFRVPRILHVLSAHSQASDKNFTAENSEVVVSSRTDVSPMKSDLLLPPSKPGCNNVLN

SEQ ID NO: 6906 - protein, 54 aa, Homo sapiens [sequence omitted]

SEQ ID NO: 6907 - protein, 73 aa, Homo sapiens [sequence omitted]

SEQ ID NO: 6908 - protein, 61 aa, Homo sapiens [sequence omitted]

SEQ ID NO: 6909 - protein, 75 aa, Homo sapiens
MRAEACLTDLQQGCGYHVLSRGCRWAVGLDLAAAMDSSSKYGNFERYHQETKVHQKHPENYQVYENGSGSKICPS

SEQ ID NO: 6910 - protein, 91 aa, Homo sapiens
MPSPPLANSNHESPVNQLGNMQNMRLGPSFILTGIFLGNGRTEASPFFTDEFALSKIFPEYKRNLFGKFQTNILCKVSYTSERSSWKLPDT

SEQ ID NO: 6911 - protein, 93 aa, Homo sapiens
MPSPPLANSNHESPVNQLGNMQNMRLGASFILTGIFLGNGRTEASPFFTDEFALSKIFPEYKRNLFGKFQTNMAFSLELDPPSLLLSVVLFMF

SEQ ID NO: 6912 - protein, 153 aa, Homo sapiens
MEPLYQAGSILMTVNTLQGKKMIESGLQSGDFSLSQSWPSCLPPPADLEILQQKVAGVQRELEDFKKEALKSIHYLEDAFCEMNGALVQQEEQAARVRQRLREEEDRGIVRNKVLTFLLPREKQLREHCKRLEDLLLDRGRDALRATKKSQAD

SEQ ID NO: 6913 - protein, 212 aa, Homo sapiens
MRHQGTQKSDVPPLTTKGKKATGNIDHKEKSTEINHEIPHCVNKLPKQEDSKRKYEDLSGEEKHLEVQILLENTGRQKDKKEDQEKKNIFVKEEQELPPKIIEVIHPERESNQEDVLVREKFKRSMQRNGVDDTLGKGTAPYTKGPLRQRRHYSFTEATENLHHGLPASGGPANAGNMRYSHSTGKHLSNREEMELEHSDSGYEPHLVSLPE

SEQ ID NO: 6914 - protein, 54 aa, Homo sapiens
MHFKIHQPCISKLSGWLRTLHGFSPEPKSCPSDESWSVVHSLSGKKMIFTPCME

SEQ ID NO: 6915 - protein, 105 aa, Homo sapiens
  UNSURE 48: Xaa = Asp,Glu
  UNSURE 47: Xaa = Cys,Phe,Ser,Tyr
  UNSURE 49: Xaa = Ile,Lys,Met,Asn,Arg,Ser,Thr
  UNSURE 50: Xaa = Ser,Thr
MEKKVVFSTISLGKCSVLDNITTDKILIDVFDGPPLYDDVKVQFFFXXXXLHTMTIAHFTSGCTHLLLKITGFIYQKMNWIIYINKKHGEFIHQILPWRYFLARK

SEQ ID NO: 6916 - protein, 52 aa, Homo sapiens
  UNSURE 10: Xaa = Pro,Thr
MQSQRYSNVXASHNLSWGIQLPPRVNTGIPDDSLPLSYRAACCYIPLKSLQS

SEQ ID NO: 6917 - protein, 62 aa, Homo sapiens
  UNSURE 2: Xaa = Cys,Gly
  UNSURE 62: Xaa = His,Gln
MXQQDNNGNVGPLTNRVKQIAIAFQYHQNIFNNSSSKDLLCSNSLTRTSPSNTEDNNEMFSX

SEQ ID NO: 6918 - protein, 88 aa, Homo sapiens [sequence omitted]

SEQ ID NO: 6919 - protein, 72 aa, Homo sapiens
MHSRQIMQLNEQLKAVYEFQDLKDTIERAKNEADLLLEDLQEEIDLQSSVLNASIAGLLRKHQEILSHIIIC

SEQ ID NO: 6920 - protein, 68 aa, Homo sapiens
MAPAGMSGAQDNSCLYQEIAPSFQRLPCPRYLMSCPWQFSTPDVGLTPIRLPFLCGKTEPRRDISQKP

SEQ ID NO: 6921 - protein, 69 aa, Homo sapiens
MTCPCGWRLSRVAQEAQGPGVACKGREQLFSRKDPKGSKAKGAICFPTDSEDKQEKCPVSPILLVLIFQ

SEQ ID NO: 6922 - protein, 69 aa, Homo sapiens
  UNSURE 61: Xaa = Pro,Arg
MTCPCGWRLSRVAQEASRAGVACKGREQLFSRKDPKGSKAKGAICFPTDSEDKQEKCPVSXILLVLIFQ

SEQ ID NO: 6923 - protein, 57 aa, Homo sapiens [sequence omitted]

SEQ ID NO: 6924 - protein, 113 aa, Homo sapiens
  UNSURE 97: Xaa = Pro,Gln
MSPELSGIHSIYSAWVTSVNITDCKPPSISGAAHQGPTAPGRMVRILANGEIVQDDDPRVRTTTQPPRGSIPRQSFFNRGHGAPPGVLAPASSRQVXGWVLLSPPSMTSTGSW

SEQ ID NO: 6925 - protein, 121 aa, Homo sapiens [sequence omitted]

SEQ ID NO: 6926 - protein, 70 aa, Homo sapiens
  UNSURE 38: Xaa = Gln,Arg
MDSHSSDYSATLKADPETKIHLQVIHLQGKLSSVGGKXKTVESTEPWTVTQRMSTRSSLLCHSVLKIFLR

SEQ ID NO: 6927 - protein, 57 aa, Homo sapiens [sequence omitted]

SEQ ID NO: 6928 - protein, 79 aa, Homo sapiens
  UNSURE 71: Xaa = Ala,Pro
  UNSURE 70: Xaa = Asp,Glu
MRYNEKELQALSRQPAEMAAELGMRGPKKGSVLKRRLVKLVVNFLFYFRTDEAEPVGALLLERCRVVREXXRHLLHQLH

SEQ ID NO: 6929 - protein, 57 aa, Homo sapiens
MVSHCVTQAGLKPLAPSNLPASASQSAGITGMSHHASPCELICKNGTMKTPRPTHLP

SEQ ID NO: 6930 - protein, 99 aa, Homo sapiens
  UNSURE 97: Xaa = Pro,Thr
MEGVCGRLPRTPRRALFLLELEPAPGVFLGARALPLNGLCLQTICCADHEPSPQCQTDSSSGPAVPLGPLRKAQKPGTPNRVQLLPTALLGAAHLVXCV

SEQ ID NO: 6931 - protein, 118 aa, Homo sapiens
MAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEEQNLLTQKMLPD

SEQ ID NO: 6932 - protein, 75 aa, Homo sapiens
  UNSURE 74: Xaa = Glu,Gln
MADGQVAELLLRRLEASDGGLDSAELAAELGMEHQAVVGAVKSLQALGEVIEAELRSTKHWELTAEGEEIAREXP

SEQ ID NO: 6933 - protein, 104 aa, Homo sapiens
MQFDHNAGQSRASLSHSSHSSQSSSKERAPLFTPSHPQQTDRTGPSPGSPGTNRKKKWFTDEPDNAYPRNIQIKPMSTHMANQINQYKSTSSLIPPIREVEDEC

SEQ ID NO: 6934 - protein, 84 aa, Homo sapiens
MVVSFDPSREYVVDIRITWGDFTKHLCLGFFGANRKKNEELCTMVTKEPQHDFRPSAPSITCFTMSDPVWRSPPSAGEPGRRSP

SEQ ID NO: 6935 - protein, 57 aa, Homo sapiens [sequence omitted]

SEQ ID NO: 6936 - protein, 57 aa, Homo sapiens
  UNSURE 55: Xaa = Phe,Val
MSSGGSPGCLRLAEGCPNHRAWVRWNKRQPHSAFLIASHLFLSVLVWFNSFRVGXGK

SEQ ID NO: 6937 - protein, 59 aa, Homo sapiens
MNMYIIKSLYFGLSETDYLFSSPHDGSLSCFQLLKFHNYPQIWMCPSKGLAMSTSPAES

SEQ ID NO: 6938 - protein, 81 aa, Homo sapiens
  UNSURE 61: Xaa =  * ,Cys,His,Lys,Asn,Pro,Gln,Arg,Ser,Thr,Trp,Tyr
  UNSURE 63: Xaa = Asn,Ser
  UNSURE 60: Xaa = Glu,Val
  UNSURE 68: Xaa = His,Pro,Gln,Arg
  UNSURE 57: Xaa = Ile,Lys,Met
  UNSURE 65: Xaa = Met,Val
  UNSURE 78: Xaa = Pro,Ser
  UNSURE 62: Xaa = any one of the twenty amino acids
MSVGFIGAGQLAFALAKGFTAAGVLAAHKIMASSPDMDLATVSALRKMGVKLTPHNXETXXXXDXLFXAVKHTSSPSXWMK

SEQ ID NO: 6939 - protein, 70 aa, Homo sapiens
MEEKGSSMTDGAPLVKIKQSLTKLKQETVEMDIRIGIVEHTLLQSKLKEKSNMTRNMHATVIPEPATGFY

SEQ ID NO: 6940 - protein, 50 aa, Homo sapiens
  UNSURE 5: Xaa =  * ,Gly
  UNSURE 8: Xaa = Glu,Gly
  UNSURE 13: Xaa = Gly,Arg
  UNSURE 12: Xaa = Ile,Leu,Met
MPSDXGLXEERXXALVHTRWSRSPTPRELATKPKVQQPRLKRRFHFSQTT

SEQ ID NO: 6941 - protein, 65 aa, Homo sapiens
MIAGPVECGERGGSFFPRGPCQGLLQSQWVPSPKPSSPGGKRFSSPWERGSWKWLWAFLGEALTE

SEQ ID NO: 6942 - protein, 74 aa, Homo sapiens [sequence omitted]

SEQ ID NO: 6943 - protein, 62 aa, Homo sapiens
MISAHCNLHLPDSLASASRVAGITGVHHHARLTFLFLTGTGFHHVGQAGLELLTNMEEPRLY

SEQ ID NO: 6944 - protein, 80 aa, Homo sapiens [sequence omitted]

SEQ ID NO: 6945 - protein, 65 aa, Homo sapiens
  UNSURE 65: Xaa = Arg,Thr
  UNSURE 62: Xaa = Asn,Ser,Thr
  UNSURE 54: Xaa = Asp,His
  UNSURE 12: Xaa = Gln,Arg
MIISRHLPSVSXLPFHPQLHPQQMIISRHLPSVCGGRFHPQRMIISRHLPSVSXSPSTLSSXLSX

SEQ ID NO: 6946 - protein, 69 aa, Homo sapiens
MLPVIRSTTGGDSVQTCTNPLDTFFPFDPCVLKRSKKFIDPIYQVWEDMSAEELQEFKKPMKKLFWRIM

SEQ ID NO: 6947 - protein, 59 aa, Homo sapiens
MRGCVGAQVEGGDLGVQTAGKPGSPSSTPSSPSTHLPNWDILKLFTPKRKKNVIFRYIL

SEQ ID NO: 6948 - protein, 59 aa, Homo sapiens; identical to SEQ ID NO: 6947

SEQ ID NO: 6949 - protein, 59 aa, Homo sapiens; identical to SEQ ID NO: 6947

SEQ ID NO: 6950 - protein, 59 aa, Homo sapiens; identical to SEQ ID NO: 6947

SEQ ID NO: 6951 - protein, 59 aa, Homo sapiens; identical to SEQ ID NO: 6947

SEQ ID NO: 6952 - protein, 59 aa, Homo sapiens; identical to SEQ ID NO: 6947

SEQ ID NO: 6953 - protein, 66 aa, Homo sapiens
MLHPRPESEIGRPATPPHRGIRSSHPEWPVRRLNCDFEAVSATRQPSSEQDSGFLKAVIGGPLQRC

SEQ ID NO: 6954 - protein, 53 aa, Homo sapiens
MGVKMNSADFLPDSSPFSVFRLLHHVLVPGSVKGLLFGWKKPLEKLLKSHVHK

SEQ ID NO: 6955 - protein, 66 aa, Homo sapiens
MFSSRATHFLPPIADSTSLRTKEPDTSFNPETLQPYSSAKIPKTSCLGSNTLFTTINSLFCFVYVI

SEQ ID NO: 6956 - protein, 156 aa, Homo sapiens
METVNEPETGEVSKDAVIVKQEKNNEYCLQDIDDKLSESAEDDGEDDTNDEDDDEDSNPKKNTQAPLELMAEFLRAEMAREYQLAKKLCQMILIYEPENPEAKEFFTLIEEMLLMEKTQNHEQDGENSDEDSSGESKGESDEELSDESSDEGEDGS

SEQ ID NO: 6957 - protein, 72 aa, Homo sapiens
MLIHTDLENTGITSHMWWRGNQDDYQLVRKLGRGKYSEVFEAINITNNEKVVVKILKVSTRDNFRGIWNIDF

SEQ ID NO: 6958 - protein, 59 aa, Homo sapiens
MSASQTYWCLASSKAVLTTASAESWTHWATSCQCWLPSGRATMSCRLMATAAATPAWEE

SEQ ID NO: 6959 - protein, 91 aa, Homo sapiens
  UNSURE 25: Xaa = Arg,Thr
MISAAQLLDELMGRDRNLAPDEKRXTCGGTTRAFVNIISVVFVLRNCSQIHVLILMYLEEEITLEMSANFWKMTSGWRSSSKRNRAEQPVP

SEQ ID NO: 6960 - protein, 76 aa, Homo sapiens
  UNSURE 25: Xaa = Arg,Thr
MISAAQLLDELMGRDRNLAPDEKRXTCGGTTRAFVNIISVVFVLRNCSQIHVLILVRVKKFMMKIYENSMRRALVS

SEQ ID NO: 6961 - protein, 55 aa, Homo sapiens
  UNSURE 45: Xaa = Lys,Asn
MKVGYERDFLRYLQSLLAEVERRIRRGHARLALSQNQQSSGAAGXQAKMKKKFRF

SEQ ID NO: 6962 - protein, 110 aa, Homo sapiens
  UNSURE 99: Xaa = Ala,Glu,Val
  UNSURE 5,11: Xaa = Asp,Glu
MIESXNLNQEXIIKELCLCNGLSYEMVGQEGSDTSKLEMFFLGYPRIVGLSLFPNLTSLTIVAQDIKEISGLEPCLQLKELWIAECCIEVSVNIKPHMXYFILNYLALEK

SEQ ID NO: 6963 - protein, 50 aa, Homo sapiens [sequence omitted]

SEQ ID NO: 6964 - protein, 70 aa, Homo sapiens
MVSNHMCFLQLFLLFWPNNPKNPYHSTKLDHHLCTHFDYEYTTTLHFCLHHVFQETRLLLSRVNLSVKKM

SEQ ID NO: 6965 - protein, 60 aa, Homo sapiens
MNVGTMFNLRMANCPRSLNLFGAYQLREKFEDAAKPSPANPSTPPTSILMGIVLGCAEDL

SEQ ID NO: 6966 - protein, 70 aa, Homo sapiens [sequence omitted]

SEQ ID NO: 6967 - protein, 54 aa, Homo sapiens [sequence omitted]

SEQ ID NO: 6968 - protein, 50 aa, Homo sapiens
MPTNSQKREIVISNKNVGRAQWLTPVIPALWEARVGGSLESRSSRPTLAI

SEQ ID NO: 6969 - protein, 104 aa, Homo sapiens
MLWVQRKRRRKETSECPSDKDKSPESHKAKNESWIKSHFSRLSEEKLALDNNASASGNATQTESGSEEVSSTVHIETFTTRHGEVGSALHRESFTAGRRHLGPQ

SEQ ID NO: 6970 - protein, 68 aa, Homo sapiens [sequence omitted]

SEQ ID NO: 6971 - protein, 65 aa, Homo sapiens
MAPVLPSVLKLPVRSLTYFSARKGKRKTVKAVIDRFLRLHCGLWVRRKAGYKKKLWKKTPARRSD

SEQ ID NO: 6972 - protein, 84 aa, Homo sapiens
  UNSURE 49: Xaa = Asp,His
MASGLVRLLQQGHRCLLAPVAPKLVPPVRGVKKGFRAAFRFQKELERQXFCGARRRPCAVQRSRTGITMQKYKLLDIGYRKTFP

SEQ ID NO: 6973 - protein, 78 aa, Homo sapiens
MGRMAGLQSDFTLNHSGWGLFLILPHKATIVETWLCSCDEARQRNGFWDQSESSMYVYVTRPNLRAFSHVLFSQNHWG

SEQ ID NO: 6974 - protein, 66 aa, Homo sapiens [sequence omitted]

SEQ ID NO: 6975 - protein, 55 aa, Homo sapiens
  UNSURE 51: Xaa = Ala,Asp,Gly,Val
  UNSURE 50: Xaa = Lys,Pro,Gln,Arg,Thr
MKGFKGQLSRQVADQMWQSGKRQASRAFRLYANIDILRPYFDVEPAQVRXXSWSP

SEQ ID NO: 6976 - protein, 94 aa, Homo sapiens
  UNSURE 44: Xaa = Gly,Trp
  UNSURE 42: Xaa = His,Asn
  UNSURE 48: Xaa = Lys,Thr
  UNSURE 47: Xaa = Pro,Ser
MSSYTRKEPGGGTKSLDCKIEESAETPALEDSSSSPVDSQQXSXQVXXDIENTERDMREMKNLLSKLRETMPLPLKNQGESCHFSLRQRMFLMG

SEQ ID NO: 6977 - protein, 75 aa, Homo sapiens [sequence omitted]

SEQ ID NO: 6978 - protein, 56 aa, Homo sapiens
MMALCTKFLQTIIICIVCSAIYLAVNHVLHCDISYSEPLCMCLCSALNYSMPVPYS

SEQ ID NO: 6979 - protein, 56 aa, Homo sapiens; identical to SEQ ID NO: 6178
  UNSURE 26: Xaa = Ser,Thr

SEQ ID NO: 6980 - protein, 123 aa, Homo sapiens
  UNSURE 122: Xaa = Ala,Pro,Ser,Thr
  UNSURE 99: Xaa = Gly,Trp
MASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVXLRMGNGALHGDHQRFSTFAGFLXL

SEQ ID NO: 6981 - protein, 141 aa, Homo sapiens
MNARGLGSELKDSIPVTELSASGPFESHDLLRKGFSCVKNELLPSHPLELSEKNFQLNQDKMNFSTLRNIQGLFAPLKLQMEFKAVQQVQRLPFLSSSNLSLDVLRGNDETIGFEDILNDPSQSEVMGEPHLMVEYKLGLL

SEQ ID NO: 6982 - protein, 141 aa, Homo sapiens; identical to SEQ ID NO: 6981

SEQ ID NO: 6983 - protein, 56 aa, Homo sapiens
MLSIKCHLTCFAHLIFITLSSFSRNDFWQLTGSTLSVHTVPNSALSTLLGFSTTIL

SEQ ID NO: 6984 - protein, 76 aa, Homo sapiens
MREDGSLATFLGRRHLLLRRCGIPKELTVLIGIAEKAGDMKAIVEVTSGRGDLIVAHKRTGIVNHITSLKNLIVII

SEQ ID NO: 6985 - protein, 76 aa, Homo sapiens; identical to SEQ ID NO: 6984

SEQ ID NO: 6986 - protein, 64 aa, Homo sapiens
MQLKYHEKAADKGVYIIGSSGFDSIPADLGVIYTRNKMNGTLTAVESFLTIHSGPEGLSIHDGT

SEQ ID NO: 6987 - protein, 70 aa, Homo sapiens
MGDIPAAVNAFQEAASLLGKKYGETANECGEAFFFLWEITSGVRKNGEWCVGKRLGRCACGRGRRRKNRR

SEQ ID NO: 6988 - protein, 81 aa, Homo sapiens
  UNSURE 70: Xaa = Glu,Gly
MSGCRVFIGRLNPAAREKDVERFFKGYGRIRDIDLKRGFGFVEFEDPRDADDAVYELDGKELCSERVTIXHARARSRGWKR

SEQ ID NO: 6989 - protein, 124 aa, Homo sapiens
MGEFKVHRVRFFNYVPSGIRCVAYNNQSNRLAVSRTDGTVEIYNLSANYFQEKFFPGHESRATEALCWAEGQRLFSSGLNGEIMEYDLQALNIKYAMDAFGGPIWSMAASPVALNFWLVVKMDL

SEQ ID NO: 6990 - protein, 68 aa, Homo sapiens
MEFIVLLAPKRSSSRLLCDTSDYFKHWGDCDWLGHFSSHIVNVWEGRKNFRGVPFVAKASSKQSYELT

SEQ ID NO: 6991 - protein, 55 aa, Homo sapiens; identical to SEQ ID NO: 6534

SEQ ID NO: 6992 - protein, 58 aa, Homo sapiens
MSIPLTWGQVEQSCGQLHLPQPFLKDPGPQKSQDPVFKDCSALPPHPVSNNRTFQQRF

SEQ ID NO: 6993 - protein, 64 aa, Homo sapiens
MFLQYYLNEQGDRVYTLKKFDPMGQQTCSAHPARFSPDDKYSRHRITIKKRFKVLMTQQPRPVL

SEQ ID NO: 6994 - protein, 64 aa, Homo sapiens
MFLQYYLNEKGDRVYTLKKFDPMGQQTCSAHPARFSPDDKYSRHRITIKKRFKVLMTQQPRPVL

SEQ ID NO: 6995 - protein, 64 aa, Homo sapiens; identical to SEQ ID NO: 6993

SEQ ID NO: 6996 - protein, 66 aa, Homo sapiens
MFLQYYLNEQGDRVYTLKEQKFDPMGQQTCSAHPARFSPDDKYSRHRITIKKRFKVLMTQQPRPVL

SEQ ID NO: 6997 - protein, 99 aa, Homo sapiens
  UNSURE 63: Xaa =  * ,Glu,Gly
  UNSURE 56: Xaa =  * ,Leu,Trp
  UNSURE 57: Xaa = Asn,Thr
  UNSURE 50,52: Xaa = Cys,Phe,Leu,Arg,Trp
  UNSURE 68: Xaa = Glu,Val
  UNSURE 58: Xaa = His,Ile,Leu,Asn
  UNSURE 55: Xaa = His,Lys,Asn,Gln
  UNSURE 49: Xaa = Ile,Asn
  UNSURE 62: Xaa = Leu,Arg
  UNSURE 53,60: Xaa = Leu,Arg,Trp
  UNSURE 65: Xaa = Lys,Gln
  UNSURE 67: Xaa = Phe,Ser
MLPLWLILRPERNLGNCEHQRPSPGQSLGHVGTTFGKVVVKHFPAHTWXXNXXGXXXXSXVXXPXFXXDSGMELEAVILSTLTQEQKTKHCMFPLISES

SEQ ID NO: 6998 - protein, 52 aa, Homo sapiens [sequence omitted]

SEQ ID NO: 6999 - protein, 191 aa, Homo sapiens
MKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 7000 - protein, 79 aa, Homo sapiens [sequence omitted]

SEQ ID NO: 7001 - protein, 115 aa, Homo sapiens
MKWFPEHRTIKLKKRTEGTEERGTVLEHHTSTSEEIRKEGGGCSHGSSTRPALQPTSPSHQVKGIFQLDQPDGLTVHSHTIQLRKGDTLNICSRITPTNIFNIKPLKKSSKEIEA

SEQ ID NO: 7002 - protein, 54 aa, Homo sapiens
MQFFRLSTARLLASETVIRNCLSSLQVDTQEQNLRGTSLWSINITTVFGRHKFK

SEQ ID NO: 7003 - protein, 54 aa, Homo sapiens [sequence omitted]

SEQ ID NO: 7004 - protein, 78 aa, Homo sapiens
MSESELGRKWDRCLADAVVKIGTGFGLGIVFSLTFFKRRMWPLAFGSGMGLGMAYSNCQHDFQAPYLLHGKYVKEQEQ

SEQ ID NO: 7005 - protein, 65 aa, Homo sapiens [sequence omitted]

SEQ ID NO: 7006 - protein, 69 aa, Homo sapiens
MDAPRQVVNFGPGPAKLPHSVLLEIQKELLDYKGVGISVLEMSHRSSDFAKIIKYRESCAGIASCSRQL

SEQ ID NO: 7007 - protein, 94 aa, Homo sapiens
MAQKEPRTIKISLPGGQKIDAVAWNTTPYQLARQISSTLADTAVAAQVNGEPYDLERPLETDSDLRFLTFDSPEGKQCSGTPAPMSWGQQLNNS

SEQ ID NO: 7008 - protein, 51 aa, Homo sapiens [sequence omitted]

SEQ ID NO: 7009 - protein, 89 aa, Homo sapiens
  UNSURE 54: Xaa =  * ,Gly
  UNSURE 70: Xaa = Cys,Phe,Ser,Tyr
MASFPPRVNEKEIVRLRTIGELLAPAAPFDKKCGRENWTVAFAPDGSYFAWSQXHRTVKLVPWSSAFRTXSCMAPRMYQFKQFKIAKTK

SEQ ID NO: 7010 - protein, 140 aa, Homo sapiens [sequence omitted]

SEQ ID NO: 7011 - protein, 126 aa, Homo sapiens
  UNSURE 46: Xaa = Ile,Val
  UNSURE 116: Xaa = Lys,Arg
MAPGEVTITVRLIRSFEHRNFKPVVYHGVNLDQTVKEFIVFLKQDXPLRTNLPPPFRNYKYDALKIIHQAHKSKTNELVLSLEDDERLLLKEDSTLKAAGIASETEIAFFCEEDYXNYKANPISSW

SEQ ID NO: 7012 - protein, 84 aa, Homo sapiens
MAVWPEVSQNRLTRGLLLPNYQLRGSVPKREKRPKRKHQHLFTPSERHSVCLDCLLEISLSGKQWRNVISFNCFCTTKTLFWVN

SEQ ID NO: 7013 - protein, 60 aa, Homo sapiens
MWAARSSNVCSQPAGRDQGWTEEYGLCCRLFVVPNCCIKQGVISCIAMHEWIPSKLCQAA

SEQ ID NO: 7014 - protein, 92 aa, Homo sapiens
  UNSURE 68: Xaa = Lys,Met,Arg,Thr
MLRHLMYKIKSTGPITVAEYMKEVLTNPAKGYYVYRDMLGEKGDFITSPEISQIFGELLGIWFISEWXATGKSTAFQLVELGPGRGTSWEIF

SEQ ID NO: 7015 - protein, 91 aa, Homo sapiens
MDSVAFEDVAVSFTQEEWALLDPSQKNLYRDVMQETFKNLTSVGKTSKVQNIEDEYKNPRRNLRGSFALVAQAGVQWRDLGSLQPPPPRFN

SEQ ID NO: 7016 - protein, 57 aa, Homo sapiens
MGGYCIEFPAGLIDDGETQKQLLSGSLKKKLATKGTLPNVLQRSVWTQACQTVLYTS

SEQ ID NO: 7017 - protein, 95 aa, Homo sapiens
MEGGFGSDFGGSGSGKLDPGLIMEQVKVQIAVANAQELLQRMTDKCFRKCIGKPGGSLDNSEQKCIAMCMDRYMDAWNTVSRAYNSRLQRERANM

SEQ ID NO: 7018 - protein, 72 aa, Homo sapiens
MPVIPALWEARTEECLSSGIQDQPGQHGETCLYKNYKKLARIRAAPNLLVVRKMAASKLVLNNCLKVKASNW

SEQ ID NO: 7019 - protein, 95 aa, Homo sapiens; identical to SEQ ID NO: 7017

SEQ ID NO: 7020 - protein, 87 aa, Homo sapiens
MEQVKVQIAVANAQELLQRMTDKCFRKCYRETWGLPGQLRAEVHRHVHGPLHGRLEHRVSRLQLAAAAGNEPTCDRRARATPPCSFP

SEQ ID NO: 7021 - protein, 95 aa, Homo sapiens; identical to SEQ ID NO: 7017

SEQ ID NO: 7022 - protein, 59 aa, Homo sapiens
  UNSURE 4: Xaa = Ala,Ser
MKLXKVVPQQMNLNANWRDQQSPAYRHKSLTTPRSHCLFQRSKEGLLKWLHCFIETRSS

SEQ ID NO: 7023 - protein, 85 aa, Homo sapiens
MTYYDHADFHHSVKSPELYETEPTNKDISAPVDAVPEAQAARQKKISFNFSEIMASTGWNSELKLLRILQDTDDEDEEDQSSGAE

SEQ ID NO: 7024 - protein, 71 aa, Homo sapiens
MGQQPTSSKLSKVSISGDLRILPCPSASGKECPFLRVPPSPCPPACLPLPTTTICSALESPVVLDEKGTLK

SEQ ID NO: 7025 - protein, 108 aa, Homo sapiens
  UNSURE 92: Xaa = His,Gln
MAGEQKPSSNLLEQFILLAKGTSGSALTALISQVLEAPGVYVFGELLELANVQELAEGANAAYLQLLNLFAYGTYPDYIANKESLPELSTAXAEQAEASYHRELGIKE

SEQ ID NO: 7026 - protein, 55 aa, Homo sapiens [sequence omitted]

SEQ ID NO: 7027 - protein, 62 aa, Homo sapiens
MFQLNWAIFYCLKNLSETCISNLSRKKPKNQGVQCCRSELFSFLSPSMFKITLVYPLRRAEV

SEQ ID NO: 7028 - protein, 61 aa, Homo sapiens
  UNSURE 48: Xaa = Gln,Arg
  UNSURE 41: Xaa = Gly,Val
  UNSURE 39: Xaa = Ile,Val
  UNSURE 14: Xaa = Phe,Val
MTAGAMAGILEHSXMYPVDSVKTRMQSLSPDPKAQYTSXYXALKKIMXTEASGGPCEASTS

SEQ ID NO: 7029 - protein, 55 aa, Homo sapiens
MSTLGDYFFLPSARQKTAVGIWFLFAYFHPQLCQKRKQCLKQFTKISIWNHQEWN

SEQ ID NO: 7030 - protein, 55 aa, Homo sapiens [sequence omitted]

SEQ ID NO: 7031 - protein, 66 aa, Homo sapiens
  UNSURE 27: Xaa = His,Gln
MSQDNDTLMRDILGHELAAMRLQKLEXSGGCLKRSSDRSARSSSWFRPILTLPRGFGALVCGRSAF

SEQ ID NO: 7032 - protein, 60 aa, Homo sapiens
MSIEVHGKHEERQDEHGFISREFHRKYRIPADVDPLTITSSLSSDGVLTVNGPRKQVSGP

SEQ ID NO: 7033 - protein, 65 aa, Homo sapiens
  UNSURE 59: Xaa = Phe,Ile
MPFGWLGGSHSKVRESSVGFTIFKDEGALGTYSENLQSTQRFLNVSTCIKLTFHRARTXQGFEFQ

SEQ ID NO: 7034 - protein, 98 aa, Homo sapiens
MPSEKTFKQRRTFEQRVEDVRLIREQHPTKIPVIIERYKGEKQLPVLDKTKFLVPDHVNMSELIKIIRRRLQLNANQAFFLLVNGHSMVSVSTPMRGV

SEQ ID NO: 7035 - protein, 58 aa, Homo sapiens
MSQDCHETIWILYSGSFISSICISLNCPSFWNTEMLMHMPLPMEGHKDEFPPGSTTGC

SEQ ID NO: 7036 - protein, 77 aa, Homo sapiens
  UNSURE 36: Xaa = Gly,Arg
MAWALQAADTCPEVKMVGLEGSDKLTILRGCPGLPXAPGPRERQAPMEREENVAPLDLLGRQDHLGPTEHLGSPSRA

SEQ ID NO: 7037 - protein, 52 aa, Homo sapiens
MKLPNMIHIQRLLRNQCGKCKTKGESILNHSSKNMVSIKKTRISEKSPKLCS

SEQ ID NO: 7038 - protein, 131 aa, Homo sapiens
MPPKGKSGSGKAGKGGAASGSDSADKKAQGPKGGGNAVKVRHILCEKHGKIMEAMEKLKSGMRFNEVAAQYSEDKARQGGDLGWMTRGSMVGPFQEAAFALPVSGMDKPVFTDPPVKTKFGYHIIMVEGRK

SEQ ID NO: 7039 - protein, 68 aa, Homo sapiens
MGWRRKRVPQRGRKAPPPQLHGNINNLYFPIRWRDRLHWDSPNPAAECQRPRSDVGLPKARARPDHVG

SEQ ID NO: 7040 - protein, 61 aa, Homo sapiens
MFFPTRGGSDHVSSMEAFKSRPAEAASLSELGRHNPHRSAWSTELHTHGASGRWAAAGALF

SEQ ID NO: 7041 - protein, 57 aa, Homo sapiens
MAKLIQKKLQGEVEKYQQLQKDLSKSMSGRQKLEAQLTENQYRERGTGPAGWVQRGL

SEQ ID NO: 7042 - protein, 77 aa, Homo sapiens
MSVAFVPDWLRGKAEVNQETIQRLLEENDQLIRCIVEYQNKGRGNECVQYQHVLHRNLIYLATIADASPTSTSKAME

SEQ ID NO: 7043 - protein, 85 aa, Homo sapiens
MEFDLGAALEPTSQKPGVGAGHGGDPKLSPHKVQGRSEAGAGPGPKASNFRGLGKGRRLTAAPPSSKDTTALPTPAAAPAIRTRM

SEQ ID NO: 7044 - protein, 62 aa, Homo sapiens
  UNSURE 7: Xaa =  * ,Tyr
MPEATKXRWSPESPGPAGSRGMSSLHRGCRAAMPPSTWPERTSSTLSEDGMKPSKKRFSAAA

SEQ ID NO: 7045 - protein, 88 aa, Homo sapiens
MTTGKNSLWSIKQTTTTMNLVVSSRHTESESLDIEDRRKNTKLRIIIQNLKCFMNHFILKLEVRCKETNLSLRILKVNLESTKININS

SEQ ID NO: 7046 - protein, 91 aa, Homo sapiens
MSAWELTHLSGKEGMASQPTEAHWGHRTSPQSRDSPSRKSDQALRGHGLRTRSREDTVTNPWLIWQVWEAARPVASPAPPDLCLQLSCSLG

SEQ ID NO: 7047 - protein, 50 aa, Homo sapiens
MFSSCSQKIFLNRKSDDYRVGCDFPLSITNLLCGKRYAHYYHLEDVVKNM

SEQ ID NO: 7048 - protein, 58 aa, Homo sapiens
  UNSURE 11: Xaa = Leu,Val
MALCALTRALXSEPGAPDRRRPCPESVPRRPDDEQWPPPTALCLDVAPLPPSSYFCGP

SEQ ID NO: 7049 - protein, 50 aa, Homo sapiens [sequence omitted]

SEQ ID NO: 7050 - protein, 54 aa, Homo sapiens
  UNSURE 52: Xaa = Asp,Glu
MSHEAAPQPQPRARGDGFAQQHPSGLFLCLRCVFEKMRRSQTCILNWNGSKXKV

SEQ ID NO: 7051 - protein, 54 aa, Homo sapiens [sequence omitted]

SEQ ID NO: 7052 - protein, 74 aa, Homo sapiens
MGAKSVGPLQYASHMEPQVCLHASEAQEGLQKFKVVRAGVHAPEEVGPREQVCGGARAPLRPQNRSPLRPLRTP

SEQ ID NO: 7053 - protein, 66 aa, Homo sapiens
MYTNPPTFLKTVLERWLSRRTDRRAYRRQKKKQMKIHIIQKKKKTTMHVYGGCTFCESDMFLSFTQ

SEQ ID NO: 7054 - protein, 56 aa, Homo sapiens
MGTFQRSSLGEGAGSASPWRLRAAGPGSSSPPVEARAPSETTLANVNAEPRRCCHG

SEQ ID NO: 7055 - protein, 109 aa, Homo sapiens
  UNSURE 21: Xaa =  * ,Glu
  UNSURE 11: Xaa = Ala,Pro
MARDLIGPALXPGFKARGTAXDEERDPSPVAGPALPPNYKSSSSDSSDSDEDSSSLYEEGNQESEEDDSGPTARKQRKNQDDDDDDDDGFLDQPFLLDLKSRMILLQGP

SEQ ID NO: 7056 - protein, 58 aa, Homo sapiens
MLPSFLSLWPWEKEAICSAGVSCSLPTFPMLKAQPSVDAQVDVDGSTKSRGPAQLLAT

SEQ ID NO: 7057 - protein, 74 aa, Homo sapiens [sequence omitted]

SEQ ID NO: 7058 - protein, 63 aa, Homo sapiens
MCFVKQLLEGSMLLESHHHSLISSTQGHKHCGRPQDLCLGKPGIVQGFSPCDSLNMASWEGKD

SEQ ID NO: 7059 - protein, 59 aa, Homo sapiens
MQLHPVADSSPAGAKWTETEIEMLRAAVKRFGDDLNHISCVIKERTVAQIKATVKRKTA

SEQ ID NO: 7060 - protein, 68 aa, Homo sapiens
MRTSRISFVGKESLFKDVHWPSREELLLQLKIGLELTGDLALDGRKRCSCRFGSSHTGGRGKLAVCSS

SEQ ID NO: 7061 - protein, 57 aa, Homo sapiens [sequence omitted]

SEQ ID NO: 7062 - protein, 59 aa, Homo sapiens
MLYCHSGHTQVVQYLNGEAARLVRAALLKCDDFHMPSFSFSLSFFFLFWPNVEDVELCF

SEQ ID NO: 7063 - protein, 102 aa, Homo sapiens
MARWRRPAAGTAVQRQEEIREGLRDRGAAEQEHGLNFQRLLDTSTYKEAFRKDMIRWGEEKRQADPGFFCRKIVEGISQPIWLVSDTRRVSDIQWFREAYGA

SEQ ID NO: 7064 - protein, 105 aa, Homo sapiens
  UNSURE 82: Xaa = Asp,Ile,Asn,Val
  UNSURE 60: Xaa = Asp,Val
  UNSURE 62: Xaa = Glu,Lys
  UNSURE 63: Xaa = Phe,Ile
  UNSURE 19: Xaa = Phe,Leu,Val
MKLLTRSRLFSRDFIPSKXAPKVKATAAPAGAPPQPQDLEFTKYTKWLGDCFFGKLIPRXQXXGLSIKAGSRYEDFSNLGTXPFAASYIQSDDKRSFIFQDNPWN

SEQ ID NO: 7065 - protein, 96 aa, Homo sapiens
MAESEDRSLRIVLVGKTGSGKSATANTILGEEIFDSRIAAQAVTKNCQKASREWQGRDLLVVDTPGLFDTKESLDTTCKKSAAASSPPAQGPMLLS

SEQ ID NO: 7066 - protein, 81 aa, Homo sapiens
MKESGMEQTHHLPKKAEGETVPLLRDTMTLMPVSMKGTEKSTTSDRSSLMMATEGFDDLPKLPRVPLSAYDTAADRRNVPE

SEQ ID NO: 7067 - protein, 64 aa, Homo sapiens
MKESGMEQTHHLPKKAEGETVPLLRDTMTLMPVSMKGTEKSTTSDRSSLMMATEGFDDLPKLPR

SEQ ID NO: 7068 - protein, 58 aa, Homo sapiens [sequence omitted]

SEQ ID NO: 7069 - protein, 83 aa, Homo sapiens
  UNSURE 49: Xaa = Ala,Val
MASTPMGNEGEKKSSWPSQAAPSLRGGPASLSRSEEYLSQISAELMEEXLCTACCHLNPVPIKKKQSQDQATQISKRAFFTKT

SEQ ID NO: 7070 - protein, 76 aa, Homo sapiens
  UNSURE 13: Xaa = Pro,Ser,Thr
MASCPKTFSAARXGAGGSAGQHPGPRIPARSRGERCGEDRPRARRTGSGPDAQAQIPSSFFGSIFKSRQRSIPSLS

SEQ ID NO: 7071 - protein, 133 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVWISVNTFLFLVYLLYKRCALKMLVYNN

SEQ ID NO: 7072 - protein, 58 aa, Homo sapiens
  UNSURE 3: Xaa = Asp,Glu
MRXERDALTVGAPQERSRGAAETTNLQFGEGFCAGETTRVLPPERTPCGLVSGPAMSA

SEQ ID NO: 7073 - protein, 63 aa, Homo sapiens; identical to SEQ ID NO: 6483

SEQ ID NO: 7074 - protein, 65 aa, Homo sapiens
MNVSTFLAYDQPTISYCGVHHELLSHKSFETNAQEDTMETHLETELDLSTITTAGRISDHKQQLA

SEQ ID NO: 7075 - protein, 97 aa, Homo sapiens
MSLADELLADLEGQQKRRKEEAMGQEEEPAIEDVQEETQLDLSGDSVKTIAKLWDSKMFAEIMMKIEEYISKQAKASEVMGPVEAALNTASSWMPTT

SEQ ID NO: 7076 - protein, 65 aa, Homo sapiens
  UNSURE 13: Xaa = Ala,Thr
  UNSURE 14: Xaa = Ile,Met
MNVSTFLAYDQPXXSYCGVHHELLSHKSFETNAQEDTMETHLETELDLSTITTAGRISDHKQQLA

SEQ ID NO: 7077 - protein, 79 aa, Homo sapiens
MEESDRPCEISEIDDNPKISENPRRSPTHEKNTMGAQEAHIYVKTVAGSEEPVHDRYRPTIEMERRRGLWWLVPGLSLE

SEQ ID NO: 7078 - protein, 152 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKWQEQ

SEQ ID NO: 7079 - protein, 90 aa, Homo sapiens [sequence omitted]

SEQ ID NO: 7080 - protein, 65 aa, Homo sapiens; identical to SEQ ID NO: 7074

SEQ ID NO: 7081 - protein, 114 aa, Homo sapiens
MELAFTEFGREAGLVIKTRSTELSILNIEDMKRKELTEEVKKGDQEEPSKCYPGIQVKTVFQSGNEQCPVTLRVRLESECRLFSFEIYMPQRGSREPISGQLSVFVCQLQHQKA

SEQ ID NO: 7082 - protein, 61 aa, Homo sapiens
  UNSURE 3: Xaa = Asp,Glu
  UNSURE 53: Xaa = Cys,Phe,Ser,Tyr
  UNSURE 48: Xaa = Ile,Asn,Ser,Thr
MAXWAKPMKRSCSAWWPPSSRRRSLLTGHVPVEKILIHCGFWFRRHPXDSLDXEDHMRQCI

SEQ ID NO: 7083 - protein, 111 aa, Homo sapiens
MLRGVLGKTFRLVDYTIQYGCIAHCAFEYVGGVVMCSGPSMEPTIQNSDIVFAENLSRHFYGIQRGDIVIAKSPSDPKSNICKRVIGLEGDKILTTSPSDFFKSHSYVFGN

SEQ ID NO: 7084 - protein, 54 aa, Homo sapiens
MVGNGDGEMALMAQPPEMGYLGGTSFQVEAVLGHGRGCSIGVSAAYIQVQDYVC

SEQ ID NO: 7085 - protein, 54 aa, Homo sapiens
MMNADMDDLSARVDAVKEENLKLKSENQVLGQYIENLMSASSVFQTTDTKSKRK

SEQ ID NO: 7086 - protein, 82 aa, Homo sapiens
MMNADMDAVDAENQVELEEKTRLINQVLELQHTLEDLSARVDAVKEENLKLKSENQVLGQYIENLMSASSVFQTTDTKSKRK

SEQ ID NO: 7087 - protein, 127 aa, Homo sapiens
MISKGVRVVTHYPAVDGEGEQETGDVGNAAGRDLALEGPGPDSTPRHRSPADLVRPRVLRAPVPHALGARADPHAAPTPAGLLLMPSSAKDSRALSGRPRFSAESTRKSPGGRRGAERGRQYLGDDL

SEQ ID NO: 7088 - protein, 80 aa, Homo sapiens
MEHHTDWVNDIVLCCNGKTLISASSDTTVKVWNAHKGFCMSTLRTHKDYVKALAYAKDKELVAAGLDRQIFLWDVNTLTA

SEQ ID NO: 7089 - protein, 67 aa, Homo sapiens [sequence omitted]

SEQ ID NO: 7090 - protein, 170 aa, Homo sapiens
  UNSURE 11: Xaa = Arg,Ser
MAASVLNTVLXRLPMLSLFRGSHRVQVPLQTLCTKAPSEEDSLSSVPISPYKDEPWKYLESEEYQERYGSRPVWADYRRNHKGGVPPQRTRKTCIRRNKVVGNPCPICRDHKLHVDFRNVKLLEQFVCAHTGIIFYAPYTGVCVKQHKRLTQAIQKAGIMVLLIYHIPQG

SEQ ID NO: 7091 - protein, 121 aa, Homo sapiens
MAASVLNTVLRRLPMLSLFRGSHRVQVPLQTLCTKAPSEEDSLSSVPISPYKDEPWKYLESEEYQERYGSRPVWADYRRNHKGGVPPQRTRKTCIRRNKVVGNPCPICRDHKLHVDFRESV

SEQ ID NO: 7092 - protein, 56 aa, Homo sapiens
MARVTSGNLQLWQKGKTHVLHGGRRERERACKCGKDNYTYNIIRSHENSLTIMRPA

SEQ ID NO: 7093 - protein, 51 aa, Homo sapiens [sequence omitted]

SEQ ID NO: 7094 - protein, 84 aa, Homo sapiens
  UNSURE 57: Xaa =  * ,Ala,Glu,Lys,Leu,Met,Pro,Gln,Ser,Thr,Val
  UNSURE 56: Xaa = Ile,Met
MLGPGSNRRRPTQGERGPGSPGEPMEKYQVLYQLNPGALGVNLVVEEMETKVKHVXXQVECMDDHYASQALEEQWGLTILPRLV

SEQ ID NO: 7095 - protein, 88 aa, Homo sapiens [sequence omitted]

SEQ ID NO: 7096 - protein, 99 aa, Homo sapiens
MEPEQMLEGQTQVAENPHSEYGLTDNVERIVENEKINAEKSSKQKVDLQSLPTRAYLDQTVVPILLQGLAVLAKERPPNPIEFLASYLLKNKAQFEDRN

SEQ ID NO: 7097 - protein, 76 aa, Homo sapiens
MEPEQMLEGQTQVAENPHSEYGLTDNVERIVENEKINAEKSSKQKVDLQSLPTRAYLDQTVVPILLQGLAVLAKER

SEQ ID NO: 7098 - protein, 120 aa, Homo sapiens
  UNSURE 118: Xaa = Asn,Tyr
MEPEQMLEGQTQVAENPHSEYGLTDNVERIVENEKINAEKSSKQKVDLQSLPTRAYLDQTVVPILLQGLAVLAKERVLQQRENTAVKYNLKNSANFSQHCFWTFLRVGSGHLQWLNKXHR

SEQ ID NO: 7099 - protein, 143 aa, Homo sapiens [sequence omitted]

SEQ ID NO: 7100 - protein, 72 aa, Homo sapiens [sequence omitted]

SEQ ID NO: 7101 - protein, 82 aa, Homo sapiens
MEPAAFQALYSAEKPKLEDEHLVFFCQMGKRGLQATQAGPGVLDTLGLATTLEPIENGWRKRVRAGGSLLIATPWPLNGHLN

SEQ ID NO: 7102 - protein, 70 aa, Homo sapiens
MEQTEVLKPRTLADLIRILHQLFAGDEVNVEGGAGHHGSLRERPHRVGNVRQVRPVQVYPKSCGSRKWKI

SEQ ID NO: 7103 - protein, 95 aa, Homo sapiens
MPPSCAYGNPKTLAGRDMSSWTSRGTHQLKKTQGAGCQSMLAEEHTNRPEAIDWWNDAYFDQGGQTRVRAAERPNSRGKPSPFWLPHLLRATVTQ

SEQ ID NO: 7104 - protein, 62 aa, Homo sapiens
MPSQVLSTTKMLCHCKCYFPSLFTIPLTTEYNFLKNKYFNKWKFNLGDSHSFDKYILHQALS

SEQ ID NO: 7105 - protein, 55 aa, Homo sapiens
  UNSURE 11: Xaa = Ile,Leu,Pro,Thr
MFLSCLSVDNXLDSHVKDLSWESQGHLGMFDRCVPENKPSDICYIDAELSGDSGL

SEQ ID NO: 7106 - protein, 68 aa, Homo sapiens [sequence omitted]

SEQ ID NO: 7107 - protein, 68 aa, Homo sapiens [sequence omitted]

SEQ ID NO: 7108 - protein, 55 aa, Homo sapiens
  UNSURE 27: Xaa = Cys,Phe
  UNSURE 53: Xaa = Met,Arg
MTVEADPANMFNWTTEEVETCDKGALXQETILIIKAGTETAILATKGCIPEGXRP

SEQ ID NO: 7109 - protein, 53 aa, Homo sapiens
MYPVFYNLTSYIFTHVYENVTFKNGCLIFYCMNMPQFNYFSLWILGCSNLSPL

SEQ ID NO: 7110 - protein, 60 aa, Homo sapiens
MAVTALAARTWLGVWGVRTMQARGFGSDQSENVDRGAGSIREAGGAFGKREQAEEERYFR

SEQ ID NO: 7111 - protein, 75 aa, Homo sapiens
MAVTALAARTWLGVWGVRTMQARGFGSDQSENVDRGAGSIREAGGAFGKREQAEEERYFRALGATFCFFAVEAVV

SEQ ID NO: 7112 - protein, 100 aa, Homo sapiens
MSTGARAPSGKPVGPSERESRLKRNDISDITGYALRSLWGEGLKLNPEPPCPCRAQSREQLAALKKHHEEEIVHHKKEIERLQKEIERHKQKIKMLKHDD

SEQ ID NO: 7113 - protein, 60 aa, Homo sapiens; identical to SEQ ID NO: 7110

SEQ ID NO: 7114 - protein, 106 aa, Homo sapiens
MAVTALAARTWLGVWGVRTMQARGFGSDQSENVDRGAGSIREAGGAFGKREQAEEERYFRAQSREQLAALKKHHEEEIVHHKKEIERLQKEIERHKQKIKMLKHDD

SEQ ID NO: 7115 - protein, 106 aa, Homo sapiens; identical to SEQ ID NO: 7114

SEQ ID NO: 7116 - protein, 74 aa, Homo sapiens
MAVTALAARTWLGVWGVRTMQARGFGSDQSENVDRGAGSIREAGGAFGKREQAEEERYFRAQSREQLAALKKHH

SEQ ID NO: 7117 - protein, 75 aa, Homo sapiens
  UNSURE 10: Xaa = Gly,Arg
MSTGARAPSXEAGGAFGKREQAEEERYFRAQSREQLAALKKHHEEEIVHHKKEIERLQKEIERHKQKIKMLKHDD

SEQ ID NO: 7118 - protein, 80 aa, Homo sapiens
MKKFVSHATCHDSLGLQEQESYLIMGQTSDLWRIKSDYSYVLGKETFLILWPADGDASKKELRDQLEEFLEYMRTHGCQS

SEQ ID NO: 7119 - protein, 104 aa, Homo sapiens
  UNSURE 64: Xaa = His,Gln
MSTLLISSSDALLEELERSTLQDSDEYSNPAPLPLDQHSRKETNLDETSEILSIQDNTSPLPAXSCILPISRSSMSTVKPKSQRNHHRLLKRQQLLSWMSSLLT

SEQ ID NO: 7120 - protein, 53 aa, Homo sapiens [sequence omitted]

SEQ ID NO: 7121 - protein, 68 aa, Homo sapiens
  UNSURE 35: Xaa = Cys,Gly
MAAPWPRVHLCRSLGPVTKESRRRRRPLPPVGPGXREKLPLDVQKSPVVDNVGNKLCNFLWHSVVKNK

SEQ ID NO: 7122 - protein, 90 aa, Homo sapiens
MALRYPMAVGSNKGHKVTKNVSKPRHSRRRGRLDQTHQVRAGHDSGGVWLCPYERRAMELLKVSKDKRAPQIYQEKGGDAHPRQEEAGRS

SEQ ID NO: 7123 - protein, 112 aa, Homo sapiens
MEGLLSPMRTKMTEGRRCQVHLLDDRKLELLVQPKLLAKELLDLVASHFNLKEKEYFGIAFTDETGPQIYQEKGGDAHPRQEEAGGAEQRTGRHEESCCQERLSPSPALSLK

SEQ ID NO: 7124 - protein, 101 aa, Homo sapiens [sequence omitted]

SEQ ID NO: 7125 - protein, 63 aa, Homo sapiens
MSIGLENPFQARGPRGLAAAGPGSHCIPPGTVLVWHTRTEKPKMKQEEQLQRQGRGSDPAIEV

SEQ ID NO: 7126 - protein, 61 aa, Homo sapiens [sequence omitted]

SEQ ID NO: 7127 - protein, 86 aa, Homo sapiens
MYLDIFRVSVQETPCCSNRRSWVLASFARDGLLFSLPSSVLFITPVIVSLVKQPLCCRPRMCVSGADVTPSLFSHPCIHTLFHFLK

SEQ ID NO: 7128 - protein, 67 aa, Homo sapiens [sequence omitted]

SEQ ID NO: 7129 - protein, 51 aa, Homo sapiens
MTLHHSKYCLYFKSVYILPPYSSFPENPSPHFKLFFWSLLKLTANNTTLNS

SEQ ID NO: 7130 - protein, 65 aa, Homo sapiens
MLRHSPSLWELVEEHVPLRERREVKRILGGGGGGPEPGAAGGGGDVTGTAPRGSILSSPQLPPHL

SEQ ID NO: 7131 - protein, 69 aa, Homo sapiens
  UNSURE 46: Xaa =  * ,Tyr
MGRMHAPGKGLSQSALPYRRSVPTWLKLTSDDVKEQIYKLAKKGLXSFTDRCNPERFTWCCTSTFCDRQ

SEQ ID NO: 7132 - protein, 73 aa, Homo sapiens
  UNSURE 70: Xaa =  * ,Cys,Phe,Leu,Ser,Trp,Tyr
  UNSURE 73: Xaa =  * ,Lys,Gln,Arg
  UNSURE 6: Xaa = Cys,Gly
  UNSURE 72: Xaa = Cys,Tyr
  UNSURE 69: Xaa = Ile,Lys,Arg,Thr
  UNSURE 71: Xaa = Leu,Met,Val
MLRVLXLLRPWSPFGPAAALPTGRPGAQRSKCAPWRVRTKAVGSMRTGLESVLVSGITVSSRGQHTANXXXXX

SEQ ID NO: 7133 - protein, 64 aa, Homo sapiens
MIVSFNFSTVHKSCPAKDWKVHKGKCYWIAETKKSWNKSQNDCAINNSYLMVIQDITAMVRFNI

SEQ ID NO: 7134 - protein, 63 aa, Homo sapiens; identical to SEQ ID NO: 6483

SEQ ID NO: 7135 - protein, 96 aa, Homo sapiens
  UNSURE 89: Xaa = Lys,Asn
MDKKSTHRNPEDARAGKYEGKHKRKKRRKQNQNQHRSRHRSVTSFSSDDPMFPSSSSSSSGSQTDSSIEDAAKGKIKKKRREKTNKWEXRKVSNCE

SEQ ID NO: 7136 - protein, 94 aa, Homo sapiens
MDKKSTHRNPEDARAGKYEGKHKRKKRRKQNQNQHRSRHRSVTSFSSDDPMFPSSSSSSSGSQTDSSIEDAAKGKIKKKRREKTNKWEKRKDKI

SEQ ID NO: 7137 - protein, 64 aa, Homo sapiens
  UNSURE 29: Xaa = Lys,Asn
MEGAGAGSGFRKELVSRLLHLHFKDDKTXKQQSAACGRPRQKTRSVWTWTSWRSSWTSRDLSRG

SEQ ID NO: 7138 - protein, 51 aa, Homo sapiens
MCILRAIIVDCWKIGFCGWAWWLTPVIPALWEAGVSRSLEVRSSRPDWPTW

SEQ ID NO: 7139 - protein, 55 aa, Homo sapiens
MRILTLCQLPKLEIIESSNWKGRYHPRFQLSTHCKIPSGTSQIDEFSSALLEYSQ

SEQ ID NO: 7140 - protein, 52 aa, Homo sapiens
MVSRVQLPPEIQLAQRLAGNEQVTRDRAVRKLRKYIVARTQRAAVVLRTTSC

SEQ ID NO: 7141 - protein, 83 aa, Homo sapiens
  UNSURE 42: Xaa = Asp,Glu
MLVERKVNGLVPRLMPVIAAHWEAQVGASLEGSSILDRAVIXHNLLSASKLYNNITFEELGALLEIPAAKAEKIASQMITEDV

SEQ ID NO: 7142 - protein, 108 aa, Homo sapiens
MDMRGIFLAFGPDFKSNFRAAPIRSVDVYNVMCNVVGITPLPNNGSWSRVMCMLKGRAALPRLSGPATVPWPDSSLPACITDHIACLRKKHHQQSGPPKPDDFHFMCE

SEQ ID NO: 7143 - protein, 59 aa, Homo sapiens
MGRWFNITSPSSPLLCPILAFIVSPLKGCELHGEVPMCFEEGLPQFIFNRYFLNNYCKD

SEQ ID NO: 7144 - protein, 51 aa, Homo sapiens
  UNSURE 43: Xaa = Arg,Ser
MVNGTWTGKGLFVWESFMAKAVTPPSKTCVFLAECCWRWPLEXLSQINLLT

SEQ ID NO: 7145 - protein, 81 aa, Homo sapiens
MAAGTSSYWEDLRKQARQLENELDLKLVSFSKLCTSYSHSSTRDGRRDSSDTTPLLNGSSQDRMFETMRLRLNNFWQGLQG

SEQ ID NO: 7146 - protein, 56 aa, Homo sapiens
  UNSURE 41: Xaa = Ala,Thr
  UNSURE 22: Xaa = Asp,Glu
  UNSURE 40: Xaa = His,Gln
  UNSURE 15: Xaa = Ile,Leu
MLIDGSDSHQTFPCXLCKDSRXSRAKPCHSSIRRAKSFIXXEEQADHAATALVFTF

SEQ ID NO: 7147 - protein, 89 aa, Homo sapiens
  UNSURE 55: Xaa = Leu,Val
MVIVFCLVTFATVPFKTMWKPQVCGQHRWNDILCFLRLPSTRHISLVLQMSAQVXVTSFSCCPGKSVCAGLERLHSSGDYSHLHFLHMH

SEQ ID NO: 7148 - protein, 86 aa, Homo sapiens
  UNSURE 72: Xaa = Lys,Asn
MAVPGCNKDSVRAGCKKCGYPGHLTFECRNFLRVDPKRDIVLDVSSTSSEDSDEENEELNKLQALQEKRINXKRKRKKKKAKKKSN

SEQ ID NO: 7149 - protein, 143 aa, Homo sapiens
  UNSURE 137: Xaa = Ile,Leu
  UNSURE 14: Xaa = Ile,Met,Arg,Ser
MEDHQHVPIDIQTXKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLGKVARPGSPGIHGEAHSQSSEIPGLXGGTVCE

SEQ ID NO: 7150 - protein, 51 aa, Homo sapiens
MRRFWNQILIWRSDRQSAWAISMRRRRVRLLVWRWSHYRRAWAPGVGHERK

SEQ ID NO: 7151 - protein, 51 aa, Homo sapiens
  UNSURE 48: Xaa = Asp,His,Asn,Tyr
  UNSURE 31: Xaa = Phe,Ile,Leu,Val
MRRFWNQILIWRSDRQSAWAISMRRRRVRLXVWRWSHYRRAWAPGVGXERK

SEQ ID NO: 7152 - protein, 51 aa, Homo sapiens; identical to SEQ ID NO: 7150

SEQ ID NO: 7153 - protein, 82 aa, Homo sapiens
MASSDVKPTSVSHAKKWSEEIENLYRFQQAGYRDETEYRQVKQVSMVDRWPETGYVKKLQRRDNTFYYYNKQRDVMTKKSTK

SEQ ID NO: 7154 - protein, 53 aa, Homo sapiens
MWTQTRIKTGHLPLRSLQSAGLRINTCSKREERSQGRSCQMDLISMKNRSPKD

SEQ ID NO: 7155 - protein, 89 aa, Homo sapiens
MKTGLSQCFNLTRAVSWSTPRSLLVPYDSPHQMTLAKSRFLCGQDWLADWWKVGWTKGGHVSSQHQFCTSSASVLVGVPVSPGPGWARA

SEQ ID NO: 7156 - protein, 80 aa, Homo sapiens
MMSWDFTFTHHSLTSSSRAISRPASFIHGRCPTEVHYFLSSMLYFHSTLPMFSYVWIYKYYHVTVACSIQYSHMLHRLVA

SEQ ID NO: 7157 - protein, 99 aa, Homo sapiens
  UNSURE 39: Xaa = Lys,Arg
MAQGQRKFQAHKPAKSKTAAAASEKNRGPRKGGRVIAPXKARVVQQQKLKKNLEVGIRKKIEHDVVMKASSSLPKKLALLKAPAKKKGAAAATSSKTPS

SEQ ID NO: 7158 - protein, 102 aa, Homo sapiens
  UNSURE 91: Xaa =  * ,Glu,Gly,Gln,Arg,Trp
  UNSURE 92: Xaa =  * ,Ser
  UNSURE 90: Xaa = Ala,Asp,His,Pro
  UNSURE 41: Xaa = Ala,Gly
  UNSURE 55: Xaa = Lys,Gln
MSVPCKPAVRGGAGLDAALHFNPRLDTSEVVFNSKEQGSWXREERGPGVPFQRGXPFEVLIIASDDGFKAVVGDAQYHHFRHRLPLARVXXXRWAGTCSWTP

SEQ ID NO: 7159 - protein, 50 aa, Homo sapiens [sequence omitted]

SEQ ID NO: 7160 - protein, 72 aa, Homo sapiens
MIDNPHYCLSRQKTDSVRKCFKWVILISAITKTTTKKQIFLLISYQQKKGMRCTGIPSTVILKMSVFKAFVF

SEQ ID NO: 7161 - protein, 62 aa, Homo sapiens
MVPMASRICGQKISLKANLAYINQTKISVDNMLMNNTTKFILKRQCVRRAFILQAQLERHLL

SEQ ID NO: 7162 - protein, 110 aa, Homo sapiens
MAKSLLKTASLSGRTKLLHQTGLSLYSTSHGFYEGEVKKTLQQFPGRSIDLQKEDNGIGILTLNNPSRMNAFSGVMMLQLLEKVIELENWTEGKGSLSVGQKILSLQDLI

SEQ ID NO: 7163 - protein, 53 aa, Homo sapiens [sequence omitted]

SEQ ID NO: 7164 - protein, 53 aa, Homo sapiens
MAHFRSMSKPPGSREPQHDSWPLFASDTKSSTVHYFTCPAPLHNRKRGLTLKK

SEQ ID NO: 7165 - protein, 74 aa, Homo sapiens
MSIGVPIKVLHEAEGHIVTCETNTGEVYRGKLIEAEDNMNCQMSNITVTYRDGRVAQLEQVYIRGSKIRFLILP

SEQ ID NO: 7166 - protein, 93 aa, Homo sapiens
MWASLSLDHPSAKENQALRLIEMREENGNVPKTEQAGSLKPLRDTGKSNLKEKKMNINKLCPGLGGECMTPDVMLLQQNQSLLWKPRNGNRRI

SEQ ID NO: 7167 - protein, 84 aa, Homo sapiens
MQYPFRKLLRPSTESCCVAQARVQWCHLGSLQPPLPGFKQFSCHSLPSSWDYRCAPPCLTNFCIFSRDRVSPCWPGWSRTPDLK

SEQ ID NO: 7168 - protein, 147 aa, Homo sapiens
MGGCMHSTQDKSLHLEGDPNPSAAPTSTCAPRKMPKRISISKQLASVKALRKCSDLEKAIATTALIFRNSSDSDGKLEKAIAKDLLQTQFRNFAEGQETKPKYREILSELDEHTENKLDFEDFMILLLSITVMSDLLQNIRNVKIMK

SEQ ID NO: 7169 - protein, 77 aa, Homo sapiens [sequence omitted]

SEQ ID NO: 7170 - protein, 69 aa, Homo sapiens
  UNSURE 63: Xaa = Arg,Ser
  UNSURE 19: Xaa = Ile,Lys
MLGFAFRDKRWWIYFACSXDSQGVRAAYCQILLLFYVSVYSLSFSYLLDHFCSLPKPLLFGTXSQIPHF

SEQ ID NO: 7171 - protein, 62 aa, Homo sapiens
  UNSURE 20: Xaa = Arg,Ser
MSNMEKHLFNLKFAAKELSXSAKKCDKEEKAEKAKLKRPFRRATWKLRGYTPKMPSARRTRR

SEQ ID NO: 7172 - protein, 67 aa, Homo sapiens
METVRAHHTPPSLPHLLAELVECSGQEQVLCGVTIGDSSESIPHQLSDQSWLPNLSVLQVWFDVFNL

SEQ ID NO: 7173 - protein, 66 aa, Homo sapiens
  UNSURE 53: Xaa =  * ,Leu
  UNSURE 24: Xaa =  * ,Lys,Arg,Trp
  UNSURE 25: Xaa = Phe,Ile,Leu,Val
MIFPFLRDMAVLTPREFLICKLEXXLLCLTELKFRSFCLISETKGNNTPIQKXINLLEVFVFNISI

SEQ ID NO: 7174 - protein, 55 aa, Homo sapiens
MLPIFFSATEQLPWYNKKDEYLLFIESGEPEKEPGKKQLEKVRGKPRVCVILQAN

SEQ ID NO: 7175 - protein, 77 aa, Homo sapiens
MRYSCIHTPACLQFINLPFKTKELQKKMDFTEPCVPKVLSQSAVFIVQTDYKKCFPFELYSLQKCFYTFSNFRNRII

SEQ ID NO: 7176 - protein, 93 aa, Homo sapiens
MYQNLWDTAKAVFRRKFIALNAHRRKQERSKIDTLTSQLKELEKQDETSSKASRRQEITKIRAELKEIQTRKTPQKISESRSWLFEKINKIDC

SEQ ID NO: 7177 - protein, 60 aa, Homo sapiens
MCLGTLRPTNDSALMEQPSVWGKVLEVHSFRKPLTSLYHALSEKLRIRKEQDPQETLMSG

SEQ ID NO: 7178 - protein, 73 aa, Homo sapiens [sequence omitted]

SEQ ID NO: 7179 - protein, 73 aa, Homo sapiens
MTRVLLSGLQQTRRLIRIHNSCQCRGASVTFTLIIIPGRRSQQLLVTTIRDFIFTSYEELSGTFLITGCHIIL

SEQ ID NO: 7180 - protein, 59 aa, Homo sapiens
  UNSURE 59: Xaa = Cys,Trp
MDGDPDTPKPVSFTVKETVCPRTTQQSPEDCDFKKDGLVKRCMGTVTLNQARGSFDISX

SEQ ID NO: 7181 - protein, 73 aa, Homo sapiens; identical to SEQ ID NO: 7179

SEQ ID NO: 7182 - protein, 54 aa, Homo sapiens [sequence omitted]

SEQ ID NO: 7183 - protein, 78 aa, Homo sapiens
MPGDAGGPGHLGLKEFGFRGTEGRLLLLQDCGVHVQVAEGGAPQSSISRWTASACCPRSSPGYGAWLQPRLRCSEKAL

SEQ ID NO: 7184 - protein, 50 aa, Homo sapiens
  UNSURE 40: Xaa = Asn,Thr
  UNSURE 39,43: Xaa = Glu,Gly
MSLSILCILMFMYIKCSVVLKTMKEIKASLDYFKEQSGXXLTXVNIRVEI

SEQ ID NO: 7185 - protein, 96 aa, Homo sapiens
MSISDVAHVACEPRERRWRDHPPDVVAWKRPQTKIQFPGEFLTPPTPPITFLANIRHWINPKKESIHSIQGSIVSPHTAATNGGYSRKKDGGFFST

SEQ ID NO: 7186 - protein, 72 aa, Homo sapiens
MCVHSLFKYLSKFNYFVQYACLPSIWLAGDIVMNRHGLLWNLQHGFHASWCYSAPKHTDMQLLDILVCAGHC

SEQ ID NO: 7187 - protein, 74 aa, Homo sapiens
MDDYTSAIEVQPNFEVPYYNRGLILYRLGYFDDALEDFKKVLDLNPGFQDATLSLKQTILDKEEKQRRNVAKNY

SEQ ID NO: 7188 - protein, 51 aa, Homo sapiens [sequence omitted]

SEQ ID NO: 7189 - protein, 53 aa, Homo sapiens
MTQSVVVQVGQCGNQIGCCFWDLALREHAAVNQKGIYDEAISSFFRNVDTRQS

SEQ ID NO: 7190 - protein, 53 aa, Homo sapiens; identical to SEQ ID NO: 7189

SEQ ID NO: 7191 - protein, 74 aa, Homo sapiens
MMADMYNRMTSACHRKCVPPHYKEAELSKGESVCLDRCVSKYLDIHERMGKKLTELSMQDEELMKRVQQSSGPA

SEQ ID NO: 7192 - protein, 52 aa, Homo sapiens
MMADMYNRMTSACHRKCVPPHYKEAELSKGESVCLDRCVSNYLDIHERMGKS

SEQ ID NO: 7193 - protein, 50 aa, Homo sapiens
MRMKKRRRRRRKMTLMGVKVLMNQILNQMKKPIIKQTWQTLLVKLQLSKS

SEQ ID NO: 7194 - protein, 59 aa, Homo sapiens
  UNSURE 30: Xaa = Ala,Gly
MPGLSSAHPRSPRNFPGLSPLESGWKGATXGSAPLGAERGKLLKRRWGLGEDINQHGQP

SEQ ID NO: 7195 - protein, 54 aa, Homo sapiens
METVARDGGSLGVSGNCAFEFPQAAGGKLRLRQEREGPTDKVAWPEACFVFWFL

SEQ ID NO: 7196 - protein, 97 aa, Homo sapiens
MALLGRSVRAGYRKTRRHIHDPRHRSNLCLTPPLPARDGKQTETGSSECSLEGLLENLLEGCEDMFGNLFAENIFSPVHHSQLAEELKRQEISKRER

SEQ ID NO: 7197 - protein, 113 aa, Homo sapiens
MDSRIPYDDYPVVFLPAYENPPAWIPPHERVHHPDYNNELTQFLPRTITLKKPPGAQLGFNIRGGKASQLGIFISKVIPDSDAHRAGLQEGDQVLAVNDVDFQDIEHSKAERS

SEQ ID NO: 7198 - protein, 80 aa, Homo sapiens
  UNSURE 74: Xaa =  * ,Trp
MWRAEGKWLPKTSRKSVSQSVFCGTSTYCVLNTVPPIEDDHGNSNSSHVKIFLPKKLLECLPKCSSLPKERHRXNTNERS

SEQ ID NO: 7199 - protein, 55 aa, Homo sapiens [sequence omitted]

SEQ ID NO: 7200 - protein, 51 aa, Homo sapiens
  UNSURE 50: Xaa =  * ,Arg
  UNSURE 49: Xaa =  * ,Cys,Trp
MVQPWGAGEASGQTITPPRPHPQGEPLKPGAAGEVEGFSFITTLPFCRXXS

SEQ ID NO: 7201 - protein, 142 aa, Homo sapiens
  UNSURE 142: Xaa = His,Gln
MSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPAILQQVDGTLRX

SEQ ID NO: 7202 - protein, 61 aa, Homo sapiens
MYPSLFRCPNKDGPFHLDTCDQPHLVSHHQHPARSCGQWGIQTNRRSMGTEQTSLSSSSNL

SEQ ID NO: 7203 - protein, 115 aa, Homo sapiens
  UNSURE 53: Xaa = Asn,Tyr
  UNSURE 79: Xaa = Cys,Phe,Gly,Val
  UNSURE 32: Xaa = Gly,Arg
  UNSURE 78,84: Xaa = Gly,Val
  UNSURE 82: Xaa = Ile,Thr
  UNSURE 83: Xaa = Lys,Thr
MVAAKKDEKVAGVGSNSRLQLVMKSGEVRPGXTRQTLKDDQTRQSEIRSFSLXNCPSFEVPKGNLKIELLCYGWLKLXXPSXXXAIILKLGHSMRKNTTECAHWLIIDPGDSEHH

SEQ ID NO: 7204 - protein, 96 aa, Homo sapiens
MVAAKKTKKSLESINSRLQLVMKSGKYVLGYKQTLKMIRQGKAKLVILANNCPALSGNNIELGTACGKYYRVCTLAIIDPGDSDIIRSMPEQTGEK

SEQ ID NO: 7205 - protein, 83 aa, Homo sapiens [sequence omitted]

SEQ ID NO: 7206 - protein, 51 aa, Homo sapiens
MLAKTGVHHYSGNNIELGTACGKYYRVCTLAIIDPGDSDIIRSMPEQTGEK

SEQ ID NO: 7207 - protein, 55 aa, Homo sapiens [sequence omitted]

SEQ ID NO: 7208 - protein, 58 aa, Homo sapiens
  UNSURE 58: Xaa = Cys,Trp
MVAAKKTKKSLESINSRLQLVMKSGKYVLGYKQTLKMIRQGKAKLVILANNCPALRKX

SEQ ID NO: 7209 - protein, 51 aa, Homo sapiens
MIQKMEHASRLHPQEPCLKDGKALFPTKTTESPLAKVNRDQCFTSEVVSKA

SEQ ID NO: 7210 - protein, 51 aa, Homo sapiens
MASSSPPRPRVSCSCLCLIAAPGLTFYGFVFYWFVFIFSGILNKSIAVRYP

SEQ ID NO: 7211 - protein, 106 aa, Homo sapiens
  UNSURE 26: Xaa =  * ,Arg
  UNSURE 27: Xaa =  * ,Glu
  UNSURE 23: Xaa = Ala,Gly,Pro,Arg
  UNSURE 40: Xaa = Ala,Pro
  UNSURE 7: Xaa = Asn,Tyr
  UNSURE 56: Xaa = Asp,Glu
  UNSURE 13: Xaa = Cys,Trp
  UNSURE 3: Xaa = His,Gln
  UNSURE 12: Xaa = Ile,Asn
  UNSURE 42: Xaa = Ile,Ser
  UNSURE 61: Xaa = Leu,Val
  UNSURE 8: Xaa = Lys,Arg
  UNSURE 22: Xaa = Pro,Arg
MVXKSTXXRSTXXTECCEGNKXXEPXXATFVFYRVVISEXGXAWYMAALVRVISTXLPTGXSVNFKQKASFLVNHSPRSPVWLRELAAMLDVVERAARSYRKMVNT

SEQ ID NO: 7212 - protein, 116 aa, Homo sapiens
MGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 7213 - protein, 78 aa, Homo sapiens
  UNSURE 29: Xaa = Glu,Lys
MAPKAAKGAKPEPAPAPPPPGAKPEEDKXDGKEPSDKPQKAVQDHKEPSDKPQKAVQPKHEGHEEGVSPLPVGIKRQQ

SEQ ID NO: 7214 - protein, 67 aa, Homo sapiens
MIRKPDTLQAGGDPGERPSQALLTPVALDFPCLDSPQAWLSALDWSATRTTSPSLASVPSVMWLSSA

SEQ ID NO: 7215 - protein, 67 aa, Homo sapiens; identical to SEQ ID NO: 7214

SEQ ID NO: 7216 - protein, 68 aa, Homo sapiens
  UNSURE 8: Xaa = Gly,Arg,Trp
MFSKIGPXVELLTSGDPTTSTSRSAGIMDVSHCPCPRWYHLQSLIRKNNMSTECNSRSGILCPSVFSS

SEQ ID NO: 7217 - protein, 58 aa, Homo sapiens
MPGIYEVLKNQNTEQNLLGDELLSFSLQHHRHITSTYTHTEKILKRHNNHGKWRLLDC

SEQ ID NO: 7218 - protein, 93 aa, Homo sapiens
MLGSVVERLAVVLEQGRRNSDVKLTVCEPWNLHSEKMKDIDIGKEYIIPSPGYRSVRERTSTSGTHRDREDSKFRRLDRVRVSLCHPDCSAVA

SEQ ID NO: 7219 - protein, 58 aa, Homo sapiens
MLFKFLLTDISQLEMILVCESLPPSNWCPGSTEILLSLNRILSSTKTYAIVNSPNEEG

SEQ ID NO: 7220 - protein, 86 aa, Homo sapiens
MRWPWKQPGRLPSLLVPSPERKVERPAGDQGRTESPGLVNSWAPRSLVFLEHAYLSQREGHGPCRARDPIFCSRREQRREHRDSCC

SEQ ID NO: 7221 - protein, 61 aa, Homo sapiens [sequence omitted]

SEQ ID NO: 7222 - protein, 75 aa, Homo sapiens
MAGQEDPVQREIHQDWANREYIEIITSSIKKIADFLNSFDMSCRSRLATLNEKLTALERRIEYIEARVTKGETLT

SEQ ID NO: 7223 - protein, 75 aa, Homo sapiens; identical to SEQ ID NO: 7222

SEQ ID NO: 7224 - protein, 75 aa, Homo sapiens; identical to SEQ ID NO: 7222

SEQ ID NO: 7225 - protein, 75 aa, Homo sapiens; identical to SEQ ID NO: 7222

SEQ ID NO: 7226 - protein, 75 aa, Homo sapiens; identical to SEQ ID NO: 7222

SEQ ID NO: 7227 - protein, 75 aa, Homo sapiens; identical to SEQ ID NO: 7222

SEQ ID NO: 7228 - protein, 68 aa, Homo sapiens
MESKEERALNNLIVENVNQENDEKDEKEQVANKGEPLALPLNVSEYCVPRGNRSGSALGSPSCSIDGT

SEQ ID NO: 7229 - protein, 68 aa, Homo sapiens; identical to SEQ ID NO: 7228

SEQ ID NO: 7230 - protein, 76 aa, Homo sapiens
MESKEKRAVNSLSMENANQENEEKEQVANKGEPLALPLDAGEYCVPRGNRRRFRVRQPILQYRWDMMHRLGEPQQG

SEQ ID NO: 7231 - protein, 100 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLRESS

SEQ ID NO: 7232 - protein, 55 aa, Homo sapiens
  UNSURE 35: Xaa = Ala,Gly
  UNSURE 36: Xaa = Leu,Val
MESKEKRAVNSLSMENANQENEEKEQVANKGEPLXXPLDAGEYCVPRGNRRRFRR

SEQ ID NO: 7233 - protein, 55 aa, Homo sapiens
  UNSURE 32: Xaa = Ala,Glu,Gly,Val
  UNSURE 54: Xaa = His,Asn,Arg,Ser
  UNSURE 53: Xaa = Phe,Ile,Leu
MESKEKRAVNSLSMENANQENEEKEQVANKGXPLALPLDAGEYCVPRGNRRRXXV

SEQ ID NO: 7234 - protein, 68 aa, Homo sapiens; identical to SEQ ID NO: 7228

SEQ ID NO: 7235 - protein, 103 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKAEGKAVES

SEQ ID NO: 7236 - protein, 115 aa, Homo sapiens
  UNSURE 112: Xaa = Ala,Pro
  UNSURE 86: Xaa = Gly,Arg,Trp
MESKEKRAVNSLSMENANQENEEKEQVANKGEPLALPLDAGEYCVPRGNRRRFRVRQPILQYRWDMMHRLGEPQARMREENMERIXEEVRQLMEKLREKQLSHSLRAVSTGXPSP

SEQ ID NO: 7237 - protein, 55 aa, Homo sapiens
  UNSURE 35: Xaa = Ala,Gly
  UNSURE 30: Xaa = Ile,Lys,Arg,Thr
  UNSURE 37: Xaa = Pro,Thr
MESKEKRAVNSLSMENANQENEEKEQVANXGEPLXLXLDAGEYCVPRGNRRRFRD

SEQ ID NO: 7238 - protein, 125 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSLRAVSTDPPHHDHHDEFCLMP

SEQ ID NO: 7239 - protein, 69 aa, Homo sapiens [sequence omitted]

SEQ ID NO: 7240 - protein, 67 aa, Homo sapiens [sequence omitted]

SEQ ID NO: 7241 - protein, 97 aa, Homo sapiens
  UNSURE 56: Xaa = Cys,Phe
MSHCASSGKVCIYVCISVSLNLPLCCKHLLYPSYYSYYLNQFLFCKTTGKDFGMKXSGEPSHPNLKNKNISVIWTIGLMYEVKYIPAYYKYAESFLV

SEQ ID NO: 7242 - protein, 92 aa, Homo sapiens
MLKAAAKRPELSGKNTISNNSDMAEVKSMFREVLPKQGPLFVEDIMTMVLCKPKLLPLKSLTLEKLEKMHQAAQNTIRQQEMAEKDQRQITH

SEQ ID NO: 7243 - protein, 69 aa, Homo sapiens [sequence omitted]

SEQ ID NO: 7244 - protein, 138 aa, Homo sapiens
MATKRLFGATRTWAGWGAWELLNPATSGRLLARDYAKKPVMKGAKSGKGAVTSEALKDPDVCTDPVQLTTYAMGVNIYKEGQDVPLKPDAEYPEWLFEMNLGPPKTLEELDPESREYWRRLRKQNIWRHNRLSKNKRL

SEQ ID NO: 7245 - protein, 63 aa, Homo sapiens
MLPRAAWSLVLRKGGGGRRGMHSSEGTTRGGGRCPPTPTAMPSATTPCQKSPSAQNSTLRSRP

SEQ ID NO: 7246 - protein, 56 aa, Homo sapiens
MIFCSHKLALLSIFPEHTPGVCKYSLPLLHTHRVFTSVTFCAYCSAPCLFHLTVII

SEQ ID NO: 7247 - protein, 56 aa, Homo sapiens [sequence omitted]

SEQ ID NO: 7248 - protein, 68 aa, Homo sapiens
  UNSURE 40: Xaa = Asp,Glu
  UNSURE 37: Xaa = Ile,Met
MGNDFINHVYVMKPPQEKNLNRRPSESFQVADHMEVXPRXGVKAPHPFSIPCPTYLFHLAVSKLHPLY

SEQ ID NO: 7249 - protein, 108 aa, Homo sapiens
MFPPDQLSVQINFPSVPTFAAITVLLCTCFKKKQQGSETKDGQPGARPETRPGPAWPKPSFMCVKRPPNVCEETTKQALFTSGHLDVYVQVTGDAMAWLGLRGLTPSS

SEQ ID NO: 7250 - protein, 56 aa, Homo sapiens
MTLTGAICEGVGLDNMKSFFSIYSIGFQSISGKYVFCPIVYVTGSESQHCSYHFCS

SEQ ID NO: 7251 - protein, 50 aa, Homo sapiens
MNLPRLASHWAWTCFTANVLLPKLYKLPGLLQKRDRVLLCCPEWNAVAQS

SEQ ID NO: 7252 - protein, 110 aa, Homo sapiens
MAETLLNISNNAGNTPGPAKLNSNSVVPQLLNPLLGTGLLGDMSSINNTLSNHQLTHLQSLLNNNQMFPPNQQQQQLLQGYRISRRSKDSPQFLAQLTITPWLVCFRTFR

SEQ ID NO: 7253 - protein, 108 aa, Homo sapiens
  UNSURE 37: Xaa = Asp,Glu,Gly
MGRHWLVEGRGRRGAGAGPEEMGTRQAVTEAARAEMXTGASHESLRPLEAGSLAANSSEEAALLPGARWFAEACYEELVQVKRLLSGNRLRVAAAGMEPTRIFCKHLY

SEQ ID NO: 7254 - protein, 60 aa, Homo sapiens
MKKKQTVQGTSANSSGRSTPRPPAPPSTPPIRPGSSPRRPRRRGPGASMASIMETIGLTQ

SEQ ID NO: 7255 - protein, 137 aa, Homo sapiens
MRGRAAFCHLCRLHWQSRHQSHPGSLSSLSTCCCDFKGNCTTRSDRFAECVLGCGSLAWRSCCWCKGDGLKSEGSRDARLKPALPRRPPAGPHTHCTGSVHWRICNRLLGAPHPCAVFQTPPFCLKVSVNEINCNLL

SEQ ID NO: 7256 - protein, 82 aa, Homo sapiens
  UNSURE 23: Xaa = Ala,Glu
  UNSURE 66: Xaa = Ala,Gly
  UNSURE 81: Xaa = Arg,Thr
  UNSURE 71: Xaa = Asp,His
  UNSURE 79: Xaa = Ile,Lys,Arg,Thr
MRKPAAGSSLTPEGAAPASGPAXAQDSTQASTPGSPLSPTEYERFFALLTPTWKQRLPAVSVQPTXAGIPXSSSWTNMXTXA

SEQ ID NO: 7257 - protein, 71 aa, Homo sapiens
MQAVSLLTNLKPFIGMGRAGGLWKSCICTLTTSGWSPSSYNTDSFCAIDWLKTGSSKLWSKPTHPLCSQDS

SEQ ID NO: 7258 - protein, 57 aa, Homo sapiens [sequence omitted]

SEQ ID NO: 7259 - protein, 54 aa, Homo sapiens
MGQVWPSMIQIRPCLLHLSTCCLWLILHYNSKIYIYIHTYIHIYVLLGPLQKKN

SEQ ID NO: 7260 - protein, 55 aa, Homo sapiens
  UNSURE 30: Xaa =  * ,Tyr
MNVAFFVGCGGWAVLQLNKQIEFCRKKTFXPIFILSHGDIFLLLSFPFFKHFYND

SEQ ID NO: 7261 - protein, 95 aa, Homo sapiens
MSFDCTMRPQQTLIKPITYNAMLAETSTVFHQNDVKIPDAKHVFTTFYAKTKSLLVNPVLFPNREDYIHLMGYDKEEFILYMEETSEEKRHKDDK

SEQ ID NO: 7262 - protein, 63 aa, Homo sapiens
  UNSURE 55: Xaa = Lys,Asn
  UNSURE 59: Xaa = Phe,Leu
MRVQILKDYVRQHFPATPLLDYALEVEKITTSKKPNLILNVDGLIGVAFVDMLRXCGAXTRGS

SEQ ID NO: 7263 - protein, 52 aa, Homo sapiens [sequence omitted]

SEQ ID NO: 7264 - protein, 78 aa, Homo sapiens
  UNSURE 4: Xaa = Asn,Thr
  UNSURE 54: Xaa = Lys,Asn
MEKXTLKFIMEQKRACIAKTILSQKNKAGGIMLPDFKLYYKAKVTKTAWYWYQXQRYRPMEQNRALRNNTTHLQPSDF

SEQ ID NO: 7265 - protein, 53 aa, Homo sapiens [sequence omitted]

SEQ ID NO: 7266 - protein, 117 aa, Homo sapiens
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 7267 - protein, 63 aa, Homo sapiens
  UNSURE 44: Xaa = Arg,Ser
  UNSURE 46: Xaa = Asp,Glu
MAATRCLRWGLSRAGVWLLPPPARCPRRALHKQKDGTEFKSIYXLXKALPPNLRARTPPGGSR

SEQ ID NO: 7268 - protein, 113 aa, Homo sapiens
  UNSURE 91: Xaa = Gly,Val
MNSTGGQTPRRDLEKVLTGEEKALRPGDPGFCARARVPMPSNKDYVVRPKWNVEMESSRFQATSKKGISRLDKQMRKFTDIRKKSRSAHAXKSALRATKCHCDLAWNVSPSLL

SEQ ID NO: 7269 - protein, 91 aa, Homo sapiens
  UNSURE 31: Xaa = Gly,Trp
MGFLRRLIYRRRPMIYVESSEESSDEQPDEXNHQLKVRILHLLKRERMREHLQLKGRSLKLIARNWFSQRLGVSLEMVLIPRGCACEMKSR

SEQ ID NO: 7270 - protein, 57 aa, Homo sapiens
MPSSQINYRYLFRREEDFTSQRVRFEIYTKKTTLHLMLHLMRHSFFYKLFFYSVSEH

SEQ ID NO: 7271 - protein, 69 aa, Homo sapiens [sequence omitted]

SEQ ID NO: 7272 - protein, 116 aa, Homo sapiens
  UNSURE 51: Xaa = Leu,Pro,Gln,Arg
  UNSURE 50: Xaa = Leu,Val
  UNSURE 46: Xaa = Pro,Arg
MAAHLVKRCTCLLREAARQAPSMAPVGRLRLAWVAHKTLTSSATSXISHXXGSLMELVEKERASTPYIEKQVDHLIKKATRQRSSWSYLVAVTTWTAIKQQWYLSGSLTCCLKARR

SEQ ID NO: 7273 - protein, 51 aa, Homo sapiens
MGTKGDCRLEGIEPTTASHGHSMFCKRQPVNSKMQAGGEGWPCSPKHNGRC

SEQ ID NO: 7274 - protein, 51 aa, Homo sapiens
MPLILQFRTTDQNIYLSSQLLYNSFCKQGYGMILMNNFFWKLVNLFSVLSF

SEQ ID NO: 7275 - protein, 72 aa, Homo sapiens [sequence omitted]

SEQ ID NO: 7276 - protein, 51 aa, Homo sapiens
  UNSURE 48: Xaa = Ala,Pro
  UNSURE 46: Xaa = Gly,Val
MVTDLFLELKNPLLIFLIHFAPPFFSSATVEAIEADEGKLASPLSXVXCNR

SEQ ID NO: 7277 - protein, 169 aa, Homo sapiens
  UNSURE 90: Xaa = Ile,Met,Thr
  UNSURE 126: Xaa = Lys,Gln
METGPSEEPSGRKESQDMCPPGLLVFAGSSEQDANLAKQFWISASMYPPSESQLVLRRDSSQRLPVARPRRSRGSENSHSSQSFHLASNXNRDIFAEALKIQESEEKVKYLQKAKTREEILQLLRXQREERISKELISLPYKPKAKEHKAKKVVSESDKEDQEEVKTLD

SEQ ID NO: 7278 - protein, 76 aa, Homo sapiens
MAGRKLALKTIDWVAFAEIIPQNQKAIASSLKSWNETLTSRLAALPENPPAIDWAYYKANVARLAWWMTLRRSLMR

SEQ ID NO: 7279 - protein, 85 aa, Homo sapiens [sequence omitted]

SEQ ID NO: 7280 - protein, 78 aa, Homo sapiens
  UNSURE 48: Xaa = Ile,Asn,Ser,Thr
  UNSURE 47: Xaa = Lys,Asn
MMNVRVASSVEFLLRRKRMKDVDNLKSIKEEWVCEKDLIINLLVIIXXQIVNILLIAFLRKLRRLVPNVCLPLNRRNR

SEQ ID NO: 7281 - protein, 95 aa, Homo sapiens
MSECIQISFAVCRIGIYTCFRALCCKGPPPARPEYDLVCIGLTGSGKTILLSKLCSESPDNVVSTTGFSIKAVPFQNAILNVKELGDFISLWGQR

SEQ ID NO: 7282 - protein, 158 aa, Homo sapiens
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEDDLEAARNELHSALQHPQLCTLPFLILANHQDKPAARSVQEKIQD

SEQ ID NO: 7283 - protein, 108 aa, Homo sapiens
  UNSURE 94: Xaa = Glu,Gly,Lys,Arg
MSDLRITEAFLYMDYLCFRALCCKGPPPARPEYDLVCIGLTGSGKTSLLSKLCSESPDNVVSTTGFSIKAVPFQNAILNVKELGGADNIRKYWXPATTKGSQGGNIWY

SEQ ID NO: 7284 - protein, 52 aa, Homo sapiens [sequence omitted]

SEQ ID NO: 7285 - protein, 110 aa, Homo sapiens [sequence omitted]

SEQ ID NO: 7286 - protein, 81 aa, Homo sapiens
  UNSURE 55: Xaa =  * ,Glu
  UNSURE 53: Xaa = Cys,Phe,Ser,Tyr
  UNSURE 54: Xaa = Ile,Asn,Ser,Thr
  UNSURE 56: Xaa = Ile,Ser
MSDLRITEAFLYMDYLCFRALCCKGPPPARPEYDLVCIGLTGSGKTSLLSKLXXXXPDNVVSTTGFSIKAVPFQNAILNVK

SEQ ID NO: 7287 - protein, 115 aa, Homo sapiens
MSDLRITEAFLYMDYLCFRALCCKGPPPARPEYDLVCIGLTGSGKTSLLSKLCSESPDNVVSTTGFSIKAVPFQNAILNVKELGGADNIRKYWSRYYQGSQGVIFVLDSASSEMI

SEQ ID NO: 7288 - protein, 77 aa, Homo sapiens
MRFCPFAERTRLVLKAKGIRHEVININLKNKPEWFFKKNPFGLVPVLENSQGQLIYESAITCEYLDEAYPGEEAVAG

SEQ ID NO: 7289 - protein, 50 aa, Homo sapiens
  UNSURE 48: Xaa = Lys,Gln
  UNSURE 49: Xaa = Phe,Ile,Leu,Val
  UNSURE 34: Xaa = Pro,Arg
MLCMRLSGIRDILLAGACCRGDPPRPQVNQGSAXGPISSLAAVCNLGXXT

SEQ ID NO: 7290 - protein, 55 aa, Homo sapiens [sequence omitted]

SEQ ID NO: 7291 - protein, 91 aa, Homo sapiens
  UNSURE 7: Xaa = Ala,Ser
MAASSRXQVLSLYRAMLRESKRFSAYNYRTYAVRRIRDAFRENKNVKDPVEIQTLVNKAKRDLGVIRRQVHIGQLYSTDKLIIENRDMPRT

SEQ ID NO: 7292 - protein, 91 aa, Homo sapiens
MAASSRAQVLALYRAMLRESKRFSAYNYRTYAVRRIRDAFRENKNVKDPVEIQTLVNKAKRDLGVIRRQVHIGQLYSTDKLIIENRDMPRT

SEQ ID NO: 7293 - protein, 91 aa, Homo sapiens [sequence omitted]

SEQ ID NO: 7294 - protein, 60 aa, Homo sapiens
MAVLPAHSPWAPFPPPTSPCPHGLLVPRHSCMGVIHAGHLRHKERRQGAAERGSVKNFQQ

SEQ ID NO: 7295 - protein, 81 aa, Homo sapiens
MMFPLARNALSSLKIQSILQSMARHSHVKHSPDFHDKYGNAVLASGTAFCVATWVFTATQIGIEWNLSPVGRVTPKEWKHQ

SEQ ID NO: 7296 - protein, 62 aa, Homo sapiens
  UNSURE 62: Xaa =  * ,Gly
MMFPLARNALSSLKIQSILQSMARHSHVKHSPDFHDKYGNAVLASGTAFCVATWVFTATQIX

SEQ ID NO: 7297 - protein, 74 aa, Homo sapiens [sequence omitted]

SEQ ID NO: 7298 - protein, 81 aa, Homo sapiens; identical to SEQ ID NO: 7295

SEQ ID NO: 7299 - protein, 74 aa, Homo sapiens [sequence omitted]

SEQ ID NO: 7300 - protein, 162 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYRGGKICLTDHFKPFWARNVPKFGLAHLMALGLGPWLAVEIPDLIQKGVIQHK

SEQ ID NO: 7301 - protein, 58 aa, Homo sapiens
MISAHCSVCLPGSRDSPASASRVAGSTGVCHHAWLIVCIFSRDRVSPCWQDGLDLLTS

SEQ ID NO: 7302 - protein, 90 aa, Homo sapiens
MSTAMNFGTKSFQPRPPDKGSFPLDHLGECKSFKEKFMKCLHNNNFENALCRKESKEYLECRMERKLMLQEPLEKLGFGDLTSGKSEAKK

SEQ ID NO: 7303 - protein, 75 aa, Homo sapiens
  UNSURE 62: Xaa =  * ,Leu
  UNSURE 56: Xaa =  * ,Lys
  UNSURE 60: Xaa =  * ,Lys,Asn,Ser,Thr,Tyr
  UNSURE 61: Xaa = Ala,Leu,Pro,Val
  UNSURE 64: Xaa = Cys,Gly,Trp
  UNSURE 59: Xaa = Cys,Phe,Ile,Leu,Met,Arg,Ser,Trp
  UNSURE 57: Xaa = Gly,Arg,Ser
  UNSURE 66: Xaa = His,Pro,Gln
  UNSURE 63: Xaa = Ile,Asn
  UNSURE 54: Xaa = Ile,Lys,Asn
  UNSURE 58: Xaa = Lys,Gln,Arg
  UNSURE 55: Xaa = Phe,Ile
  UNSURE 53,68: Xaa = Phe,Leu
  UNSURE 65: Xaa = Phe,Leu,Pro,Ser
MQKKTLFLKCGPGMMYIPGKERTAVTSDNAPFYGILINCILAGDTQVKQSCIXXXXXXXXXXXXXXFXLRMLIYG

SEQ ID NO: 7304 - protein, 55 aa, Homo sapiens
MTTFQLECTHCPRNPAFQGGSAFDSARRFVGPDGVGCGCGPGGDGAFASIVGHSF

SEQ ID NO: 7305 - protein, 64 aa, Homo sapiens
  UNSURE 3: Xaa = Ala,Gly,Pro,Arg
  UNSURE 16: Xaa = Gly,Arg
  UNSURE 13: Xaa = Gly,Val
  UNSURE 10: Xaa = Ile,Leu,Val
  UNSURE 12: Xaa = Leu,Arg
  UNSURE 33: Xaa = Lys,Arg
  UNSURE 11: Xaa = Lys,Asn,Arg,Ser
MIXASAFRPXXXXPNXVGMSCPHRDLPSAHCEXVFRCAMARCGATMWVVATETWRRSFCTLGNQ

SEQ ID NO: 7306 - protein, 71 aa, Homo sapiens
  UNSURE 42: Xaa = Glu,Gly
  UNSURE 41: Xaa = Phe,Ile
MTQGVTENKKIQYQDNQTTTGLQFIETRAVLTLRSVEEMSXXEWLVVTLFSPHPLNQTLKVLNPLNLLFFT

SEQ ID NO: 7307 - protein, 94 aa, Homo sapiens [sequence omitted]

SEQ ID NO: 7308 - protein, 110 aa, Homo sapiens
  UNSURE 108: Xaa = Arg,Ser,Thr
  UNSURE 109: Xaa = Cys,Phe
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRXXT

SEQ ID NO: 7309 - protein, 76 aa, Homo sapiens [sequence omitted]

SEQ ID NO: 7310 - protein, 98 aa, Homo sapiens
MALSKSMHARNRYKDKPPDFAYLASKYPDFKQHVQINLNGRVSLNFKDPEAVRALTCTLLREDFGLSNGYSIGETNSHSSLETQLYSLGRRSDRSPGF

SEQ ID NO: 7311 - protein, 67 aa, Homo sapiens
MTLLYALHTISTLTVMPSSTLYSPYHCLLRKTTQIQIKEMKQIDKLSLVVAHTCNPSTLGGRGGWTT

SEQ ID NO: 7312 - protein, 56 aa, Homo sapiens [sequence omitted]

SEQ ID NO: 7313 - protein, 56 aa, Homo sapiens
  UNSURE 8: Xaa = Pro,Arg
MTTYAGGXSSGLPQGLVSRACSFIRKIYILLIKERFVSNKVFVITHENATLSLCRL

SEQ ID NO: 7314 - protein, 52 aa, Homo sapiens
MSYGPLDMYRNPGPSGQPSGTSAASSRREAATSSGSAKPLLQIKNFDEPARN

SEQ ID NO: 7315 - protein, 108 aa, Homo sapiens
MASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 7316 - protein, 53 aa, Homo sapiens
MMTAVSLTTRPQESVAFEDVAVYFTTKEWAIMVPAERALYRDVMLENYEAVAL

SEQ ID NO: 7317 - protein, 102 aa, Homo sapiens
MMTAVSLTTRPQESVAFEDVAVYFTTKEWAIMVPAERALYRDVMLENYEAVAFVVPPTSKPALVSHLEQGKESCFTQPQGVLSRNDWRAGWIGYLELRRYTY

SEQ ID NO: 7318 - protein, 53 aa, Homo sapiens
  UNSURE 29: Xaa =  * ,Glu
MMENYDNLVSLGHSVSKPDLITLLEQGKXPWMIVREETRGECTELQSKNCGFN

SEQ ID NO: 7319 - protein, 80 aa, Homo sapiens
MAHGSVTFRDVAIDFSQEEWEFLDPAQRDLYRDVMWENYSNFISLGPSISKPDVITLLDEERKEPGMVVREGTRRYCPGE

SEQ ID NO: 7320 - protein, 71 aa, Homo sapiens
MVNVLKGVLIECDPAMKQFLLYLDESNALGKKFIIQDIDDTHVFVIAELVNVLQERVGELMDQNAFSLTQK

SEQ ID NO: 7321 - protein, 77 aa, Homo sapiens [sequence omitted]

SEQ ID NO: 7322 - protein, 57 aa, Homo sapiens [sequence omitted]

SEQ ID NO: 7323 - protein, 54 aa, Homo sapiens
MPVSPALWEAEAGRSPEDKSSRPAWPTWQNPISTKNTRISRCGGGHCNPIYLGG

SEQ ID NO: 7324 - protein, 64 aa, Homo sapiens [sequence omitted]

SEQ ID NO: 7325 - protein, 100 aa, Homo sapiens
  UNSURE 30: Xaa = Lys,Asn
MAASSQGNFEGNFESLDLAEFAKKQPWWRXCSGRNLDLQQKSIAWQPSCSLEVSLDGAQVSYSRRLESWLQQLWEVDFFSFSLQTILGTSKLTGNEWRRT

SEQ ID NO: 7326 - protein, 71 aa, Homo sapiens
  UNSURE 19: Xaa = Cys,Gly
  UNSURE 67: Xaa = Cys,Phe
  UNSURE 17: Xaa = Cys,Trp
MLTLPTNLRCVTQILLXAXVDIAIPCNNKWSSLSGFDVVDAGSGSFCACVHTISHEHPWEVMPQLCXLQRS

SEQ ID NO: 7327 - protein, 60 aa, Homo sapiens
MLPFFNHICITYGVWVLMRSWYHIWDFFLCKSSSIRRNYGTLSLALENLQWTNRCHQTSF

SEQ ID NO: 7328 - protein, 67 aa, Homo sapiens
  UNSURE 45: Xaa =  * ,Cys,Gly,Arg,Ser
  UNSURE 43: Xaa = Ala,Glu
  UNSURE 61: Xaa = Gly,Arg
MPAREVLRMRDTISHEHPWEVMPQLCFYRDPEEIEKEEQAAAXKXMTKEEFQGEWTAPAPXVHCYSA

SEQ ID NO: 7329 - protein, 82 aa, Homo sapiens
  UNSURE 74: Xaa =  * ,Gly,Arg,Trp
  UNSURE 64: Xaa = Ala,Gly
  UNSURE 62: Xaa = Arg,Ser
  UNSURE 75: Xaa = Asp,Glu
  UNSURE 11: Xaa = Asp,His
  UNSURE 61: Xaa = Leu,Val
  UNSURE 73: Xaa = Lys,Arg
MLTYLPLLCVXRFSSVLCGHCHPMQQQGSSLSGFDVVDAGSGKFCACVTPFPMNTPGRSCXXSXSTEILKRLXXXQAAAEKQ

SEQ ID NO: 7330 - protein, 100 aa, Homo sapiens
MAVSNIRYGAAVTKEVGMDLKNMGAKNVCLMTDKNLSKLPPVQVAMDSLVKNGIPFTVYDNVRWNQRIQASWKLLSLPKRELLMPMLLSVVALPWTPVSC

SEQ ID NO: 7331 - protein, 123 aa, Homo sapiens
MGNRVCCGGSWSCPSTFQKKKKRGSQTRRTLKPQPQQLQQNLPKGHETTGHTYERVLQHQGSQERSPGLMSEDSNLHYADIQVCSRPHAREVKHVHLENATEYATLRFPQATPRYDSKNGTLV

SEQ ID NO: 7332 - protein, 64 aa, Homo sapiens
MSTSVPQGHTWTQRVKKDDEEEDPLDQLISRSGCAASHFAVQECMAQHQDWRQCSHRCRRSRIA

SEQ ID NO: 7333 - protein, 55 aa, Homo sapiens
MVPGTLSGAGRAQACTSKVGWDQAAPRPSIQVLPWAPVALQTLRAKVLCCFLVPP

SEQ ID NO: 7334 - protein, 71 aa, Homo sapiens
MQKKKFCSVLFGNFFVLRLCEIHLFLAELKTYIIPISAGCLVSRNITYFGLWPGWVVLKVTECQVWLELKF

SEQ ID NO: 7335 - protein, 62 aa, Homo sapiens [sequence omitted]

SEQ ID NO: 7336 - protein, 80 aa, Homo sapiens
MARTLEPLAKKIFKGVLVAELVGVFGAYFLFSKMHTSQDFRQTMSKKYPFILEVYYKSTEKSGMYGIRELDQKTWLNSKN

SEQ ID NO: 7337 - protein, 80 aa, Homo sapiens; identical to SEQ ID NO: 7336

SEQ ID NO: 7338 - protein, 79 aa, Homo sapiens
  UNSURE 78: Xaa = Asp,Glu
MHPDLSPHLHTEECNVLINLLKECHKNHNILKFFGYCNDVDRELRKCLKNEYVENRTKSREHGIAMRKKLFNPPEESXK

SEQ ID NO: 7339 - protein, 54 aa, Homo sapiens
MCDAKEDAAFKVLSWKQRLCPHQMLNLLSTLIFHFTFIRTVFEELSHCLLQWMN

SEQ ID NO: 7340 - protein, 54 aa, Homo sapiens
  UNSURE 6: Xaa = Leu,Val
MIILTXFNLKVKGYELILKRLPVLLVHWGFNYVYIRACFQFYQNLRNKVEVQIG

SEQ ID NO: 7341 - protein, 67 aa, Homo sapiens
  UNSURE 49: Xaa =  * ,Tyr
  UNSURE 51: Xaa = Phe,Ile
MMSLKSYPTNFLYISIFPTLIFMMHYLICPECIMDICSYHLFFSINLMXLXSQICCLSTKKIYVVYP

SEQ ID NO: 7342 - protein, 121 aa, Homo sapiens
  UNSURE 87: Xaa = Ile,Val
MASEAEKTFHRFAAFGESSSSGTEMNNKNFSKLCKDCGIMDGKTVTSTGRGHRVQQSQGQERPNHHVSTVQRGSEGTGPEALQREEXQMKSLENIYGLMEGQRPSHHWALLKQQQWVQWTV

SEQ ID NO: 7343 - protein, 67 aa, Homo sapiens
MASEAEKTFHRFAAFGESSSSGTEMNNKNFSKLCKDCGIMDGKTVTSTDVTSCSAKSSEEPKIWRWG

SEQ ID NO: 7344 - protein, 73 aa, Homo sapiens
MASEAEKTFHRFAAFGESSSSGTEMNNKNFSKLCKDCGIMDGKTVTSTDVTSCSAKSRPRTPEPSRFNSSKRQ

SEQ ID NO: 7345 - protein, 58 aa, Homo sapiens
MASEAEKTFHRFAAFGESSSSGTEMNNKNFSKLCKDCGIMDGKTVTSTDVDIVFSKVK

SEQ ID NO: 7346 - protein, 73 aa, Homo sapiens; identical to SEQ ID NO: 7344

SEQ ID NO: 7347 - protein, 155 aa, Homo sapiens
  UNSURE 41: Xaa = Ala,Asp
  UNSURE 132: Xaa = Ala,Glu
  UNSURE 6,102: Xaa = Asp,Glu
  UNSURE 51: Xaa = Asp,His,Asn,Tyr
  UNSURE 131: Xaa = Lys,Asn
  UNSURE 7: Xaa = Lys,Gln
  UNSURE 56: Xaa = Lys,Thr
  UNSURE 137: Xaa = Ser,Thr
MASEAXXTFHRFAAFGESSSSGTEMNNKNFSKLCKDCGIMXGKTVTSTDVXIVFSXVKAKNARTITFQQFKEAVKELGQKRFKGKSPDEVLENIYGLMEGKXPATTGATKATTVGAVDRLTDTSKYTGTHXXRFDEXGKGKGIAGREEMTDTQAM

SEQ ID NO: 7348 - protein, 73 aa, Homo sapiens; identical to SEQ ID NO: 7344

SEQ ID NO: 7349 - protein, 52 aa, Homo sapiens; identical to SEQ ID NO: 6638

SEQ ID NO: 7350 - protein, 116 aa, Homo sapiens
MLRPKALTQVLSQANTGGVQSTLLLNNEGSLLAYSGYGDTDARVTAAIASNIWAAYDRNGTKRLMKTISNSSSWTAWPRLWCSTWRSPSPKWRHLNGIGGSWGQKREMTIWRGGAS

SEQ ID NO: 7351 - protein, 80 aa, Homo sapiens
MLRPKALTQVLSQANTGGVQSTLLLNNEGSLLAYSGYGDTDARVTAAIASNIWAAYDRNGTKRLMKTISNSSSWTAWRAV

SEQ ID NO: 7352 - protein, 80 aa, Homo sapiens; identical to SEQ ID NO: 7351

SEQ ID NO: 7353 - protein, 69 aa, Homo sapiens
MDNSNIVAMFEMMDSSGRGTISFVQYKEALKTLGLCTEDEDLQDDGHKITLDKFKEEVNKRMKEIWSAF

SEQ ID NO: 7354 - protein, 72 aa, Homo sapiens
MDNSNIVAMFEMMDSSGRGTISFVQYKEALKTLGLCTEDEDLQDDGHKITLDKFKEEVCIHPASLQAFARKF

SEQ ID NO: 7355 - protein, 103 aa, Homo sapiens
MTTEIGWWKLTFLRKKKSTPKVLYEIPDTYAQTEGDAEPPRPDAGGPNSDFNTRLEKIVDKSTKGKHVKVSNSGRFKEKKKVRATLAENPNLFDDHEEGRSSK

SEQ ID NO: 7356 - protein, 52 aa, Homo sapiens [sequence omitted]

SEQ ID NO: 7357 - protein, 56 aa, Homo sapiens
  UNSURE 18: Xaa = Gly,Trp
MEGWGMSSINPYGMHSQXPSHLGLEPLVQGLGENRPHGNSHTVIAFNTEPRVPKQQ

SEQ ID NO: 7358 - protein, 110 aa, Homo sapiens
MQAALEVTARYCGRELEQYGQCVAAKPESWQRDCHYLKMSIAQCTSSHPIIRQIRQACAQPFEAFEECLRQNEAAVGNCAEHMRRFLQCAEQVQPPRSPATVEAQPLPAS

SEQ ID NO: 7359 - protein, 91 aa, Homo sapiens
MAATVNLELDPIFLKALGFLHSKSKDSAEKLKALLDESLARGIDSSYRPSQKDVEPPKISSTKNISIKQEPKISSSLPSGNNMARSSQLKR

SEQ ID NO: 7360 - protein, 76 aa, Homo sapiens
  UNSURE 67: Xaa = Gly,Ile,Arg,Val
MGPQVCAPYSPPITYQRALQELLTNRLSMVLHSRINCTSVCAKSTRHWRNSRNNTWYRHMDLSGKRXGNKQEKARV

SEQ ID NO: 7361 - protein, 57 aa, Homo sapiens
MAHVSSETQDVSPKDELTASEASTRSPLCEHTFPGDSDLRSMIEEHAFKETLENSGK

SEQ ID NO: 7362 - protein, 55 aa, Homo sapiens
  UNSURE 2: Xaa = Ala,Gly
  UNSURE 8: Xaa = Ala,Thr
  UNSURE 50: Xaa = Cys,Phe
  UNSURE 29: Xaa = Cys,Trp
  UNSURE 7: Xaa = Glu,Gly
  UNSURE 42: Xaa = Met,Arg
MXHVSAXXQDVSPKDESTGSKASSGSPLXEHIIPGDSDLRSXTESMIFRXCHKDP

SEQ ID NO: 7363 - protein, 53 aa, Homo sapiens
  UNSURE 14: Xaa = Asp,Asn
MFLQKLKMFLLKMXQLGSKASSGSPLCEHIIPGDSDLRSMTESMIFRFCHKDP

SEQ ID NO: 7364 - protein, 68 aa, Homo sapiens
  UNSURE 35: Xaa = Gly,Val
MGEILRARASETFRHRAREGFQVPLSSCSQGELVXCYSSLRGSWFFATRAARWRFGVSEEDSTGHESW

SEQ ID NO: 7365 - protein, 68 aa, Homo sapiens
MSCTPKDSVLQLHPPVSLNINSERANLTGERTTRMRMSPTELNLSPEASCWPWNMAKALSVPVKERGK

SEQ ID NO: 7366 - protein, 51 aa, Homo sapiens
MCPLPLAAAAVAAPRAPLRLLNRGLAAAMSTAQSLKSVDYEVFGRVQGSPG

SEQ ID NO: 7367 - protein, 67 aa, Homo sapiens
MSSTVCNSPTNELFSPHIPPSLNPPMPIVFILRNTESQGASFHFPKGVALALWATTVFKLCGVTMTV

SEQ ID NO: 7368 - protein, 63 aa, Homo sapiens [sequence omitted]

SEQ ID NO: 7369 - protein, 75 aa, Homo sapiens
  UNSURE 27: Xaa = Gly,Arg
MPGPTPSGTNVGSSGRSPSKAVAARAXDPLSGRGKMPAVGQGVQAAQPRQAPGGCGDSTQKIHLGSKLALFQYWL

SEQ ID NO: 7370 - protein, 52 aa, Homo sapiens
  UNSURE 27: Xaa = Gly,Arg
MPGPTPSGTNVGSSGRSPSKAVAARAXDPLSGRDFNREPAQVISIPGTHHKA

SEQ ID NO: 7371 - protein, 75 aa, Homo sapiens; identical to SEQ ID NO: 7369
  UNSURE 27: Xaa = Gly,Arg

SEQ ID NO: 7372 - protein, 91 aa, Homo sapiens
MLSNLHELLPNHLMETLYSRKSEEDKKKCENPELSGLERILARHQLPKEINLTPKPNRMPPWKRKIINNVTDGWKKCHLLKRTRKSLQCPP

SEQ ID NO: 7373 - protein, 68 aa, Homo sapiens
MFILPKASSRHNAIPIKIPMTFFKEIEKTILKFVWNHKRPQITKAILNKKKKKLEASHCLASKYTTRL

SEQ ID NO: 7374 - protein, 101 aa, Homo sapiens
MDVFLMIRRHKTTIFTDAKESSTVFELKRIVEGILKRPPDEQRLYKDDQLLDDGKTLGECGFTSQTARPQAQPQWGWPSGQMTPLRPCASSRFPARQSCPM

SEQ ID NO: 7375 - protein, 66 aa, Homo sapiens
MDVFLMIRRHKTTIFTDAKESSTVFELKRIVEGILKRPPDEQRLYKMTPLRPCASSRFPARQSCPM

SEQ ID NO: 7376 - protein, 58 aa, Homo sapiens; identical to SEQ ID NO: 7301

SEQ ID NO: 7377 - protein, 65 aa, Homo sapiens
  UNSURE 19: Xaa = Ala,Pro
  UNSURE 41: Xaa = Cys,Trp
  UNSURE 63: Xaa = Glu,Gly
MLTRLVLNSWPQVILPLQXSQYAGITGMRRQAWHWFCFCSXLYPSMDMCITEIELDKYLLNNXLN

SEQ ID NO: 7378 - protein, 92 aa, Homo sapiens
  UNSURE 41: Xaa = Ala,Pro
MKKDGLVGMASWEAWPWVWRDWPDSSDLLCPSPNPEGDAGXTENAPGGPVHPRCPFPVLPLPPVSILCGLQLISAPLRFVLQPHHVLWDECK

SEQ ID NO: 7379 - protein, 89 aa, Homo sapiens
  UNSURE 38: Xaa = Ala,Pro
MDSWAWPSWEAWPWVWRDWPDSSDLLCPSPNPEGDAGXTENAPGGPVHPRCPFPVLPLPPVSILCGLQLISAPLRFVLQPHHVLWDECK

SEQ ID NO: 7380 - protein, 65 aa, Homo sapiens [sequence omitted]

SEQ ID NO: 7381 - protein, 68 aa, Homo sapiens
  UNSURE 55: Xaa = His,Asn
  UNSURE 56: Xaa = Leu,Val
  UNSURE 65: Xaa = Lys,Gln
  UNSURE 12: Xaa = Pro,Arg
METGPEDPSSMXEESSPRRTPQSIPYQDLPQPGQCRRTVPLLQVLETHRHTQGPXXCVPWSRRAXWPL

SEQ ID NO: 7382 - protein, 80 aa, Homo sapiens
MRKVVLITGASSGIGLALCKRLLAEDDELHLCLACRNMSKAEAVCAALLASHPTARSPLSRWMSATCSHSSGPPRNLSKG

SEQ ID NO: 7383 - protein, 83 aa, Homo sapiens [sequence omitted]

SEQ ID NO: 7384 - protein, 102 aa, Homo sapiens
MADDVDQQQTTNTVEEPLDLIRLSLDERIYVKMRNDRELRGRLHAYDQHLNMILGDVEETVTTIEIDEETYEEIYKSTKRNIPMLFVRGDGVVLVAPPLRVG

SEQ ID NO: 7385 - protein, 69 aa, Homo sapiens
METESGNQEKVMEEESTEKKKEVEKKKRSRVKQVLADIAKQVDFWFGDANLHKDRFLREQIEKSRDGYG

SEQ ID NO: 7386 - protein, 57 aa, Homo sapiens [sequence omitted]

SEQ ID NO: 7387 - protein, 65 aa, Homo sapiens
MNIRNAQPDDLMNMQHCNLLCLPENYQMKYYLYHGLSWPQLSYIAEDEDGKIVGYVLAKMGGGTR

SEQ ID NO: 7388 - protein, 112 aa, Homo sapiens
MFSKMATYLTGELTATSEDYKLLENMNKLTSLKYLEMKDIAINISRNLKDLNQKYAGLQPYLDQINVIEEQVAALEQAAYKLDAYSKKTGSQVQEAGEAMRNLFLWDRVFFF

SEQ ID NO: 7389 - protein, 74 aa, Homo sapiens
MAPTIQTQAQREDGHRPIPTGLCLRGLEWSAESSTAIASLISPSTPSSSPTPSTRTGSSSTKPLPWRNSTNMTS

SEQ ID NO: 7390 - protein, 50 aa, Homo sapiens [sequence omitted]

SEQ ID NO: 7391 - protein, 59 aa, Homo sapiens [sequence omitted]

SEQ ID NO: 7392 - protein, 116 aa, Homo sapiens
  UNSURE 112: Xaa = Asp,Asn
  UNSURE 19: Xaa = Ile,Lys,Arg,Thr
  UNSURE 108: Xaa = Ser,Thr
MGGAVSAGEDNDELIDNLXEAQYIRTELVEQAFRAIDRADYYLEEFKENAYKDLAWKHGNIHLSAPCIYSEVMEALDLQPGLSFLNLGSGTGYLSSMVGLILGPFGVXMGWXFTQM

SEQ ID NO: 7393 - protein, 75 aa, Homo sapiens
  UNSURE 4: Xaa = Ala,Asp,Gly,Val
MRTXPSAKDQESCPHDPLPQHIHFQSSARNLCAENRRKAQGAAALPTGPFHSQASSAKAGREETHSPPNPYDQGL

SEQ ID NO: 7394 - protein, 70 aa, Homo sapiens
  UNSURE 27: Xaa = Asn,Thr
MWAFSRVKIQVLTTVYLQFPLKKKKVXLAAIEYTMCIYNSYFIYCSINIFKLNVLHSQVVGSLVIKVCVI

SEQ ID NO: 7395 - protein, 63 aa, Homo sapiens [sequence omitted]

SEQ ID NO: 7396 - protein, 60 aa, Homo sapiens
  UNSURE 54: Xaa =  * ,Ser
  UNSURE 51: Xaa = Cys,Gly
  UNSURE 52: Xaa = Glu,Gln
  UNSURE 50: Xaa = Lys,Asn
  UNSURE 53: Xaa = Phe,Val
MVKLTLLNIYHVPSCRLNSFYVLYHLVLTVNPCGAYHHYLRKLRLRDRVXXXXXGHTSRK

SEQ ID NO: 7397 - protein, 58 aa, Homo sapiens
  UNSURE 18: Xaa =  * ,Glu,Lys
  UNSURE 30: Xaa =  * ,Gly
  UNSURE 19: Xaa = Ala,Thr
  UNSURE 13: Xaa = Arg,Ser
  UNSURE 20: Xaa = Gln,Arg
  UNSURE 24: Xaa = Pro,Thr
MPVIPALWEAKVXGFPFXXXDFKXSLANMXNPITTKNTKISQAQWHMPVIPASQEAEA

SEQ ID NO: 7398 - protein, 60 aa, Homo sapiens
MRLSPFHLQLEFHMKEKREDLQISWSFISVPEMAVNIQPKHWGRTRWLRQVRCLTFSRTS

SEQ ID NO: 7399 - protein, 60 aa, Homo sapiens
  UNSURE 40: Xaa = Ala,Pro,Thr
MRHPLSVSHKPAKKMDVARITFDLNKLSPQDFISCLNVKXTFYDVYSISYDLHCMRLSAW

SEQ ID NO: 7400 - protein, 83 aa, Homo sapiens [sequence omitted]

SEQ ID NO: 7401 - protein, 59 aa, Homo sapiens
  UNSURE 25: Xaa = His,Ile,Leu,Asn,Pro,Arg,Ser,Thr
  UNSURE 29: Xaa = Lys,Asn
  UNSURE 30: Xaa = Met,Arg
MLCCLPPGTELLGGTYAFTVCAICXLIPXXNALKSFEVRSFNSYFLLHWSLFFYCSIRC

SEQ ID NO: 7402 - protein, 66 aa, Homo sapiens
  UNSURE 34: Xaa = Asn,Thr
  UNSURE 37: Xaa = Glu,Gly
  UNSURE 33: Xaa = His,Gln
MHILHEKVCILFEYIMNLGVYKGLRMSDKISWXXPAXWMIFILENDELINLYMKSNKQSLLFLEQK

SEQ ID NO: 7403 - protein, 68 aa, Homo sapiens [sequence omitted]

SEQ ID NO: 7404 - protein, 61 aa, Homo sapiens
MEIDVRSEYWSYTSISELILSSHEKESSFKVQLLSLLEANFFSFIFLNINILLYGLKRPHE

SEQ ID NO: 7405 - protein, 58 aa, Homo sapiens; identical to SEQ ID NO: 7301

SEQ ID NO: 7406 - protein, 98 aa, Homo sapiens
MRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRVD

SEQ ID NO: 7407 - protein, 122 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRVSN

SEQ ID NO: 7408 - protein, 120 aa, Homo sapiens
MSSLYPSLEDLKVDQAIQAQVRASPKMPALPVQATAISPPPVLYPNLAELENYMGLSLSSQEVQESLLQIPEGDSTAVSGPGPGQMVAPVTGTAWACGELRSSPGCARSTCARTSAARPG

SEQ ID NO: 7409 - protein, 52 aa, Homo sapiens
MPMWNARCEPSWYSWKKHPARTVSLTVIIPGASTHTHIPTILECFCFMKQKE

SEQ ID NO: 7410 - protein, 63 aa, Homo sapiens
  UNSURE 13: Xaa =  * ,His,Gln,Tyr
  UNSURE 30,63: Xaa = Ala,Pro
  UNSURE 2: Xaa = Gly,Arg
MXLRPWRGVARPXTRLPAVRRAVYLCHAQXWQVLQAALVLSPRMVSLQIHVSAYDPCGTASKX

SEQ ID NO: 7411 - protein, 81 aa, Homo sapiens
MVAPVTFASIVEEELQQEAALIRSREKPLALIQIEEHAIQDLLVFYEAFGNPEEFVIVERTPQDHWQYLCGISMDASSLWS

SEQ ID NO: 7412 - protein, 70 aa, Homo sapiens
MPHIDNDVKLDFKDVLLRPKRSTLKSRSEVDLTRSFSFRNSKQTYSGVPIIAANMDTVGTFEMAKVLCKS

SEQ ID NO: 7413 - protein, 158 aa, Homo sapiens
MAAVAAGGLVGKGRDISLAALQRHDPYINRIVDVASQVALYTFAHRANEWEKTDVEGTLFVYTRSASPKHGFTIMNRLSMENRTEPITKDLDFQLQDPFLLYRNARLSIYGIWFYDKEECQRIAELMKNLTQYEQLKAHQGTGAGISPVILNSGEGKK

SEQ ID NO: 7414 - protein, 58 aa, Homo sapiens; identical to SEQ ID NO: 7301

SEQ ID NO: 7415 - protein, 88 aa, Homo sapiens
MALSTIVSQRKQIKRKAPRGFLKRVFKRKKPQLRLEKSGDLLVHLNCLLFVHRLAEESRTNACASKCRVINKEHVLAAAKVILKKSRG

SEQ ID NO: 7416 - protein, 88 aa, Homo sapiens; identical to SEQ ID NO: 7415

SEQ ID NO: 7417 - protein, 56 aa, Homo sapiens; identical to SEQ ID NO: 6275

SEQ ID NO: 7418 - protein, 96 aa, Homo sapiens
MPRLEVQSFLDFAPHYFNYITNAVQQKRPTALAKILGVYRIGYKNSQNNTEKKLDLLVMENLFYGRKMAQVFDLKGSLRNRNVKTDTGKESCDVVL

SEQ ID NO: 7419 - protein, 58 aa, Homo sapiens
MKSAPFPSGFSKYEQRRHKTQVPETVPATIRLISRHTGPCSPLRLGSWTRVLRSDRRA

SEQ ID NO: 7420 - protein, 62 aa, Homo sapiens
  UNSURE 12: Xaa = Ala,Gly
MAHPERAWKLRXPSHRLSPIHLFIWCSSIAFVMSLIVNRKTCTPNSMVRKPQKDVSKDHEGV

SEQ ID NO: 7421 - protein, 106 aa, Homo sapiens
MMATGTPESQARFGQSVKGLLTEKVTTCGTDVIALTKQVLKGSRSSELLGQAARNMVLQEDAILHSEDSLRKMAIITTHLQYQQEAIQKNVEQSSDLQDQLNHLLK

SEQ ID NO: 7422 - protein, 55 aa, Homo sapiens [sequence omitted]

SEQ ID NO: 7423 - protein, 78 aa, Homo sapiens
MPRQPQSHDEGQLRTRCAQNHRSGSLDPALSARYLNGDSSSFGVPSAGSTTTLLLGLGIKPCQVARKAGGRAGRHHLT

SEQ ID NO: 7424 - protein, 53 aa, Homo sapiens
MQNCRTRSGGWIQRTWGSVWAVLVKEGFQGEATEDSLQLFLEKMRIRSGIGNI

SEQ ID NO: 7425 - protein, 90 aa, Homo sapiens
MSARKLRNLSYKKAVRRQKLLEQSIQSAQETEKSLHLIQESLTFIDKQLAAYIADKVDAAQMPQEAQASTSGNQLPFFCFYYFNKMLQCF

SEQ ID NO: 7426 - protein, 90 aa, Homo sapiens; identical to SEQ ID NO: 7425

SEQ ID NO: 7427 - protein, 63 aa, Homo sapiens [sequence omitted]

SEQ ID NO: 7428 - protein, 59 aa, Homo sapiens; identical to SEQ ID NO: 5025

SEQ ID NO: 7429 - protein, 59 aa, Homo sapiens; identical to SEQ ID NO: 5025

SEQ ID NO: 7430 - protein, 55 aa, Homo sapiens
MAEQEQRKIPLVPENLLKKRKAYQALKATQAKQALLAKKEVMVGNQEKVIRIFIW

SEQ ID NO: 7431 - protein, 59 aa, Homo sapiens; identical to SEQ ID NO: 5025

SEQ ID NO: 7432 - protein, 59 aa, Homo sapiens; identical to SEQ ID NO: 5025

SEQ ID NO: 7433 - protein, 60 aa, Homo sapiens
MLSMSSLNILHIWNSAVIIVLMSTSTNVKSCISSGSISIDQMPSLNEICIVLLLCKPGNF

SEQ ID NO: 7434 - protein, 80 aa, Homo sapiens
  UNSURE 48: Xaa = Ile,Ser
MNCSRCVVWGSQMAILCMCIWYHGPWNRIYVGPLKSCKGPILSILHGXQKLMVVAAEVWLLDEADFFFLTWNNETNNKHF

SEQ ID NO: 7435 - protein, 59 aa, Homo sapiens
MIKGYYCYPHFSYEAWRGSMARPGAPGEMGCRARNNPEPAHSATRLSGSTGPDTSFTSL

SEQ ID NO: 7436 - protein, 58 aa, Homo sapiens; identical to SEQ ID NO: 7301

SEQ ID NO: 7437 - protein, 63 aa, Homo sapiens
  UNSURE 9: Xaa = Ala,Cys,Gly,Ser,Trp
  UNSURE 8: Xaa = Asp,Glu,His,Gln
MLTAWSAXXMLCERIAIAKELIKRAESLSRSRKGGIEGGAKLCSKLKAGIKILAESRSWESSY

SEQ ID NO: 7438 - protein, 50 aa, Homo sapiens
MNHLDSSMKWSEPRRAQPTEALWEPVSKARLAKCHLILNLVGPHSPSARS

SEQ ID NO: 7439 - protein, 60 aa, Homo sapiens
MQSARAWLPGDCTSRDGVASAFSGATLLQLPPLPGAPGKKECQVDMQSLWREAVLFAGLW

SEQ ID NO: 7440 - protein, 59 aa, Homo sapiens
  UNSURE 39: Xaa = Leu,Pro,Gln,Arg
MSVLLPSPKKSHAGRGGNQSSALPGSPWSPWEILSLQRXKSPGPIAETPGHCSTAAAER

SEQ ID NO: 7441 - protein, 112 aa, Homo sapiens
MYRTKVGLKDRQQLYKLIISQLLYDGYISIANGLINEIKPQSVCAPSEQLLHLIKLGMENDDTAVQYAIGRSDTVAPGTGLTWNLMQMFRLCPQRLLSTKHAMSHHIKDHAV

SEQ ID NO: 7442 - protein, 53 aa, Homo sapiens
MMSAAAIANGGGVASGSLVATLQSLGATGLSGLTKFILGSIGSAIAAVIARFY

SEQ ID NO: 7443 - protein, 75 aa, Homo sapiens; identical to SEQ ID NO: 6647

SEQ ID NO: 7444 - protein, 53 aa, Homo sapiens; identical to SEQ ID NO: 7442

SEQ ID NO: 7445 - protein, 97 aa, Homo sapiens
MTILCQENENVRYFHYRESHFPLIVSGRKKATQINLFRTIFSYLYMSYMLSCSKTTLFLDTAFQNLWDSTLKKKKEYLALHIILFWGSLISTLISES

SEQ ID NO: 7446 - protein, 83 aa, Homo sapiens
  UNSURE 62: Xaa = Gly,Val
  UNSURE 16: Xaa = Leu,Val
MGKESGWDSGRAAVAXLVGGFVAVGTVLVALSAMGFTSVGIAASSIAAKMMSTAAIANGGGXCCWQSGGYSAVSGGSWTLCDI

SEQ ID NO: 7447 - protein, 91 aa, Homo sapiens [sequence omitted]

SEQ ID NO: 7448 - protein, 56 aa, Homo sapiens
MRVRGKLSPTERIQIGREKKKDQRWFMWAAPHNPAQTLLRHQDLQDSYEETEAKEC

SEQ ID NO: 7449 - protein, 71 aa, Homo sapiens
  UNSURE 17: Xaa = Asp,Glu
MLSRVSPVLQGSHKASXLLPKQLYILSEQWGSSFSLELKRFICGTSLPSILQFQVQKGTKAQIQCLEGLNF

SEQ ID NO: 7450 - protein, 58 aa, Homo sapiens
MLVTINEGRVCRTLEISPEIQPNSIPGPKTLKNLELESSRLEASTDCRIQGDICRLAL

SEQ ID NO: 7451 - protein, 53 aa, Homo sapiens
MLDTEKELLKEKIKEALIQQSQEQKEILEKCLEEERQRNKEALVSAANLKKKQ

SEQ ID NO: 7452 - protein, 81 aa, Homo sapiens
  UNSURE 75: Xaa =  * ,Leu
  UNSURE 68: Xaa = Ala,Gly
  UNSURE 72: Xaa = Ala,Pro
  UNSURE 66,69: Xaa = Asp,Glu
  UNSURE 80: Xaa = Cys,Gly
MQLNRQTRSVNHMKAWNLMNLIPSLTGEMQIPSYPLSRDGELKSKRGSENALSLSTSSIGKPVTTXFXXGKXNGXWIQCXL

SEQ ID NO: 7453 - protein, 125 aa, Homo sapiens
MERHTSHPNRKVPAKEEANAVPLCRAKPSPSYINLQASSPPATFLNIQTTKLPSVDHKPKECLGLLECMYANLQLQTQLAQQQMAVLEHLQASVTQLAPGRGSNNSSLPALSPNPLLNHLPQFSK

SEQ ID NO: 7454 - protein, 107 aa, Homo sapiens
MCVLELKDARLLSPCSFPLFNLMFFGIKTSLPSSTWFYAQHALTVEKRPLAHIEGMVMEMPIHGIRWHSYVGSYSRSLLGKDSSREGRYHWRTMHEDREEMIGIMKH

SEQ ID NO: 7455 - protein, 69 aa, Homo sapiens
MYSHQEDLKVWSLVEKKLILGEASCHVMKTLKKPCEEEARPANNSQHQLSSQGIEPSHSGSSSPHQAFI

SEQ ID NO: 7456 - protein, 56 aa, Homo sapiens
MQEMSDFHSFLSPYSTQEVQLAPPLDHKFQVNLDISNNLSFAVNYKIFQFDHWRLT

SEQ ID NO: 7457 - protein, 144 aa, Homo sapiens
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLI

SEQ ID NO: 7458 - protein, 66 aa, Homo sapiens
  UNSURE 12: Xaa =  * ,Glu,Lys,Gln
  UNSURE 48: Xaa = Ala,Val
  UNSURE 17: Xaa = Phe,Ile
MTWSGVTARTEXARPAXLNTLGWWGCGKKRVCFFTSSTESAHYGCPLXPRTHNMKEMVLPSSSLGL

SEQ ID NO: 7459 - protein, 220 aa, Homo sapiens
MPMWNKVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIENRHTSVRSC

SEQ ID NO: 7460 - protein, 71 aa, Homo sapiens
  UNSURE 19: Xaa = Asp,Glu
MELSAEYLREKLQRDLEAXMWRWRTRPSTVAPVASESWWCRPSSRGNRCFRDTGSVQSNEMCDGCKPGVFF

SEQ ID NO: 7461 - protein, 55 aa, Homo sapiens
  UNSURE 19: Xaa = Asp,Glu
MELSAEYLREKLQRDLEAXMWRWRTRPSTVAPVASESWWCRPSSRGNRCFRDTGW

SEQ ID NO: 7462 - protein, 57 aa, Homo sapiens
MIKTTILLSSIQVLMSILKRRELKKFCRNCFLHHISKDLLRISEVPRVERSEPKKLI

SEQ ID NO: 7463 - protein, 69 aa, Homo sapiens
MIKTTILLSSIQVLMSILKRRELKKFCRNCFLHHISKDLLRISEVPRVERSEPKNSSEVFGQMKSMAAD

SEQ ID NO: 7464 - protein, 66 aa, Homo sapiens
  UNSURE 47: Xaa =  * ,Glu
  UNSURE 58: Xaa = Ile,Ser
MVRAAVAATKAWLSGGVLRCWEPWGGRGRGIGKSRSLGVRAQALAWXRPRRGLGKEGXGHLWVRLA

SEQ ID NO: 7465 - protein, 139 aa, Homo sapiens
MLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSAHWGI

SEQ ID NO: 7466 - protein, 123 aa, Homo sapiens
MAGHRLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKF

SEQ ID NO: 7467 - protein, 142 aa, Homo sapiens
  UNSURE 141: Xaa = Asp,Glu
  UNSURE 139: Xaa = Ile,Met
MAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSITCKTRSRSFXNXR

SEQ ID NO: 7468 - protein, 70 aa, Homo sapiens
MDDPKSEQQRILRRHQRERQELQAQIRSLKNSVPKTDKTKRKQLLQDVARMEGRDGSEAPAGAGEVPRRQ

SEQ ID NO: 7469 - protein, 51 aa, Homo sapiens
MLQRSLRICFKLGGGLEIQKSLCSTGLFSCLCKKFRFLFQHLERHSSPPRR

SEQ ID NO: 7470 - protein, 78 aa, Homo sapiens [sequence omitted]

SEQ ID NO: 7471 - protein, 56 aa, Homo sapiens
  UNSURE 42: Xaa = Ile,Asn,Ser,Thr
  UNSURE 23: Xaa = Leu,Arg
MPVCDVGKKKKASDITEGLCIFXFSEPPPLTLITQTLTEPRXPNSADLRTFEDYLP

SEQ ID NO: 7472 - protein, 136 aa, Homo sapiens
  UNSURE 89: Xaa = Ala,Pro
  UNSURE 99: Xaa = Asn,Tyr
MARTKQTARKSTGGKAPRKQLATKAARKSAPSTGGVKKPHRYRPGTVALREIRRYQKSTELLIRKLPFQRLVREIAQDFKTDLRFQSAXSVRCRRLAKXLVGLFEDTNLCAIHAKRVTIMPKDIQLARRIRERELK

SEQ ID NO: 7473 - protein, 72 aa, Homo sapiens
  UNSURE 72: Xaa = Gly,Arg,Trp
MARTKQTARKSTGGKAPRKQLATKAARKSAPSTGGVKKPHRYRPGTVALREIRRYQKSTELLIRKLPLPEVX

SEQ ID NO: 7474 - protein, 86 aa, Homo sapiens
  UNSURE 54: Xaa =  * ,Glu,Lys,Gln
  UNSURE 61: Xaa = Asp,Gly
  UNSURE 68: Xaa = Glu,Gly
  UNSURE 65: Xaa = Lys,Arg
MDDAHESPSDKGGETGESDETAAVPGDPGATDTDGIPEETDGDADVDLKEAAAXEGEVGRXVLMXLKXLPRDCVTGCSPGFCRIEE

SEQ ID NO: 7475 - protein, 90 aa, Homo sapiens
MRISSCSDESSNSNSSRKSDNHSPAVVTTTVSSKKQPSVLVTFPKEERKSVSGKASIKLVPIFIFNIYSVIMKYLITEFVGKKVNLQLAK

SEQ ID NO: 7476 - protein, 72 aa, Homo sapiens
MIERQRVASLQGTSSSRHGITLREKTDKGRGSCDGISQMPAWPLPLRGLGLLLTLAGWYKLPAQIKLCLMLP

SEQ ID NO: 7477 - protein, 55 aa, Homo sapiens
  UNSURE 19: Xaa =  * ,Leu
  UNSURE 28: Xaa = Gly,Ser
MGCEELAEQRQASQMERTXGECRPLVEXRTECGQTWSKRDIITALKESTMHEGSI

SEQ ID NO: 7478 - protein, 151 aa, Homo sapiens
MTKIKADPDGPRLRRRRVPGSAPTRSCWSTRTPSRTPGFSPPHAKLYKCIKKAVKQKQIRRGVKEVQKFVNKGEKGIMVLAGDTLPIEVYCHLPVMCEDRNLPYVYIPSKTDLGAAASKRPTCVIMVKPHEEYQEAYDECLEEVQSLPLPL

SEQ ID NO: 7479 - protein, 88 aa, Homo sapiens
  UNSURE 58: Xaa = Ala,Asp,Gly,His,Leu,Pro,Arg,Val
MLLSPGEVTSTIKGGSEMASGFLGVGQGPAGGFPSRCTEGSAEPTVCRGCVPRALPRXPPALASALQGGVPILGAVCHAHLTQVCVPV

SEQ ID NO: 7480 - protein, 123 aa, Homo sapiens
  UNSURE 117: Xaa = His,Gln
  UNSURE 36: Xaa = Pro,Arg,Ser,Thr
MTKIKADPDGPRLRRRRVPGSAPTRSCWSTRTPSRXPGFSPPHAKLYKCIKKAVKQKQIRRGVKEVQKFVNKGEKGIMVLAGDTLPIEVYCHLPVMCEDRNLPYVYIPSKTDLGAAXPSAPPV

SEQ ID NO: 7481 - protein, 73 aa, Homo sapiens
MPTSSSFKHRIKEQEDYIRDWTAHREEIARISQDLALIAREINDVAGEIDSVTSSGTAPSTTVSTAATTPGSA

SEQ ID NO: 7482 - protein, 50 aa, Homo sapiens
MLGPAVLTAVLLLTHHVMEQPTVLKPRFLHLQNNHLRPSSLRALLPEPSM

SEQ ID NO: 7483 - protein, 113 aa, Homo sapiens
MLGPQVWSSVRQGLSRSLSRNVGVWASGEGKKVDIAGIYPPVTTPFTATAEVDYGKLEENLHKLGTFPFRGFVVQGSNGEFPFLTSSERLEVVSRVRQAMPKNRLLLAGSGCE

SEQ ID NO: 7484 - protein, 120 aa, Homo sapiens
  UNSURE 96: Xaa = Gly,Trp
MSFEELLKVFWENHDPTQGMRQGNDHGTQYRSAIYPTSAKQMEAALSSKENYQKVLSEHGFGPITTDIREGQTFYYAEDYHQQYLSKNPNGYCGLXGTACPAQWVLKNNCSPHGGPLRFQ

SEQ ID NO: 7485 - protein, 119 aa, Homo sapiens
  UNSURE 101: Xaa = Arg,Thr
MRPGGFLGAGQRLSRAMSRCVLEPRPPGKRWMVAGLGNPGLPGTRHSVGMAVLGQLARRLGVAESWTRDRHCAADLALAPLGDAQLVLLRPRLLMNANGRXWPGLRTVWADCRGSLPGA

SEQ ID NO: 7486 - protein, 63 aa, Homo sapiens
MVMKLELGLHECSLPVSPLGSIATRFLEEEELRSHHILERLDAHIEELKRESEKTVRQFTALK

SEQ ID NO: 7487 - protein, 139 aa, Homo sapiens
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARVWDFFSSNKRSVI

SEQ ID NO: 7488 - protein, 162 aa, Homo sapiens
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVIVSFEFGSLKKCLRYGVQK

SEQ ID NO: 7489 - protein, 104 aa, Homo sapiens
MFIQNLLWEKNMRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 7490 - protein, 65 aa, Homo sapiens
MGLGPWGCGRPGIQGMPWGSFTRMETGSPRILPSSATEPEMGLQDDTSTSGTALQVSHLGFTIAG

SEQ ID NO: 7491 - protein, 120 aa, Homo sapiens
MDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLSC

SEQ ID NO: 7492 - protein, 81 aa, Homo sapiens
MSYDRAITVFSPDGHLFQVEYAQEAVKKGSTAVGVRGRDIVVLGVEKKSVAKLQDERTVRKICALDDNVCMAFAGSPPMQG

SEQ ID NO: 7493 - protein, 65 aa, Homo sapiens [sequence omitted]

SEQ ID NO: 7494 - protein, 51 aa, Homo sapiens
  UNSURE 30: Xaa = Ala,Ser
  UNSURE 31: Xaa = Arg,Ser,Thr
  UNSURE 28: Xaa = Asp,Tyr
  UNSURE 32: Xaa = Ile,Met,Arg,Ser
  UNSURE 34: Xaa = Lys,Arg
MAKKWKQAKYSSTDEWIKKMWYIYMMDXHXXXQXNKILNHAAVWMNLKTLC

SEQ ID NO: 7495 - protein, 57 aa, Homo sapiens [sequence omitted]

SEQ ID NO: 7496 - protein, 61 aa, Homo sapiens
MSFCSFFGGEVFQNHFEPGVYVCAKCGYELFSSRSKFTLVSMAGVHRDHSRRQRGQASGAQ

SEQ ID NO: 7497 - protein, 79 aa, Homo sapiens
MGTEVSEEDICNILHLCTQVIEISEYRTQLYEYLQNRMMAIAPNVTVMVGELVGARLIALRFSFKFGQACSFYRSDSWS

SEQ ID NO: 7498 - protein, 93 aa, Homo sapiens
MANILMRDRRQTPRRGPCEDTAEPGGVRPLAAERLEPPEAEKGLRIQKSAAHSTQRWGGRGHALDHEAHSEEQVTRGEKWDNEKSQAQSKDPG

SEQ ID NO: 7499 - protein, 71 aa, Homo sapiens
  UNSURE 56: Xaa =  * ,Glu
  UNSURE 69: Xaa = Ala,Thr
MVQSCSAYGCKNRYDKDKPVSFHKFPLTRPSLFKEWEAAVRRKNFKPTKYSSICSXHFTPDCFKRECTXSY

SEQ ID NO: 7500 - protein, 92 aa, Homo sapiens
  UNSURE 25: Xaa = His,Gln
MVEKKTSVRSQDPGQRRVLDRAARXVASTGSWRPWRMTTSRMTPTRDSLSSARDCLSLMTMRTLERKRRKPEVIILNFASEKTFRPCWRSRT

SEQ ID NO: 7501 - protein, 92 aa, Homo sapiens
  UNSURE 83: Xaa = Ala,Thr
  UNSURE 25: Xaa = His,Gln
MVEKKTSVRSQDPGQRRVLDRAARXVASTGSWRPWRMTTSRMTPTQDSLSSARDCLSLMTMRTLERKRRKPEVIILNFASEKXFRPCWRSRT

SEQ ID NO: 7502 - protein, 92 aa, Homo sapiens
  UNSURE 69: Xaa = Gly,Ser
MVEKKTSVRSQDPGQRRVLDRAARHVASTGSWRPWRMTTSRMTPTRDSLSSARDCLSLMTMRTLERKRXKPEVIILNFASEKTFRPCWRSRT

SEQ ID NO: 7503 - protein, 64 aa, Homo sapiens
  UNSURE 23: Xaa = Arg,Thr
MGRKCSPVPACGSCLEVTQWCAXPSHHSPRASPVNGAGIPCSSPLAAWKLPFFQLYYWPSKELF

SEQ ID NO: 7504 - protein, 60 aa, Homo sapiens
MKFDLFQNPQKSLKWKNFLRTKRHGIDDMKLTLHHVPEIDLRKRSCPPGTSLTWKRQAVS

SEQ ID NO: 7505 - protein, 57 aa, Homo sapiens
MADGKAGDEKPEKSQRAGAAGVMEGKVPVAALRSDQLKKKLPTSQQSLQRSPSLDLP

SEQ ID NO: 7506 - protein, 50 aa, Homo sapiens
  UNSURE 27: Xaa = Cys,Gly
  UNSURE 26: Xaa = Phe,Leu
MFHYIKTSLAPLPCYVYLIEHPSLKXXDHSFHSQVSCGVLLCHPGWSPMV

SEQ ID NO: 7507 - protein, 79 aa, Homo sapiens
MNGFGRLEHFSGAVYEGQFKDNMFHGLGTYTFPNGAKYTGNFNENRVEGEGEYTDIQGLEWSGNFHFTAAPDLKLKLHM

SEQ ID NO: 7508 - protein, 67 aa, Homo sapiens
  UNSURE 3: Xaa = Cys,Gly
MGXMDYQRRQAGLPNLLTGHVTLLPPDLYSPLHLSSTVIRVISCNDQGVTPCFVSDKTVTQRDEMTC

SEQ ID NO: 7509 - protein, 57 aa, Homo sapiens
  UNSURE 8: Xaa = Phe,Ile
MFLSCACXPYWHVKISFIIVNYIPARSEIFALVFIPICFICNCARFFAPEIFFWVQL

SEQ ID NO: 7510 - protein, 60 aa, Homo sapiens [sequence omitted]

SEQ ID NO: 7511 - protein, 74 aa, Homo sapiens
  UNSURE 58: Xaa =  * ,Gly
MNGFGRLEHFSGAVYEGQFKDNMFHGLGTYTFPNGAKYTGNFNENRVKGEGEYTDIQXLEWSGNFHFTAAPDLN

SEQ ID NO: 7512 - protein, 83 aa, Homo sapiens
  UNSURE 77: Xaa =  * ,Tyr
MGKVLECDIIKNYGFVHIEDKTAAEDAIRNLHHYKLHGVNINVEASKNKSKTSTKLHVGNISPTCTNKELRAKFEEXWSGHRM

SEQ ID NO: 7513 - protein, 70 aa, Homo sapiens
MMAAALGPPEVIAQLENAAKVLMAPPSMVNNEQRQHAEHIFLSFRKSKSPFAVCKHILVLHALEVTVEER

SEQ ID NO: 7514 - protein, 77 aa, Homo sapiens
MFPGENELIVNDQLAVAELKDCIEKKTMEGRSSKVYFTINMNLDVSDEKMAMFSLACILPFKYPAVLLKLLSDQYIE

SEQ ID NO: 7515 - protein, 79 aa, Homo sapiens
MVNNEQRQHAEHIFLSFRKSKSPFAVCKHILETSKVDYVLFQAATAIMEAVVREWILLEKGSIESLRTFLLTYVLQRPK

SEQ ID NO: 7516 - protein, 101 aa, Homo sapiens
MAKIKARDLRGKKKEELLKQLDDLKVELSQLRVAKVTGGAASKLSKIRVVRKSIARVLTVINQTQKENLRKFYKGISTSPWTCGLRRHVPCAAGSTSTRRT

SEQ ID NO: 7517 - protein, 101 aa, Homo sapiens
  UNSURE 78: Xaa =  * ,Ala,Glu,Ser
MAKIKARDLRGKKKEELLKQLDDLKVELSQLRVAKVTGGAASKLSKIRVVRKSIARVLTVINQTQKENLRKFYKGKKXSPWTCGLRRHVPCAAGSTSTRRT

SEQ ID NO: 7518 - protein, 99 aa, Homo sapiens
METSNDGDCTRTSSGIYERNGIGIHTTPNGIVYTGSWKDDKMNGFGRLEHFSGAVYEGQFKDNMFHGLGTYTFPNGAKYTGNFNENRVKGEGEYTDIQG

SEQ ID NO: 7519 - protein, 95 aa, Homo sapiens
MSDAAVDTSSEITTKDLKEKKEVVEEAENGRDAPANGNANEENGEQEADNEGRRRRGRKVGRKRRRKKKVMVRKRMEMKMRKLSQLRASGAAEDG

SEQ ID NO: 7520 - protein, 69 aa, Homo sapiens
  UNSURE 61: Xaa =  * ,Ala,Cys,Asp,Glu,Gly,His,Pro,Gln,Arg,Ser,Trp,Tyr
  UNSURE 60: Xaa = Glu,Gly,Ile,Lys,Arg,Val
  UNSURE 27: Xaa = Pro,Thr
MSDAAVDTSSEITTKDLKEKKEVVEDXENGRDAPANGNANEENGEQEADNEVDEEEEEGXXGRGGGRRR

SEQ ID NO: 7521 - protein, 77 aa, Homo sapiens
  UNSURE 18: Xaa = Lys,Asn
MSDAAVDTSSEITTKDLXEKKEVVEEAENGRDAPANGNANEENGEQEADNEVDEEEEEGGEEEEEEEEGDGEGRGWR

SEQ ID NO: 7522 - protein, 59 aa, Homo sapiens [sequence omitted]

SEQ ID NO: 7523 - protein, 72 aa, Homo sapiens [sequence omitted]

SEQ ID NO: 7524 - protein, 88 aa, Homo sapiens
MPPGSGHWLLVAIFHKYSGREGDKHTLSKKELKELIQKELTIGSKLQDAEIARLMEDLDRNKDQEVNFQEYVTFLGALALIYNEALKG

SEQ ID NO: 7525 - protein, 68 aa, Homo sapiens
MSDAAVDTSSEITTKDLKEKKEVVEEAENGRHAPANGNANEENGEQEADKGRRRRGRRWGGRGGGRRR

SEQ ID NO: 7526 - protein, 88 aa, Homo sapiens; identical to SEQ ID NO: 7524

SEQ ID NO: 7527 - protein, 69 aa, Homo sapiens
MSDAAVDTSSEITTKDLKEKKEVVEEAENGRDAPANGNANEENGEQEADNEVDERRGRRWGGRGGGRRR

SEQ ID NO: 7528 - protein, 88 aa, Homo sapiens
  UNSURE 64: Xaa = His,Gln
MPPGSGHWLLVAIFHKYSGREGDKHTLSKKELKELIQKELTIGSKLQDAEIARLMEDLDRNKDXEVNFQEYVTFLGALALIYNEALKG

SEQ ID NO: 7529 - protein, 68 aa, Homo sapiens; identical to SEQ ID NO: 7525

SEQ ID NO: 7530 - protein, 96 aa, Homo sapiens
MDRSSYHCCWDTAIGYLAYKRFYVKDHRNKAMINLHIQKDNPKIVHAFDMEDLGDKAVYCRCWRSKKFPFCDGAHTKHNEETGDNVGPLIIKKKET

SEQ ID NO: 7531 - protein, 50 aa, Homo sapiens
  UNSURE 15: Xaa = Leu,Arg
MLLTWRIWEIKLYCXCWRSKKFPFCDGAHTKHNEETGDNVGPLIIKKKET

SEQ ID NO: 7532 - protein, 96 aa, Homo sapiens; identical to SEQ ID NO: 7530

SEQ ID NO: 7533 - protein, 50 aa, Homo sapiens
MLLTWRIWEIKLYCRCWRSKKFPFCDGAHTKHNEETGDNVGPLIIKKKET

SEQ ID NO: 7534 - protein, 71 aa, Homo sapiens
  UNSURE 56: Xaa = Ile,Arg
  UNSURE 12: Xaa = Ser,Thr
MDRSSYHCCWDXAIGYLAYKRFYVKDHRNKAMINLHIQKDNPKIVHAFDMEDLGDXAVYCRCWRSKKVPIL

SEQ ID NO: 7535 - protein, 50 aa, Homo sapiens; identical to SEQ ID NO: 7533

SEQ ID NO: 7536 - protein, 68 aa, Homo sapiens
MWAFPWEEPLYVITFYIVAVEAKWTESPRQHEVVLQVILEKLTYHTTHQPMQKPVYVQSAECLGPPKK

SEQ ID NO: 7537 - protein, 92 aa, Homo sapiens
  UNSURE 90: Xaa = Ala,Gly
MACPLDQAIGSLVAIFHKYSGREGDKHTLSKKELKELIQKELTIGSKLQDAEIARLMEDLDRNKDQEVNFQEYVTFLGALALIYNEALKXDK

SEQ ID NO: 7538 - protein, 79 aa, Homo sapiens
MRKDGEGGNRALFLSKENCVTLKWPQAFITMRKTYLSYPFGPKEDEACCVTETTSRHLSQDSLLLKSNMPELASIDSSP

SEQ ID NO: 7539 - protein, 72 aa, Homo sapiens [sequence omitted]

SEQ ID NO: 7540 - protein, 86 aa, Homo sapiens [sequence omitted]

SEQ ID NO: 7541 - protein, 98 aa, Homo sapiens
MVHPRILYRDGQALGSWLRPLGQPCAKDLLTTDQPDHLPPSKSSKSSKLVTCPLMFPGNQERGPLHFIFPSRVAGSLPGKQASFSTAVVALTKQSGHM

SEQ ID NO: 7542 - protein, 60 aa, Homo sapiens
MIEACTKKARTGWKRRTWWEEQEGFYHMVGMVTIIMNDYPKFKYALLAVMGAYVLLKRES

SEQ ID NO: 7543 - protein, 78 aa, Homo sapiens
MLIKVKTLTGKEIEIDIEPTDKVERIKERVEEKEGIPPQQQRLIYSGKQMNDEKTAALQDFRWFSPSPGVGSERRRWS

SEQ ID NO: 7544 - protein, 73 aa, Homo sapiens
MSEKSGQSTKAKDGKKYATLSLFNTYKGKSLETQKTTARHGLQSLGKVGISRRMLHLLTSQVLKQKTKAMILM

SEQ ID NO: 7545 - protein, 50 aa, Homo sapiens [sequence omitted]

SEQ ID NO: 7546 - protein, 63 aa, Homo sapiens [sequence omitted]

SEQ ID NO: 7547 - protein, 52 aa, Homo sapiens
MDGSLFPSPLNIFIKKQTNGQAWWLTPVIPALWKAEAGESPEVRSLRPAWPM

SEQ ID NO: 7548 - protein, 63 aa, Homo sapiens
MLKSHFRQLHDFLQMSWPCLEVYLYSLKREGCRPGAVTHACNPSTVGGQGRWITRSGDRDHPG

SEQ ID NO: 7549 - protein, 51 aa, Homo sapiens
MKKRLYREIKKLAQGYTARKQKSWSLNFDSLTRGSFSVFNQSTTLPLQKHA

SEQ ID NO: 7550 - protein, 144 aa, Homo sapiens
MAVLLETTLGDVVIDLYTEERPRACLNFLKLCKIKYYNYCLIHNVQRDFIIQTGDPTGTGRGGESIFGQLYGDQASFFEAEKVPRIKHKKKGTVSMVNNGSDQHGSQFLITTGENLDYLDGVHTVFGEVTEGMDIIKKINETFC

SEQ ID NO: 7551 - protein, 61 aa, Homo sapiens [sequence omitted]

SEQ ID NO: 7552 - protein, 69 aa, Homo sapiens
  UNSURE 61: Xaa = Asp,Glu
MVASVPGNMGRGKLGGLKNEDRFHLGCMLNFRWQRGIQQATRTGTQKRDTESHWHNDIIFXALGADELT

SEQ ID NO: 7553 - protein, 114 aa, Homo sapiens
  UNSURE 102: Xaa = Phe,Val
MDQEPVGGVERGEAVAASGAAAAAAFGESAGQMSNERGFENVELGVIGKKKKVPRRVIHFVSGETMEEYSTDEDEVDGLEKKDVLPTVDPCVTSLERRLHLXWVSAPPKYQYAI

SEQ ID NO: 7554 - protein, 66 aa, Homo sapiens
MDQEPVGGVERGEAVAASGAAAAAAFGESAGQNLTLLPRLKFMARSRLAATSTSRVQAILLPQPPV

SEQ ID NO: 7555 - protein, 51 aa, Homo sapiens
MYSLPWGWCEALHEAPMIQSPPTRPHLQHWGLHFNMRFGQDKNPNYFKDSS

SEQ ID NO: 7556 - protein, 66 aa, Homo sapiens; identical to SEQ ID NO: 7554

SEQ ID NO: 7557 - protein, 73 aa, Homo sapiens
  UNSURE 13: Xaa = Ala,Pro
MFFLAETTHPWPXPYPTPGPDVATIFEKVLDVPVLWNTSLICNFLSMCVIICLFGSLIRPSFLDLPILIHFYF

SEQ ID NO: 7558 - protein, 87 aa, Homo sapiens
MSSAICLFSCNICPELTSEIIDRLHRSQLLKMTFLSFFTSILSSTHDLGSIVQDLGTHFECKQFLLALLEVKGCLILRNRVVSGGLA

SEQ ID NO: 7559 - protein, 133 aa, Homo sapiens
MGIRIRVSDKGVPVRQRSSEWPRGSHEQQRQQPGQPGEPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 7560 - protein, 51 aa, Homo sapiens
MFCHTKNLGCKDKAKAPIPFFSSPRMHPSGSLARVPRPVSVSVALFSIKAL

SEQ ID NO: 7561 - protein, 99 aa, Homo sapiens
MRPQEKQVTITETLWDQVLTVFKDIQKELQEDARIRGMSNCSMTPMTSAPRTGSIRPSDSLMTPKLRRLQFSSGEQPSGGRIHNLKTQLFSQSAYYPGP

SEQ ID NO: 7562 - protein, 59 aa, Homo sapiens
MAQHPCQDQEQKVEMTSKQQRSTSIEETMRPQEKQVTITETLWDQVLTVFKDIQKEARV

SEQ ID NO: 7563 - protein, 80 aa, Homo sapiens
MELNEKRRGLKYELISETGRGHDKRFVMEVEVDGQKFRGAGPNKKVAKASAALAAWRNCFLDPMRQIIRKRRLSLRQRAL

SEQ ID NO: 7564 - protein, 114 aa, Homo sapiens
  UNSURE 54: Xaa = Ala,Pro
  UNSURE 55,110: Xaa = Leu,Val
MELNEKRRGLKYELISETGRGHDKRFVMEVEVDGQKFRGAGPNKKVAKASAALXXLEKLFSGPNAANNKKKKIIPQAKGVVNTAVSAAVQAVRGRGRGTLTRGAFVGATXLLAT

SEQ ID NO: 7565 - protein, 58 aa, Homo sapiens [sequence omitted]

SEQ ID NO: 7566 - protein, 117 aa, Homo sapiens
METKKLIGKPLQPARPVRHLTSPPGAVFPFNFQNEYPCNTQCIQSGVSRCKTNGMQAFSQGLNEQQQQQSPVKKERIKYSRDFLLKLSSVSICRKKPDFLPDHPIVLQKPENNQSFK

SEQ ID NO: 7567 - protein, 58 aa, Homo sapiens
  UNSURE 14: Xaa = Gly,Arg
MISAHCSVCLPGSXDSPASASRVAGSTGVCHHAWLIVCIFSRDRVSPCWQDGLDLLTS

SEQ ID NO: 7568 - protein, 107 aa, Homo sapiens
MCGDCVEKEYPNRGNTCLENGSFLLNFTGCAVCSKRDFMLITNKSLKEEDGEEIVTYDHLCKNCHHVIARHEYTFSIMDEFQEYTMLCLLCGKAKILSVFSLMTPDK

SEQ ID NO: 7569 - protein, 107 aa, Homo sapiens; identical to SEQ ID NO: 7568

SEQ ID NO: 7570 - protein, 76 aa, Homo sapiens [sequence omitted]

SEQ ID NO: 7571 - protein, 51 aa, Homo sapiens
MGKNTTKSSGRLQAILRTRMLPVPPELDEKRRTEPHPVPCREFPSALLQPK

SEQ ID NO: 7572 - protein, 59 aa, Homo sapiens
MIVLGWMFFVGLVCYMGTFPELMPPTLKWQERWPVQESKTQLRRRALGEDLLQNHVEGI

SEQ ID NO: 7573 - protein, 59 aa, Homo sapiens; identical to SEQ ID NO: 7572

SEQ ID NO: 7574 - protein, 76 aa, Homo sapiens
MIVLGWMFFVGLVCYMGTFPELMPPTLKWQERWPVQESKTQLRRRALGTMWKGYKYPPGGTPVEVSKDDPGEVMQL

SEQ ID NO: 7575 - protein, 96 aa, Homo sapiens
MSRLSARLFGEVTRPTNSKSMKVVKLFSELPLAKKKETYDWYPNHHTYAELMQTLRFLGLYRDEHQDFMDEQKRLKKLRGKEKPKKGEGKRAAKRK

SEQ ID NO: 7576 - protein, 106 aa, Homo sapiens
  UNSURE 91: Xaa = Lys,Arg
MSSLSEYAFRMSRLSARLFGEVTRPTNSKSMKVVKLFSELPLAKKKETYDWYPNHHTYAELMQTLRFLGLYRDEHQDFMDEQKRLKKLRGXEKPKKGEGKRAAKRK

SEQ ID NO: 7577 - protein, 106 aa, Homo sapiens
  UNSURE 23: Xaa = Asn,Thr
MSSLSEYAFRMSRLSARLFGEVXRPTNSKSMKVVKLFSELPLAKKKETYDWYPNHHTYAELMQTLRFLGLYRDEHQDFMDEQKRLKKLRGKEKPKKGEGKRAAKRK

SEQ ID NO: 7578 - protein, 106 aa, Homo sapiens
MSSLSEYAFRMSRLSARLFGEVTRPTNSKSMKVVKLFSELPLAKKKETYDWYPNHHTYAELMQTLRFLGLYRDEHQDFMDEQKRLKKLRGKEKPKKGEGKRAAKRK

SEQ ID NO: 7579 - protein, 152 aa, Homo sapiens
  UNSURE 29: Xaa = Ala,Gly
MQDAPLSCLSPTKWSSVSSADSTEKSASXAGTRNLPFQFCLRQALRMKAAGILTLIGCLVTGRVQNLHSLQTGKNILEGWPGQLLGLQLGNWICMAYYESGYNTTAQTVLDDGSIDYGIFQINSFAWCRRGKLKENNHCHVACSGPADTSTR

SEQ ID NO: 7580 - protein, 99 aa, Homo sapiens
  UNSURE 53: Xaa = Ile,Val
  UNSURE 65: Xaa = Lys,Arg
MAYYESGYNTTAQTVLDDGSIDYGIFQINSFAWCRRGKLKENNHCHVACSALXTDDLTDAIICAXKIVKETQGMNYWQGWKKHCEGRDLSDWKKDCEVS

SEQ ID NO: 7581 - protein, 69 aa, Homo sapiens
MPNRPPAVSKPRGFTHSPALLILNLETTFFYPGWHSFPWPWLNLMPFKYPAKLAALRKPWTLIYLLSND

SEQ ID NO: 7582 - protein, 110 aa, Homo sapiens
MEKPERQESAKHTKDWAVTGENTQPACTQVKYTALLLTQSLFGGFFTRMHVTFGAEDPGQEDSFGRPVPCCRPHSVRDPPMISGPQTNQPKEHLANFKSEDRSVRPLSPS

SEQ ID NO: 7583 - protein, 72 aa, Homo sapiens [sequence omitted]

SEQ ID NO: 7584 - protein, 81 aa, Homo sapiens [sequence omitted]

SEQ ID NO: 7585 - protein, 72 aa, Homo sapiens
  UNSURE 62: Xaa = Ala,Ser
MIQWLAGSPPCPPASVSGVGISLGRCAGSGWGGRGEEPWTLRDGISPCCLGWSGALDLKRSXLPRPPNVLGL

SEQ ID NO: 7586 - protein, 151 aa, Homo sapiens
  UNSURE 108: Xaa = Leu,Val
MQPCYSKNGFLPNASPRRLLAGLTLGRGEGLRSEGQANHSRGFLPGGSCAHGMEKGIGFFFPIFNFQNHPLYPVECTHLHSDVSRSRAYRDCHNFDYPTVSTQPAASXCYSHSWPSHSLSSVPLGPGGCSESKPQGKREAGTTEAPRQPPF

SEQ ID NO: 7587 - protein, 66 aa, Homo sapiens
MLEKLNELVYKVLPHLPYSPDFSPTTTSSSISTTFCRENASTTSRMQKMLSKSLSNPEARIFVLQE

SEQ ID NO: 7588 - protein, 71 aa, Homo sapiens
  UNSURE 34: Xaa = Leu,Trp
MISSHCNLHLPDSSDSPLSASQVAGITGIHYHAXLIFVFLVETGFHHVGQAGLQLLTSGDTPPRPPKVLGL

SEQ ID NO: 7589 - protein, 77 aa, Homo sapiens [sequence omitted]

SEQ ID NO: 7590 - protein, 60 aa, Homo sapiens
  UNSURE 25: Xaa = Ala,Asp,Gly,Val
MTGFSREGEARFFPWRGIWLEGWAXSGCEELARGIAGSERRGPRSRARRLQQWLNNWTLL

SEQ ID NO: 7591 - protein, 111 aa, Homo sapiens
MSEHVRTRSQSSERGNDQESSQPVGSVIVQEPTEEKRQEEEPPTDNQGIAPSGEIENEGAPAVQGPDMEAFQQELALLKIEDEPGDGPDVREGIMPTFDLTKVLEAGDAQP

SEQ ID NO: 7592 - protein, 110 aa, Homo sapiens
  UNSURE 82: Xaa = Ala,Glu
  UNSURE 30: Xaa = Glu,Gln
  UNSURE 55: Xaa = Glu,Lys
  UNSURE 93: Xaa = Ile,Thr
  UNSURE 94: Xaa = Leu,Met
  UNSURE 99: Xaa = Leu,Pro
  UNSURE 67: Xaa = Met,Val
  UNSURE 25: Xaa = Pro,Ser
  UNSURE 65: Xaa = Pro,Thr
MSEHVTRSQSSERGNDQESSQPVGXVIVQXPTEEKRQEEEPPTDNQGIAPSGEIXNEGAPAVQGXDXEAFQQELALLKIEDXPGDGPDVREGXXPTFDXTKVLEAGEGQL

SEQ ID NO: 7593 - protein, 89 aa, Homo sapiens [sequence omitted]

SEQ ID NO: 7594 - protein, 76 aa, Homo sapiens
MTTSRCVRLMLISMANDLKEVWISEQPFLLVTYLWQYMPTWAWWITNKMGKKRIENFKSGVDADSSYFKIFKTKHD

SEQ ID NO: 7595 - protein, 91 aa, Homo sapiens [sequence omitted]

SEQ ID NO: 7596 - protein, 71 aa, Homo sapiens
MISSHCNLHLPDSSDSPLSASQVAGITGIHYHAWLIFVFLVETGFHHVGQAGLQLLTSGDTPPRPPKVLGL

SEQ ID NO: 7597 - protein, 55 aa, Homo sapiens
MVCDPNNQFLNITTSRNRVHLQFLLTFSFPFGFPFSGLRLPVSLGTIKILPSWVH

SEQ ID NO: 7598 - protein, 55 aa, Homo sapiens [sequence omitted]

SEQ ID NO: 7599 - protein, 96 aa, Homo sapiens
  UNSURE 86: Xaa = Pro,Arg
  UNSURE 11: Xaa = Ser,Thr
MTGLSMDGGGXPRGTWTRSTMVSLGPCAPFLSPQDPFHQAAASPSPRSMLCAPYLPWLPRAAAGRLRRETAAGRDHPSRSSCPLFXETMRPFAMGA

SEQ ID NO: 7600 - protein, 55 aa, Homo sapiens
MLHIKPIEYLFSHSKRQGMHAVLMYRKLLTPLSPLNFSHICPKTFIRHTQPSLLR

SEQ ID NO: 7601 - protein, 62 aa, Homo sapiens
MMMPSSSTDPACSSCCSCWPWKKLDLHLMQNFIQKNPLLLESQPHLQQGTCVSSQRNAGGKH

SEQ ID NO: 7602 - protein, 62 aa, Homo sapiens [sequence omitted]

SEQ ID NO: 7603 - protein, 189 aa, Homo sapiens
MSRCMRCWPLPSRCTPCVLMRAFTSSCGRNMGTRCCACRKVTHKSMKNFSVTPAPSSSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEEA

SEQ ID NO: 7604 - protein, 74 aa, Homo sapiens
MLGGKVHGSLARAGKVRGQTPKVSESISGHGVSTFFPFTAKPSPWALTRFAFSLPGDEPEGRDARCGRQEPGPD

SEQ ID NO: 7605 - protein, 61 aa, Homo sapiens
MQLFVRAQELHTFEVTGQETVAQIKAHVASLEGIARKIKSCSWQARPWRMRPLWASAGWRP

SEQ ID NO: 7606 - protein, 96 aa, Homo sapiens
MADNDTDRNQTEKLLKRVRELEQEVQRLKKEQAKNKEDSNIRENSSGAGKTKRAFDFSAHGRRHVALRIAYMGWGYQGFASQENTNNTIEENCLKL

SEQ ID NO: 7607 - protein, 99 aa, Homo sapiens
MMEVDRRVESEESGDEEGKKHSSGIVADLSEQSLKDGEERGEEDPEGTRPSSLGDICWLGDVGCAARGLALGVGAVSVWRRTAVLLRGPQWPRAGGYAL

SEQ ID NO: 7608 - protein, 96 aa, Homo sapiens
MTSALENYINRTVAVITSDGRMIVGTLKGFDQTINLILDESHERVFSSSQGVEQVVLGLYIVRGDNVAVIGEIDEETDSALDLGNIRAEPLNSVAH

SEQ ID NO: 7609 - protein, 82 aa, Homo sapiens
MFAPAVMRAFRKNKTLGYGVPMLMDPELEKKLKENKISLESEYEKIKDSKFDDWKNIRGPRPWEDPDLLQGRNPESLKTKTT

SEQ ID NO: 7610 - protein, 108 aa, Homo sapiens
MAAPCLLRQGRAGALKTMLQEAQVFRGLASTVSLSAESGKSEKGQPQNSKKQSPPKKPAPVPAEPFDNTTYKNLQHHDYSTYTFLDLNLELSKFRMPQPSSGRESPRH

SEQ ID NO: 7611 - protein, 108 aa, Homo sapiens; identical to SEQ ID NO: 7610

SEQ ID NO: 7612 - protein, 71 aa, Homo sapiens
  UNSURE 14: Xaa = Cys,Gly,Arg,Ser
MISSHCNLHLPDSXDSPLSASQVAGITGIHYHAWLIFVFLVETGFHHVGQAGLQLLTSGDTPPRPPKVLGL

SEQ ID NO: 7613 - protein, 70 aa, Homo sapiens
MSVMMACWKQNEFRDDACRKEIQGFLDCAARAQEARKMRSIQETLGESGSLLPNKLNKLLQRFPNKPYLS

SEQ ID NO: 7614 - protein, 68 aa, Homo sapiens
MAEDADMRNELEEMQRRADQLADESLESTRRMLQLVEESKDAGIRTLVMLDEQGEQLQNTVVRIMGIY

SEQ ID NO: 7615 - protein, 89 aa, Homo sapiens [sequence omitted]

SEQ ID NO: 7616 - protein, 77 aa, Homo sapiens
  UNSURE 56: Xaa = Gly,Arg
MGSQRPSISEKRRKKARSTGNLELRNYVPEDEDLKKRRVPQAKPVALEEKVKEQLXGRQARARHRGGGPGQPRSSEA

SEQ ID NO: 7617 - protein, 83 aa, Homo sapiens
MEAEESEKAATEQEPLEGTEQTLDAEEEQEESEEAACGSKKRVVPGIVYLGHIPPRFRPLHVRNLLSAYGRSDASSFRLRTGS

SEQ ID NO: 7618 - protein, 102 aa, Homo sapiens
  UNSURE 83: Xaa = Glu,Gln
MGFTGFGKKARTFDLEAMFEQTRRTAVERSRKTLEAREKEEEMNREKELRRQNEDIEPTSSRSNVVRDCSKSSSRDTSSSESXQSSDSSDDELIGLLYPLKW

SEQ ID NO: 7619 - protein, 107 aa, Homo sapiens
MRNEARKLNHQEVVEEDKRLKLPANWEAKKARLEWELKEEEKKKECAARGEDYEKVKLLEISAEDAERWERKKKRKNPDLGFSDYAAAQLRQYHRLTKQIKPDMENI

SEQ ID NO: 7620 - protein, 59 aa, Homo sapiens
MIVSLVEDYPNYMIINLDKLDYCASLKNLETISNKQNYKFIQGDICDSHFVNCFLKQRK

SEQ ID NO: 7621 - protein, 59 aa, Homo sapiens
MSPSSDPGTRLLGVWGSSTPQRHKADFNHFFSFKLDSAAVEPAQRMFSHPARQRPSSPP

SEQ ID NO: 7622 - protein, 62 aa, Homo sapiens
MASSTPPSTKNLLPHTPSRNCSIQVLSLPQRSASHSPFGPSFELPDLRLDCLFVLEFSKFLY

SEQ ID NO: 7623 - protein, 110 aa, Homo sapiens
MAASSSSSSAGGVSGSSVTGSGFSVSDLAPPRKALFTYPKGAGEMLEDGSERFLCESVFSYQVASTLKQVKHDQQVARMEKLAGLVEELEADEWRFKPIEQLLGFTPSSG

SEQ ID NO: 7624 - protein, 110 aa, Homo sapiens
MAASSSSSSAGGVSGSSVTGSGFSVSDLAPPRKALFTYPKGAGEMLEDGSERFLCESVFSYQVASTFKQVKHDQQVARMEKLAGLVEELEADEWRFKPIEQLLGFTPSSG

SEQ ID NO: 7625 - protein, 135 aa, Homo sapiens
  UNSURE 82: Xaa =  * ,Glu
  UNSURE 113: Xaa = Ala,Val
  UNSURE 57: Xaa = Arg,Ser
  UNSURE 86: Xaa = Asp,His
  UNSURE 125: Xaa = Leu,Arg
  UNSURE 110: Xaa = Lys,Asn
  UNSURE 118: Xaa = Phe,Leu
  UNSURE 58: Xaa = Pro,Ser
  UNSURE 95: Xaa = Ser,Trp
  UNSURE 120: Xaa = Ser,Tyr
MFEAIFPSTPQARLKRDPREKPGLSSFRSTFRQQSSLGLCIPRLMLPKEASPSQRHXXMSSSMARALVLLQSMASRDARCPXWKPXQKPRTLSKXVQTISRYYRKTSEPXDAXSLTGXMXKMELXRVFPTHPDCP

SEQ ID NO: 7626 - protein, 62 aa, Homo sapiens [sequence omitted]

SEQ ID NO: 7627 - protein, 77 aa, Homo sapiens
MTSLFAQEIRLSKRHEEIVSQRLMLLQQMENKLGDQHTEKASQLQTVETAFKRNLSLLKDIGSRKVTTDQDSPTSTA

SEQ ID NO: 7628 - protein, 71 aa, Homo sapiens
  UNSURE 38: Xaa = Ala,Glu,Gly,Val
  UNSURE 37: Xaa = Phe,Leu
MISSHCNLHLPDSSDSPLSASQVAGITGIHYHAWLIXXFLVETGFHHVGQAGLQLLTSGDTPPRPHKVLGL

SEQ ID NO: 7629 - protein, 60 aa, Homo sapiens
MSSSGIYQAFKQDCNNYSKMVEKFLRQKAISTNCAGSILYYDDESLQCNGCQDSETMARL

SEQ ID NO: 7630 - protein, 61 aa, Homo sapiens
  UNSURE 45: Xaa = Ala,Glu,Gly,Val
MSTLFPSLFPRVTETLWFNLDRPCVEETELQQQTAASGLAPKHRXERQQPGSYWQASLRAL

SEQ ID NO: 7631 - protein, 52 aa, Homo sapiens [sequence omitted]

SEQ ID NO: 7632 - protein, 50 aa, Homo sapiens
MILPCSISPWQKKSKISASRKLQLKTLLLQIAKQELEREAEERRERRGAL

SEQ ID NO: 7633 - protein, 55 aa, Homo sapiens [sequence omitted]

SEQ ID NO: 7634 - protein, 65 aa, Homo sapiens
MIPLTTCFQHSQVGQGVLQKNLGLDLQGVWLVLTEGRAELVRLAMEKADLAGVVQRSQLVYMLIP

SEQ ID NO: 7635 - protein, 60 aa, Homo sapiens
MKRNCERRRFPQAGTNELLGHVVRTRQRHTIKENAGLSWPLKSGLPRLPPSIKMVVGRPS

SEQ ID NO: 7636 - protein, 205 aa, Homo sapiens
  UNSURE 75: Xaa = Gln,Arg
MAEASSANLGSGCEEKRHEGSSSESVPPGTTISRVKLLDTMVDTFLQKLVAAGSYQRFTDCYKCFYQLQPAMTQXIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 7637 - protein, 68 aa, Homo sapiens [sequence omitted]

SEQ ID NO: 7638 - protein, 60 aa, Homo sapiens
MAVDQDWPSVYPVAAPFKPSAVPLPVRMGYPVKKGVPMAKEGNLELFKDSQFSAFDSCSN

SEQ ID NO: 7639 - protein, 75 aa, Homo sapiens
MGEKPVGSLAGIGEVLGKKLEERGFDKAYVVLGQFLVLKKDEDLFREWLKDTCGANAKQSRDCFGCLREWCDAFL

SEQ ID NO: 7640 - protein, 75 aa, Homo sapiens; identical to SEQ ID NO: 7639

SEQ ID NO: 7641 - protein, 119 aa, Homo sapiens
MFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 7642 - protein, 106 aa, Homo sapiens
  UNSURE 24,104: Xaa = Ala,Pro
  UNSURE 55: Xaa = Cys,Arg
MQVAHPALSREAPQPGWPSGGLAXFTVAGKAKLVAGGAHHQGDLTAEKLDPPPSXLGRQVVELGLSGIARGQARQGAPPSGHAVSSRKAGRASRALGTLTQPGXRG

SEQ ID NO: 7643 - protein, 56 aa, Homo sapiens
  UNSURE 54: Xaa = Arg,Thr
MSLRSRASLGGESSDTQDPKASPAHPSPWTCLPGCAPAPGGGGAPHSPGQDSLXGE

SEQ ID NO: 7644 - protein, 67 aa, Homo sapiens
MGKGSSMDRRWDGRDRNCRVRRRNCSPKANKLALWNPRKAQELRDITEGRVKRGREDREMEGRKLLK

SEQ ID NO: 7645 - protein, 61 aa, Homo sapiens [sequence omitted]

SEQ ID NO: 7646 - protein, 74 aa, Homo sapiens
MPHAKQMCPNSCRTRHILNLSVQQLFKTFFKIIQAQGLIKYTQNGYVTPWIPCRFGSNQGELEPEARFRNRALD

SEQ ID NO: 7647 - protein, 144 aa, Homo sapiens
MDQSSEGCMKKISSVNLDKLINDFSQIEKKMVETNGKNNILDIQLEKSNCLLKVMQAKEVSIKEECATLHNIIKGLQQTIEYQQNLKGENEQLKISADLIKEKLKSHEQEYKNNIAKLVSEMKIKEEGYKKGISKLYQDMQRKG

SEQ ID NO: 7648 - protein, 56 aa, Homo sapiens
MLHQLGVGIAETTAVGAPISSLWQGHILPEDHPVVLGQPSMSTCTPVTLIAQSQGI

SEQ ID NO: 7649 - protein, 83 aa, Homo sapiens [sequence omitted]

SEQ ID NO: 7650 - protein, 61 aa, Homo sapiens
  UNSURE 53: Xaa = Asp,Glu
  UNSURE 54: Xaa = Asp,His
MKKKEPVGDDESVPENVLSFDDLTADALANLKVSQIKKVRLLIDEAILKCDAXXKVGSRAV

SEQ ID NO: 7651 - protein, 54 aa, Homo sapiens
MPRVHNIKKSLTPHISCVTNESDNLLDFLPDRLRAKLLPFQKDGIIFALKRNGR

SEQ ID NO: 7652 - protein, 69 aa, Homo sapiens
MPHSYPALSAEQKKELSDIALRIVAPGKGILAADESVGSMAKRLSQIGVENTEENRRLYRQSCSVLMTV

SEQ ID NO: 7653 - protein, 69 aa, Homo sapiens; identical to SEQ ID NO: 7652

SEQ ID NO: 7654 - protein, 65 aa, Homo sapiens
MAKRLSQIGVEKHRGEPAGCTRQVLFSADDRVKKVHWRASFFFHETLLTRKDDNGCSPSSETIQG

SEQ ID NO: 7655 - protein, 69 aa, Homo sapiens
  UNSURE 12: Xaa = Ala,Cys,Asp,Phe,Gly,His,Ile,Leu,Asn,Pro,Arg,Ser,Thr,Val,Tyr
  UNSURE 9: Xaa = Cys,Ser
MPHSYPALXAEXKKELSDIALRIVAPGKGILAADESVGSMAKRLSQIGVENTEENRRLYRQSCSVLMTV

SEQ ID NO: 7656 - protein, 51 aa, Homo sapiens
MTTSQKHRDFVAEPWGRSQWGAWLGLVKSWARSWRKGVLTRPMLSLASFWC

SEQ ID NO: 7657 - protein, 69 aa, Homo sapiens
  UNSURE 12: Xaa =  * ,Cys,Phe,His,Leu,Pro,Gln,Arg,Ser,Trp,Tyr
  UNSURE 3: Xaa = Asp,His
  UNSURE 6: Xaa = Pro,Arg
MPXSYXALSAEXKKELSDIALRIVAPGKGILAADESVGSMAKRLSQIGVENTEENRRLYRQSCSVLMTV

SEQ ID NO: 7658 - protein, 69 aa, Homo sapiens; identical to SEQ ID NO: 7652

SEQ ID NO: 7659 - protein, 69 aa, Homo sapiens; identical to SEQ ID NO: 7652

SEQ ID NO: 7660 - protein, 51 aa, Homo sapiens; identical to SEQ ID NO: 7656

SEQ ID NO: 7661 - protein, 119 aa, Homo sapiens [sequence omitted]

SEQ ID NO: 7662 - protein, 119 aa, Homo sapiens [sequence omitted]

SEQ ID NO: 7663 - protein, 118 aa, Homo sapiens
MQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 7664 - protein, 71 aa, Homo sapiens; identical to SEQ ID NO: 7612
  UNSURE 14: Xaa = Cys,Gly,Arg,Ser

SEQ ID NO: 7665 - protein, 58 aa, Homo sapiens; identical to SEQ ID NO: 7301

SEQ ID NO: 7666 - protein, 54 aa, Homo sapiens
  UNSURE 2,15,48: Xaa =  * ,Lys
  UNSURE 18: Xaa = Cys,Gly
  UNSURE 17,31: Xaa = Pro,Ser
MXFTVKMILCCTIFXYXXFERIVERKWVACXVIAFRSLGECYRRLNLXIKAQSS

SEQ ID NO: 7667 - protein, 73 aa, Homo sapiens
  UNSURE 21: Xaa = Leu,Ser
MCFSRLIQLQRWQLSHCLSPXGHCPAGSWKAWYEDLQEVLSSDENGGTMFHLLEMKRKNQKSSPLLTLLLWLG

SEQ ID NO: 7668 - protein, 53 aa, Homo sapiens
MFELCIFDIVPGRNSTAQTLVFLLTSSNTWFVWRVSKNSAITPVHVFTGDCSC

SEQ ID NO: 7669 - protein, 140 aa, Homo sapiens
  UNSURE 38: Xaa = Asp,Glu
MPLESSSSMPLSFPSLLPSVPHNTNPSPPLMSYITSQXMKCILHWFANWSGPQRERFLEDLVAKAVPEKLQPLLDSLEQLSVSGADRPPSIFECQLHLWDQWFRGWAEQERNEFVRQLEFSEPDFVAKFYQAVAATAGKD

SEQ ID NO: 7670 - protein, 152 aa, Homo sapiens
MTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTRMYQISLPL

SEQ ID NO: 7671 - protein, 117 aa, Homo sapiens
MFRLLSSCCSCLRTTEETRRNVTIPIIGLNNSGKTVLVEAFQKLLPSKTDHCMKSELTTLLLDEYELSIYDLNGDLKGREAWPNYYAQAHGLVFVLDSSDIRRMQGSEDHLNTSAVR

SEQ ID NO: 7672 - protein, 52 aa, Homo sapiens
MMMAMNYALFSKVWYHGLKSHTKNILKINISWACRTHLLICFQLKFSHHHDG

SEQ ID NO: 7673 - protein, 117 aa, Homo sapiens
MQAVRNAGSRFLRSWTWPQTAGVVARTPAGTICTGARQLQDAAAKQKVEQNAAPSHTKFSIYPPIPGEESSLRWAGKKFEEIPIAHIKASHNKGISECQEGHRHRSTDSRHSRSGES

SEQ ID NO: 7674 - protein, 143 aa, Homo sapiens
  UNSURE 54: Xaa = Ala,Asp,Ser,Tyr
MQAVRNAGSRFLRSWTWPQTAGRVVARTPAGTICTGARQLQDAAAKQKVEQNAXPSHTKFSIYPPIPGEESSLRWAGKKFEEIPIAHIKASHNNTQIQVVSASNEPLAFASCGTEGFRNAKKGTGIAAQTAGIAQRRELNKRA

SEQ ID NO: 7675 - protein, 60 aa, Homo sapiens
  UNSURE 31: Xaa = Ile,Thr
MQAVRNAGSRFLRSWTWPQTAGVVARTPAGXICTGARQLQDAAAKQKVEQNAAPSHTKFR

SEQ ID NO: 7676 - protein, 69 aa, Homo sapiens
MCIGPEGDMHDITPGECAVRLVKAGASIVGVNCRFGPDTSLKTMELMKEGLEWAGLKRTSWSASGVPRA

SEQ ID NO: 7677 - protein, 86 aa, Homo sapiens
  UNSURE 32: Xaa = His,Gln,Arg
MQTRGAVIPSPAWGAIWNLDSLETLETPRRIXRQVSREMSLSPSHGPPKDSRIRKLFLLLRHPRKAAPPLGRSDGNWLRAQRKTHN

SEQ ID NO: 7678 - protein, 77 aa, Homo sapiens; identical to SEQ ID NO: 7627

SEQ ID NO: 7679 - protein, 86 aa, Homo sapiens
  UNSURE 68: Xaa = Ala,Pro,Ser
MPAYQELVEEAIAYGRKLGGSQEDQIKNAIDKLFVLFGAEILKKIPGRVSTEVDARLSFDKDAMVARXGGSSSSTRKLGSARTEFL

SEQ ID NO: 7680 - protein, 86 aa, Homo sapiens
MPAYQELVEEAIAYGRKLGGSQEDQIKNAIDKLFVLFGAEILKKIPGRVSTEVDARLSFDKDAMVARAGGSSSSTRKLGSARTEFL

SEQ ID NO: 7681 - protein, 55 aa, Homo sapiens
MGERLHSTLPRPVELQMLAHIREGVKPLRSSAGLSSDHGSTQMHGHVSHRLFACK

SEQ ID NO: 7682 - protein, 53 aa, Homo sapiens
MLLKAPFPQRITAIEGKMLHVPSASWCLSKDNGGRETKCLDVCVNQELSGPCL

SEQ ID NO: 7683 - protein, 71 aa, Homo sapiens; identical to SEQ ID NO: 7596

SEQ ID NO: 7684 - protein, 50 aa, Homo sapiens
MFLTGDTSPAEDNREATLPQCSLPELYACIENFNKESKKSNLLKNAWYFT

SEQ ID NO: 7685 - protein, 102 aa, Homo sapiens
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQTCPSLLKS

SEQ ID NO: 7686 - protein, 96 aa, Homo sapiens
MAEVEETLKRLQSQKGVQGIIVVNTEGIPIKSTMDNPTTTQYASLMHSFILKARSTVRDIDPQNDLTFLRIRSKKNEIMVAPDKDYFLIVIQNPTE

SEQ ID NO: 7687 - protein, 71 aa, Homo sapiens; identical to SEQ ID NO: 7596

SEQ ID NO: 7688 - protein, 55 aa, Homo sapiens
MVQLHQDTDPQIPKVVPSSCTCIRPKNLISPLTVINILMKTGYVDAGRWGKLVSS

SEQ ID NO: 7689 - protein, 55 aa, Homo sapiens
  UNSURE 50: Xaa =  * ,Leu
  UNSURE 3: Xaa = Asn,Thr
  UNSURE 6: Xaa = Asp,Glu
  UNSURE 49: Xaa = Asp,Gly
MDXPEXVQPPKQQPMIYICGECHTENEIKSRDTNQMQRMWIQNNVQEKXXKDWSF

SEQ ID NO: 7690 - protein, 53 aa, Homo sapiens
MKTFGSAKHQKQIQKIKYTPEKPILSTHLTVHKEQLQSNLKNKENGRKMGNMH

SEQ ID NO: 7691 - protein, 87 aa, Homo sapiens [sequence omitted]

SEQ ID NO: 7692 - protein, 64 aa, Homo sapiens
  UNSURE 14: Xaa = Cys,Trp
MLENYSNMVSLGFXIYQPEAFSLLEKGKEPWKILRDETRGPCPDMQSRCQTKKLLPKNGIFERE

SEQ ID NO: 7693 - protein, 73 aa, Homo sapiens
  UNSURE 66: Xaa = Phe,Ser
MCSCPISSPGHIKGLGQEETPVRSADLVFKERMPACNTHGEGHFLAPPAKYLQTLGRRLHSQHRTXLNSFRIR

SEQ ID NO: 7694 - protein, 61 aa, Homo sapiens
MMLFNPYCLGHLLKMSFRRYQHFLSHGLIEFIELCDRNHILHKSHKAIMTTRVEDERCQIF

SEQ ID NO: 7695 - protein, 98 aa, Homo sapiens
MSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 7696 - protein, 96 aa, Homo sapiens
  UNSURE 3: Xaa =  * ,Lys,Leu,Met,Arg,Trp
  UNSURE 76: Xaa = His,Tyr
  UNSURE 92: Xaa = Met,Arg
  UNSURE 68: Xaa = Phe,Ser
  UNSURE 90: Xaa = Pro,Ser
MAXRDDLSFCREMKFRNKMVEYLTDWVMGTSNQAADDDVKCLTRHQVPEKEEIKALKTLSIFYQAGAXKAGNPIFXYAARATSPSWWNPXVXTAKA

SEQ ID NO: 7697 - protein, 131 aa, Homo sapiens
  UNSURE 101: Xaa = Ile,Ser
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRXIISHVDFRENVFSSLLAILRSSNKCGSVFL

SEQ ID NO: 7698 - protein, 87 aa, Homo sapiens
  UNSURE 61: Xaa = Ala,Pro
  UNSURE 66: Xaa = Pro,Ser
MSRKGRRRHGHTQRESAVWRQRLRPTCRGRSQGSPQMGSRAEAGTEAPSGGTFSVLGRSPXCLRLXLGLLFPEPGERPSLLESHSSL

SEQ ID NO: 7699 - protein, 74 aa, Homo sapiens [sequence omitted]

SEQ ID NO: 7700 - protein, 74 aa, Homo sapiens [sequence omitted]

SEQ ID NO: 7701 - protein, 75 aa, Homo sapiens
MASDTVLWAPSLDSWPAFSSGKGLLQVFIGPRASWIPSAEAGQRGRAPEASGVGEHRCFQLAWLPALGPEGVNEA

SEQ ID NO: 7702 - protein, 76 aa, Homo sapiens
  UNSURE 76: Xaa =  * ,Trp
MAALSCLLDSVRRDIKKVDRELRQLRCIDEFSTRCLCDLYMHPYCCCDLHPYPYCLCYSKRSRSCGLCDLYPCCLX

SEQ ID NO: 7703 - protein, 68 aa, Homo sapiens
MAALSCLLDSVRRDIKKVDRELRQLRCIDEFSTRCLCDLYMHPYCCCDLHPYPYCLCYSKRSRSCGPV

SEQ ID NO: 7704 - protein, 56 aa, Homo sapiens; identical to SEQ ID NO: 6178
  UNSURE 26: Xaa = Ser,Thr

SEQ ID NO: 7705 - protein, 59 aa, Homo sapiens [sequence omitted]

SEQ ID NO: 7706 - protein, 76 aa, Homo sapiens
  UNSURE 72: Xaa = Ala,Pro,Ser,Thr
MDNHLEELSLPVPTSDRTTSRTSSSSSSDSSTNLHSPNPSDDGADTPLAQSDEEEERGDGGAELEPAASSGXLTTD

SEQ ID NO: 7707 - protein, 81 aa, Homo sapiens
  UNSURE 45: Xaa = His,Gln
MLAAVGRPKPRSPLSSLSTLQLYLFCSSTRRADMDPNPRAALERXSSAFGSGKNSSRTFYSQRQSLSFLCPICISSRRDPP

SEQ ID NO: 7708 - protein, 51 aa, Homo sapiens
  UNSURE 45: Xaa = Gly,Arg
  UNSURE 44: Xaa = Lys,Arg
MTAIQQEQVDQVKITGKPIKRRPVSFVARYFDETLSEKTAATPXXPLFLLL

SEQ ID NO: 7709 - protein, 91 aa, Homo sapiens [sequence omitted]

SEQ ID NO: 7710 - protein, 91 aa, Homo sapiens [sequence omitted]

SEQ ID NO: 7711 - protein, 91 aa, Homo sapiens
  UNSURE 74: Xaa = Asp,Glu
MILGNKCDMNDKRQVSKERGEKLAIDYGIKFLETSAKSSANVEEAFFTLARDIMTKLNRKMNDSNSAGAGGPVXITENRSKKTSFFRCSLL

SEQ ID NO: 7712 - protein, 91 aa, Homo sapiens [sequence omitted]

SEQ ID NO: 7713 - protein, 96 aa, Homo sapiens
  UNSURE 52: Xaa = Asp,Asn
  UNSURE 75: Xaa = Asp,His,Asn,Tyr
  UNSURE 73: Xaa = Gly,Val
  UNSURE 74: Xaa = Ile,Lys,Met,Asn,Arg,Ser,Thr
MILGNKCDMNDKRQVSKERGEKLAIDYGIKFLETSAKSSANVEEAFFTLARXIMTKLNRKMNDSNSAGAGGPXXXNRKPIKEDQFLSLLATLMNSF

SEQ ID NO: 7714 - protein, 91 aa, Homo sapiens [sequence omitted]

SEQ ID NO: 7715 - protein, 96 aa, Homo sapiens
  UNSURE 86: Xaa =  * ,Ile,Lys,Leu,Arg,Ser,Thr
  UNSURE 30: Xaa = Lys,Asn
MILGNKCDMNDKRQVSKERGEKLAIDYGIXFLETSAKSSANVEEAFFTLARDIMTKLNRKMNDSNSAGAGGPVKITENRSKKTSFXSLLATLMNSF

SEQ ID NO: 7716 - protein, 91 aa, Homo sapiens
  UNSURE 72: Xaa = Ile,Lys,Met,Asn,Arg,Ser,Thr
MILGNKCDMNDKRQVSKERGEKLAIDYGIKFLETSAKSSANVEEAFFTLARDIMTKLNRKMNDSNSAGAGGXVKITENRSKKTSFFRCSLL

SEQ ID NO: 7717 - protein, 91 aa, Homo sapiens; identical to SEQ ID NO: 7716
  UNSURE 72: Xaa = Ile,Lys,Arg,Thr

SEQ ID NO: 7718 - protein, 91 aa, Homo sapiens [sequence omitted]

SEQ ID NO: 7719 - protein, 96 aa, Homo sapiens
  UNSURE 74: Xaa =  * ,Cys,Asp,Glu,Gly,His,Lys,Asn,Gln,Arg,Ser,Trp,Tyr
  UNSURE 75: Xaa = Asp,Asn
  UNSURE 73: Xaa = any one of the twenty amino acids
MILGNKCDMNDKRQVSKERGEKLAIDYGIKFLETSAKSSANVEEAFFTLARDIMTKLNRKMNDSNSAGAGGPXXXNRKPIKEDQFLSLLATLMNSF

SEQ ID NO: 7720 - protein, 82 aa, Homo sapiens
  UNSURE 70: Xaa = Ile,Leu,Ser,Thr
MARTPDLSHFWELLVELQKKRRLTKLVKRDRARWLTPVILALWRPRQADHLRSRVRDQPGQLGETSSLLXVQKLAGRGGMHL

SEQ ID NO: 7721 - protein, 86 aa, Homo sapiens
MASVAVDPQPSVVTRVVNLPLVSSTYDLMSSAYLSTKDQYPYLKSVCEMAENGVKTITSVAMTSALPIIQKLEPQIAVANTYACKG

SEQ ID NO: 7722 - protein, 94 aa, Homo sapiens
  UNSURE 20: Xaa = Asn,Ser
MKTDSLMEEKLECSLWCCLXDPSTPGRCCVLERRIVPWMQQESYSSSSPIWSVDSDEPNLTSVLERLEDTKDNSSVRKETKLFSLFLMNIIFRN

SEQ ID NO: 7723 - protein, 50 aa, Homo sapiens
MEGCGGIVSCKFESSYLPFNSLHSSLPLNKQNNTKTQKTKTVFALGRRTT

SEQ ID NO: 7724 - protein, 70 aa, Homo sapiens [sequence omitted]

SEQ ID NO: 7725 - protein, 55 aa, Homo sapiens
MADKEAAFDDAVEERVINEEYKIWKKNTPFLYDLVMTHALEWPSLTAQWLPDVTR

SEQ ID NO: 7726 - protein, 52 aa, Homo sapiens
MCCTGRYISNIIFKFEFSEVLPKKKHYCFCARDAHQNLKSCSHFSVLVDTFS

SEQ ID NO: 7727 - protein, 78 aa, Homo sapiens
  UNSURE 16: Xaa = Leu,Val
MVATRSLQPQSPYSAXPGGGGKRYRAVYDYSAADEDEVSFQDGDTIVNVQQIDDGWMYGTVERTGDTGMLPANYVEAI

SEQ ID NO: 7728 - protein, 55 aa, Homo sapiens
MVFESVGARAHFWLSQQLGWHLLPSARNSNIMNARDSVLSKVFHPKGAGHGGSRL

SEQ ID NO: 7729 - protein, 67 aa, Homo sapiens [sequence omitted]

SEQ ID NO: 7730 - protein, 73 aa, Homo sapiens
MYQDRPDHKTNNKECQKSFTWKKKKMRARRPKKGEVSIDGTLGCSLRPPLLVFASKKNISTENHIIWFNRLNI

SEQ ID NO: 7731 - protein, 53 aa, Homo sapiens
MAGGGRGGSCNRYWRERRGHKGRGRNRCPQWLQICPWITEDSCSPAEVETAVS

SEQ ID NO: 7732 - protein, 67 aa, Homo sapiens
  UNSURE 26: Xaa = Lys,Arg
MNSLVLFLGHLGLLIKDCVLLFAMSXVSQKQKVLGPFGSPELESLGIGPKYLHFHRFLVGDFLQAKV

SEQ ID NO: 7733 - protein, 101 aa, Homo sapiens [sequence omitted]

SEQ ID NO: 7734 - protein, 55 aa, Homo sapiens; identical to SEQ ID NO: 6473

SEQ ID NO: 7735 - protein, 84 aa, Homo sapiens
MHLFESLLSILWGIYPGVELLDHMVTPYLIFEELPDCFPQWPHHFTFSSTMHKVPVSLHPHQHLLFSYPNGCKLVAYGFLFAFT

SEQ ID NO: 7736 - protein, 70 aa, Homo sapiens
MGIIFLRFHRLRSGLAFRIGLEKGPSAGWAGVFLPMCSVPLHTPPLWSRCIVEILPQGWVQWLTPVIPVL

SEQ ID NO: 7737 - protein, 71 aa, Homo sapiens
  UNSURE 53: Xaa =  * ,Cys
  UNSURE 12: Xaa =  * ,Lys,Arg,Trp
  UNSURE 58: Xaa = Cys,Trp
  UNSURE 40: Xaa = Gly,Arg
MSRGGSYPHLLXDVRKRSLGLEDPSRLRSRYLGRREFIQXLKLEATLNVHDGXVNTIXWNDTGEYISIWLR

SEQ ID NO: 7738 - protein, 75 aa, Homo sapiens
MPTSSELKVLTFLLPHQYLLFSDFLMIVILVGVKWYLIVVLICISLMANDVEPSFHVSPGHLCIFGEVFRSFAHY

SEQ ID NO: 7739 - protein, 61 aa, Homo sapiens
  UNSURE 59: Xaa = Leu,Val
MYGTVERTGDTGMLPANYVRPSEPAAPPSVFSTFHGIASVLGVTRSILQCLCFLKPATXDS

SEQ ID NO: 7740 - protein, 87 aa, Homo sapiens
  UNSURE 60: Xaa = Arg,Thr
MANRGPSYGLSREVQEKIEQKYDADLENKLVGLDHPAVRRGHRAPAPRQAHFQKWLMDGXVLCKLINSLYPPGQEPIPKISESKDGF

SEQ ID NO: 7741 - protein, 56 aa, Homo sapiens
  UNSURE 38: Xaa =  * ,Glu
  UNSURE 53: Xaa = Cys,Phe,Gly,Val
  UNSURE 48: Xaa = Phe,Leu
  UNSURE 49: Xaa = Pro,Thr
MREVRARLAATQVEYISGKVFFTTCSDLNMLKKLKSAXRLFLLIKKQXXLIIXFCK

SEQ ID NO: 7742 - protein, 152 aa, Homo sapiens
  UNSURE 45: Xaa = Ala,Val
MALASVLERPLPVNQRGFFGLGGRADLLDLGPGSLSDGLSLAAPXGVSQKSQESKCFMEQPPWPSRLYYVDSEGNRISVATFSVGSGSVYAYGVMDRGYSYDLEVEQAYDLARRAIYQATYRDAYSGGAVNLYHVREDGWIRVSSDNVAGST

SEQ ID NO: 7743 - protein, 58 aa, Homo sapiens
MLSPTFCCSSLLIPKKVVFTWCFFNLLRMNSRNISTNTLNSCHILIFTEHLHTHYVIR

SEQ ID NO: 7744 - DNA, 108 bp, Homo sapiens
gaggttgagacaagagaatcacttgaacctgagaggcagaggttgcagtgcagcctgggtgacagagggagactccggccccctcccaaaaaaaaaaaaaaaaaagct

SEQ ID NO: 7745 - DNA, 89 bp, Homo sapiens
aataatagctactaaaaagtaacaaggttgagaccagcctgggcaacataaggagaccccttcttcacaaaaaaaaaaaaaaaaaagct

SEQ ID NO: 7746 - DNA, 108 bp, Homo sapiens
gaggttgagacaagagaatcacttgaacctgagaggcagaggttgcagtgcakcctgggtgacagagggagactccggccccctyccaaaaaaaaaaaawmaaaagct

SEQ ID NO: 7747 - DNA, 108 bp, Homo sapiens; identical to SEQ ID NO: 7744

SEQ ID NO: 7748 - DNA, 154 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaaaagct

SEQ ID NO: 7749 - DNA, 108 bp, Homo sapiens; identical to SEQ ID NO: 7744

SEQ ID NO: 7750 - DNA, 96 bp, Homo sapiens
agagaccaatggctgcggccgcagctgcggcgctggaatcctggcaggcggcggctccgcggaagaggcgctccgcggctcgacggccgcrgcggm

SEQ ID NO: 7751 - DNA, 153 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaaagct

SEQ ID NO: 7752 - DNA, 108 bp, Homo sapiens; identical to SEQ ID NO: 7744

SEQ ID NO: 7753 - DNA, 101 bp, Homo sapiens
acagttaactttaggaccatagccaaaagatagaaacagcataaacgccaaaataaaaagaagccaataaagataaacacaaaaaaaaaaaaaaaaaagct

SEQ ID NO: 7754 - DNA, 108 bp, Homo sapiens; identical to SEQ ID NO: 7744

SEQ ID NO: 7755 - DNA, 113 bp, Homo sapiens
aagtaggagcggcggcwgcggcggcggcggcggtcgaaagcggwgtgaaagagggaggcagggagccggagagccggaaccgbamtcgcagcsgcggagacccctgtgcggtd

SEQ ID NO: 7756 - DNA, 108 bp, Homo sapiens; identical to SEQ ID NO: 7744

SEQ ID NO: 7757 - DNA, 108 bp, Homo sapiens
gaggttgagacaagagaatcacttgaacctgasaggcasaggttgcagtgcagcctgggtgacagagggagactccggccccctcccaaaaaaaaaaaaaaaaaagct

SEQ ID NO: 7758 - DNA, 108 bp, Homo sapiens; identical to SEQ ID NO: 7744

SEQ ID NO: 7759 - DNA, 406 bp, Homo sapiens
cctgtaatcccagctacccaggaggctgaggcaggagaatcgctggaacccgggaggtagaggctgcagtgagccgagatcgcgccactgcactccagcctgggcgacagagcgagagtttgtctgaaaaaaaaaaaaaaaaaaaaaagccagggtgagcggtggctcaagcctgtaatcgcaagcaacactttgggaggcggcagctgggcagatcaccggaggtcgggagttggagaccagcctgaccaacgtggagaaaccccatctgtactaaaaatacaaagttagacgggcgtggtggcacatgcctgtagtcccagctgctcgggaggctgaggcaggggaatcgcttgaacccgggaggcggaggttgcagagagcctaratcgcgccattggactcc

SEQ ID NO: 7760 - DNA, 108 bp, Homo sapiens; identical to SEQ ID NO: 7744

SEQ ID NO: 7761 - DNA, 88 bp, Homo sapiens
cattggtagcttgatggggatggcattgaatctgwaaattaccttgggcagtatggccattttcacgatatygattcttcctacccgy

SEQ ID NO: 7762 - DNA, 169 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacawaaaaraaaaaaaaaagct

SEQ ID NO: 7763 - DNA, 108 bp, Homo sapiens; identical to SEQ ID NO: 7744

SEQ ID NO: 7764 - DNA, 108 bp, Homo sapiens; identical to SEQ ID NO: 7744

SEQ ID NO: 7765 - DNA, 108 bp, Homo sapiens
gaggttgagacaagagaatcacttgaacctgakaggcagaggttgcagtgcagcctgggtgacagagggagactccggccccctcccaaaaaaaaaaaaaaaaaagct

SEQ ID NO: 7766 - DNA, 169 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaaaaaaaaaaaaaaaagct

SEQ ID NO: 7767 - DNA, 108 bp, Homo sapiens; identical to SEQ ID NO: 7744

SEQ ID NO: 7768 - DNA, 134 bp, Homo sapiens
actgtcggcgcttcccccacccccccaggaccchmccctgsctsccagmcstgcaaatytvgcgaggaaacacgcggwttmactaghgtgtytacaccgatcactactaatycgkrccgaaccgatccggattw

SEQ ID NO: 7769 - DNA, 108 bp, Homo sapiens; identical to SEQ ID NO: 7744

SEQ ID NO: 7770 - DNA, 108 bp, Homo sapiens
gaggttgagacaagagaatcacttgaacctgagaggcagaggttgcagtgcagcctgggtgacagagggagactccggccccctyccaaaaaaaaaaaaaaaaaagct

SEQ ID NO: 7771 - DNA, 108 bp, Homo sapiens; identical to SEQ ID NO: 7744

SEQ ID NO: 7772 - DNA, 266 bp, Homo sapiens
atgtcgtctcccagtgggaagggagcccgggcgctggaggctcctggctgcgggccccggccgctcgcccgggacctggtggactccgtggacgatgcggaggggctgtacgtggctgtggagcgctgcccgctgtgcaacactacccgccggcggctgacctgcgccaaatgcgttcagagcggcgatttcgtctacttcgacggccgcgaccgggagaggtttatcgacaagaaggaaaggctaagccgacttaagagcaagcm

SEQ ID NO: 7773 - DNA, 108 bp, Homo sapiens; identical to SEQ ID NO: 7744

SEQ ID NO: 7774 - DNA, 63 bp, Homo sapiens
cttttgcgttctctttccctctcccaacatggcggcctcagcaaaaaaaaaaaaaaaaaagct

SEQ ID NO: 7775 - DNA, 299 bp, Homo sapiens
tttttttttttttttttytctttctgagacggagtctcgctttgkcgccaaggctggagtgcagtggtgagatctcagmtcactgcaacctctgcctycctgcctcatgtcctgccccatccctatcctgcctgatccctggatctccctcaratcccctyttctmagacagcgccaggccggggtggggccggggttggggccragccccacagytgcccccytcccctccctttttcgkataatttaataaagaaatggtcgcgcttctgtttttgaaaaaaaaaaaaaaaaaagct

SEQ ID NO: 7776 - DNA, 108 bp, Homo sapiens; identical to SEQ ID NO: 7744

SEQ ID NO: 7777 - DNA, 80 bp, Homo sapiens
tttttcgcaacgggtttgccgccagaacacaggtgtcgtgaaaactacccctaaaagccaaaaaaaaaaaaaaaaaagct

SEQ ID NO: 7778 - DNA, 101 bp, Homo sapiens; identical to SEQ ID NO: 7753

SEQ ID NO: 7779 - DNA, 63 bp, Homo sapiens; identical to SEQ ID NO: 7774

SEQ ID NO: 7780 - DNA, 80 bp, Homo sapiens
ctttttcgcaacgggtttgccgccagaacacaggtgtcgtgaaaactacccctaaaagccaaaaaaaaaaaaaaaaagct

SEQ ID NO: 7781 - DNA, 108 bp, Homo sapiens; identical to SEQ ID NO: 7744

SEQ ID NO: 7782 - DNA, 154 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaawwrraaaaaaaaaaaaaaaaaaaaaaaagct

SEQ ID NO: 7783 - DNA, 169 bp, Homo sapiens
ctggacaaatgacttgaatagacagttctccaaagaagatatgcaaatggctcaacattattaatcattagggaacattgttaataattagyggtatctscacagtgagatatcacttsttacccattaggatggctataataaaaaacamaaaamaawaaaaaargct

SEQ ID NO: 7784 - DNA, 108 bp, Homo sapiens; identical to SEQ ID NO: 7744

SEQ ID NO: 7785 - DNA, 108 bp, Homo sapiens; identical to SEQ ID NO: 7744

SEQ ID NO: 7786 - DNA, 366 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaawwawaaaragct

SEQ ID NO: 7787 - DNA, 101 bp, Homo sapiens; identical to SEQ ID NO: 7753

SEQ ID NO: 7788 - DNA, 444 bp, Homo sapiens
acctggggcgcccgcgcgggaagcgccagtgcgggggagagccccggatactcgacccccaagccagtttggggagaaagacggcggcggggaggggaaagttgagcacacagctgcgattcccgtgagttgcggcgactttgcataggtgacatcgcgccgcggtcctgccttgggcacggtgggacccgcttgctgagcgcgctctagagcgcgcggyacatcgtcgaaatttctaactctgcagggaaagcgctatgtacttcggctttacaaatggggaaactgaggctcagaaacgcgccctaccaaagccaccgaccagtaagtggcaacgccaaataataaataggactttaagcccagggctttctgctgcagagagcgtaccctcaccccttcgattctgccaggcatcaggaccaggagggtcccgcagccgcg

SEQ ID NO: 7789 - DNA, 108 bp, Homo sapiens; identical to SEQ ID NO: 7744

SEQ ID NO: 7790 - DNA, 108 bp, Homo sapiens
gaggttgagacaagagaatcacttgaacctgagaggcagaggytgcmstgcagcctgvgtgacagagggagactccggccccctcccaaamaammwaaaarraaagct

SEQ ID NO: 7791 - DNA, 108 bp, Homo sapiens
gaggttgagacaagagaatcacttgaacctgagaggcagaggttgcagtgcagcctgggtgacagagggagactccggccccctcccaaaaaaaaaaaamaaaaagct

SEQ ID NO: 7792 - DNA, 339 bp, Homo sapiens
catataaaattagatttgtattcagaaaacaaccagaaatatgaaataactaggaataattttaataagaaatgttaaaaattatcaatgtttgggaaataaaacatacatacaggtagagttatgccatgttgaaggagagaaataaccaaatctagggctgagcacagtggctcatgcctgtaatcctagcactttgagaggccgagatgggaggaccgcttgaggccaggagttcagcctggtcaacacagcaagcccttagcgcaaaaaaaaaaamrrhaagaaaagaamagaaaggaaaaaaaagatgtgagataagtaaccaaatattacagk

SEQ ID NO: 7793 - DNA, 79 bp, Homo sapiens
gaggaagaagcggaggaggcrgmtcccgcgctcgcagggccgtgccacctgcccgcccggccgctcgctcgctcgcccg

SEQ ID NO: 7794 - DNA, 63 bp, Homo sapiens
cttttgcgttctctttccctctcccaacatggcggcctcagcaaaaaaraaaaaaaaaaagct

SEQ ID NO: 7795 - DNA, 169 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaaaaawaaaaaaaaaagct

SEQ ID NO: 7796 - DNA, 108 bp, Homo sapiens
gaggttgagacaagagaatcacttgaacctgagaggcagaggttgcagtgcagcctgggtgacmsagggagactccggccccctcccaaaaaaaaaaaaawaaaagct

SEQ ID NO: 7797 - DNA, 80 bp, Homo sapiens; identical to SEQ ID NO: 7780

SEQ ID NO: 7798 - DNA, 108 bp, Homo sapiens; identical to SEQ ID NO: 7744

SEQ ID NO: 7799 - DNA, 89 bp, Homo sapiens
ccataaaaggctaaatgtassagttcacttataaagtgaacaggtagatctaatcagtctagtaagtccaaaaaaaaaaaaaaaaagct

SEQ ID NO: 7800 - DNA, 63 bp, Homo sapiens; identical to SEQ ID NO: 7774

SEQ ID NO: 7801 - DNA, 150 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaagct

SEQ ID NO: 7802 - DNA, 500 bp, Homo sapiens
  misc_feature 417: n=a, g, c or t
tgattatgtgtcttggggttgctcttcttgmsgggtatcttasyggtgttccctgtactttctgaatttgaacttgggcctgtcttgctaggttgssgaagyycttctggatgatatcctaaagtgtgttttccaatttggtccattctccctgtcactttcaggtatgccmstcattcatgggtwwggtcttttcacatagtcgcatatkytcttgcaggctttgttcactccttttcattgttcttgttctctaatcttgyctttatgccttatttcagcmhggtgatcttcastctctgatatcctttcttctgcttsatcgatttgtctattgatactygtgtatgctycaagaagytctcatgctgtgtttttcagctccatcaggtcattkatgtycctctctaaactggnyattktagttagccattcctgtmacctttkatcaaggttcttarcttccttgcattgggttagaacatgctcctttagctcas

SEQ ID NO: 7803 - DNA, 108 bp, Homo sapiens; identical to SEQ ID NO: 7744

SEQ ID NO: 7804 - DNA, 108 bp, Homo sapiens; identical to SEQ ID NO: 7744

SEQ ID NO: 7805 - DNA, 108 bp, Homo sapiens; identical to SEQ ID NO: 7744

SEQ ID NO: 7806 - DNA, 297 bp, Homo sapiens
ttgtagttgttgctgtttttgagacagagtctcactctgtcgcctaggctggagtgcagtggtgcaatctcagctcactgcaaactctgcctcccaggttcaaactattctcctgcctcagcctcccaagtaggtgggactacaggcgcccaccaccacacccgcctaatttttgtattttattagagacagggtttcaccatattggccaggctggtcggaactcccgaccttgtgatccacccacctcggsctyccacagtggtgggattacaggcgtgagccaccacacccags

SEQ ID NO: 7807 - DNA, 357 bp, Homo sapiens
aagagaaaacatagaagaatatctttataacctttggagtaagcaaatatttcttagagaacagacaaaaatttcataaaagaaaaaaaattaatgactcagacataaaccacagtgtgggggaaaatatttgtaaaatattttctgtccacagagtgaaaatgatatctcatgcagtttggatgtgtatctgcctgactcctggagatggtgcatatcttttatgttgacttaaatttttttttctgkgaattgccaattcatgccctttgactatttttctattggtttgkccttttttaaaaatcgatgtttargtgcttatgtttaagtaatatgaaacctatgcttacatgk

SEQ ID NO: 7808 - DNA, 80 bp, Homo sapiens; identical to SEQ ID NO: 7780

SEQ ID NO: 7809 - DNA, 385 bp, Homo sapiens
gacggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgttttttgaccagaaaaaccgacaaccttccccagaaagtccaagctcgtggtgggt

SEQ ID NO: 7810 - DNA, 53 bp, Homo sapiens
agagagcgctctgggtagaggccgggcccggrmagcaggtggccccaggtagc

SEQ ID NO: 7811 - DNA, 381 bp, Homo sapiens
cgagtcgtttaagctgccgttccagcttgcccagcacacaaaaagtcacaggacatttcaggctcagtgtagttttccagaatgccatgagctttttgaagatcttcctctgctgtatgaacatgaagctcaacactatttaagtaaaacaccagagtcatctgcacaaccaagtgaaacaattctttgggatgttcagacagactcaaatcctaatcaggaaaaagactcatctagtaatgagaaacaaactattagtctgccagtttctactagcaaatcaaggaaagagtctacagaaccaaagacatgtatagaaagtatggaaaagaaaacagacagtttagttcagaatggaaacgaacgttctgatgacactgk

SEQ ID NO: 7812 - DNA, 177 bp, Homo sapiens
caaaaaattagccgggcgcggtggcgggtgcctgtagtcccagctactcgggaggctgaggcaggagaatggcgtgaacctgggaggcggagcttgcagtgagccaagattgtgccactgcaatccggcctgggctaaagagcgggactccgtcccaaaaaaaaaaaaaaaaaagct

SEQ ID NO: 7813 - DNA, 162 bp, Homo sapiens
  misc_feature 111,162: n=a, g, c or t
gttggacatgggttgtaaaaataaaaccaggaacacacaaacagacacacacacaaacacacccccacctcctgcaattaaacagtagcatcgccaaaaaaaaaaaaaawnvwmhwmmaaaaaaaaaaaaaaaaaaaaaaaaaaaaaaaaaaaaaaaaaaan

SEQ ID NO: 7814 - DNA, 409 bp, Homo sapiens
caagaaactggtacagtgttatcagaatggacttccattaagggatttagcacagatatttaaaattctgaatctgtgttcaggaaaaataaaaaaccagcctcgttttatagaatctgcatatgatatcataaaactgtgtggcttgccatttttgaaaaagaaagtgtcggatgaaataacttatgctgaagatactgctaattcaattgcacttctgggtgacttaatgaaaataccaagttctgaattgaggatacaaatttgtaagtgtattgktgatttttatcatgcagaaccaccaaagaagcatattccaggttaccagcaagcgagttcatcatacaagattcaaatggctgaagttggaggattagcaaaaacaatggtccagtcaatgaccttgctt

SEQ ID NO: 7815 - DNA, 230 bp, Homo sapiens
agacctaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcggg

SEQ ID NO: 7816 - DNA, 61 bp, Homo sapiens
ataaccggccgccgccgccaccgcggaccgagcgcggagttctggagtctcggacccgaag

SEQ ID NO: 7817 - DNA, 157 bp, Homo sapiens
agtgcgggctgagaaggcggtggctgcagcagcagcggcggcggaaaccctaaagtccgagtccggactacgagtgcgtggcctcctaatccggatcctagtcctgagcgtgtctgtgtgcsagtggacsgkcccggacgcgatgaccctgaacggs

SEQ ID NO: 7818 - DNA, 158 bp, Homo sapiens
ctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggca

SEQ ID NO: 7819 - DNA, 205 bp, Homo sapiens
ttgaattgagtcattaattttgatgctgaagttgttccatatgatatcaggaataattgaggagtagaagatggcttggtgacagtgtgttgagtgaatgtgagaatctggccgggcattggacagattttctgaataaattgaggatgtgaagaggatggcatttctaaataatgtgaacttcaaaaaaaaaaaaaaaaaagct

SEQ ID NO: 7820 - DNA, 366 bp, Homo sapiens
atcaatcattggctctcatttgtatccacaccttccccctggtgatcccatctggtcccatgactttaaaatcattctaccagagggagtggagccaagatggctgaaaaggaacagctccagtctacagctcccagtgtgagcgacacagaagatggatgatttctgcatttccaactgaggtactgggttcatctcactggggagtgctgtatagcgggtgcagcacaccatacatgagccaaagcagggcgaggcatcgcctyacccgggaagcacaagaggtcagggaattcccattcctagtcaaagaaaggggtgacagatggcacctggaaaatcgggttactyccaccctaatactgk

SEQ ID NO: 7821 - DNA, 361 bp, Homo sapiens
attcactatccaagctgcaccatcttcggggtcattgtgtgccaggcatatcaactcttttcaataaaaatggtaagtaatagattttataactctccttggtctcctggcaaatgtgctactcttctctgcatagaacagtcagagttgagggtgcttcacagtcaggtcctctgagcctttgggattttgcttggccactttttccttgctgatgaagctgctgagtcttgttcatgccagttgagagacatggcttcaagagttccctttttttgattctagccttcagaataggagaagagcactgkcttgcagaaagaaaatatgcattctttgkctttgcctcataggatagctt

SEQ ID NO: 7822 - DNA, 317 bp, Homo sapiens
attattgttctttttttgcgatgggtctctgttacctaagctggtctgagctcctgagctcaagcgatcctcctgcctcggccacccaaagtgttgggattacaggagtgagccaccacgtctggcctctcgtcgtttttattttttaatttttgagtgggggctcgctccgtcgcccaggctgtgatgcagccgcgcgatcacgacctactgsrtcctggacctcctgggctcaagcgaatctccggcttcagcctcccaagtagctggaactacactyccgcgccaccacgtcccgctaaattaaaaaaaaaaty

SEQ ID NO: 7823 - DNA, 343 bp, Homo sapiens
aaaaaaaatgtggcacacatacaccatggaatactatggagacataaaaaaggatgagttcatgtcctttgcagggacatggatgaagctggaaacaatcagtctcaggaaactaacacaggaacagaaaaccaaacaccgcatgttctcactcataagtaggagttgaacaatgagaacacatggacacagggaagggaacatcacacaccagggcctgtcagggggtgggggcgaggggaggcatagcattaggagaatacctaatgtagatgacgggttgatgggtgcaagcaaaccaccatggcacctgtatacctatgtaacaaacctgcaagttcag

SEQ ID NO: 7824 - DNA, 343 bp, Homo sapiens
actcgtctggcaccagcccgggccgcgcccgggacctcatttcggacctcggtttccctttgcgtggggctcgcagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggaggatgcttctggctggcacacctggcttcccctccatgctcagaactgsttcctactctacatccaggctcctgagcagcccccagcttaagcttcagcagcty

SEQ ID NO: 7825 - DNA, 208 bp, Homo sapiens
ttcgcgagaagccggtccgcgatcttgtggccgcccctcccctccccctgcctctcggactcgggctgcggcgtcagccttcttcgggcctcggcagcggtagcggytcgctcgcctcagccccagcgcccctcggctaccctcggcccaggcccgcagcgccgcccgccctcggmmgccccgacrccggcctgggccgcggccgcar

SEQ ID NO: 7826 - DNA, 293 bp, Homo sapiens
taaaataaaggcacctcttgcagtggcatcttcgatttgaagaagtataatattctacgaatatacaaatttctgttgtttttttgtmyscccgcaasscctgcccttttaaagacatatagtaatatagtggggttataggtttatatactgctacttadctgtgcagagaaattacagcatttaaaarratcaccaatctgtcttmstcataagtcatsatctagaaatggggagaagcwdmgagtggkaattttggccagktaataaggkcttatrttcttttggcttaw

SEQ ID NO: 7827 - DNA, 242 bp, Homo sapiens
aaaaatatccggcgagccatggtgtctcacgcctgtaatcccagcagtttgggaggccaaggcgggtggatcacttgaggtcaggagttcaagaccagcctcaccaatatggtgaaacctcatctgtactaaaaatacaaaaattagccaggtgtggtggtgggcccctgtaatctcagctacttgggaggctgagccagaagaattacttgagcctgggggttggaggttgcagtgagccg

SEQ ID NO: 7828 - DNA, 584 bp, Homo sapiens
ataaaggaagagggcaacgttatcatctgactgcttgtagctgtggaagggcggcgtagaagaggaaaggctgggggtttcggatggttgtttttgaagccatcagtattcttgaagaagcagcatatcttgaactgtcctatgggtgaaggctttgatgtggtcctgtaaaaactggcattgaaatggatggcatctgatcctgcttcatgtgattcttcatttagctctggactctttacatcattaaggctttttctttgcaggaatttaaaagcaaccctatgaatataacatttgtcaaaaagagcaagtgccaagccagttgagaataaccttacaatgtgtacaaggattccagcttatgcaacatgaaaatggcaaggatgaagacctttatgatgatccatttccatttaatgaatagaagaagtgtkatcaattctgttgatggaccccttaatctcttctactgattatcttctacttgaaccagtgccaaattaatgttgcaagctttgtcttgaaatattttcttctgagcatcagccagagatcactgattggttcacaggaataagcag

SEQ ID NO: 7829 - DNA, 81 bp, Homo sapiens
attagaagtaagtaggttagaggggaggtggagggagtgtgctggggtgtgagcttttatgatgctgaaaggatcatgata

SEQ ID NO: 7830 - DNA, 310 bp, Homo sapiens
tgagatggagtcttgcactgtcacccaggctggagtgcagtggcgcgatcttggctcactgcaacccccgccgcctaggttcaagtgattctcatgcctcagcctcccaagtagctgggactacaggtgtgcaccactactcctggatatttttttgtggttttagtagagatggggtttcgccatgttggccaagctggtcttgaactcctgacctcaggtgatccacccgcctcgggctcccaaactgctgggattacagacgtgaggcaccacaaccagcctggatgattcttaagggcccttctag

SEQ ID NO: 7831 - DNA, 548 bp, Homo sapiens
tcttttttggagagaaggtcttgttatattgcccaggctagactcaaactcctaggctaatgtgcctctcctgcctcatcctcccaagaagctatgagatgagtggtagataatcaacctaggactgatgtttcaggtgatatagcacagattcaggcaaaactctcttgccattggtgataacactgtcttgaggaaccagaagtatctccttttcttgggatcatgggagtttgtgggttcttgtttttacataaaaaaccaaagtgtgtttcaaataatgcagatcttctcctcttagtaatcttctcagtatttcctttgaaaagggacagttcgtttccagatacataatttttatttatacatgcagcatagcacatttactatgcagttaagagcatgaacttgagagccagactgcctgtttgaatccccattcccttaacttctctgtgcatcagtttcttcmtctataaaatgggggytaatgataacacatacctcaaaggtggtaataasgatccagttaatattcatagatcttt

SEQ ID NO: 7832 - DNA, 328 bp, Homo sapiens
agtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgta

SEQ ID NO: 7833 - DNA, 505 bp, Homo sapiens
taatattatttaaaatgcaaacggggcagtttttgttgctgctgttgttcttgtttatttttgtgccctttatgtatttgttatgtttttctttggcagattttaagatcaccttttctttattgattttgaaaatcaaattatgatggcctgtggtgtcctttgtgtgtgtgtgtttcttacttagagtttattaaacttctcagttctatgtgtttatatttttcctttactgtgaacaattttcagccattttcttttcaaatatgtctagctttccccctcactctttctcttcttttagtactccagctgaaattaggatagaccactgctatccaattagtagtgccccacagatcactgatctcgttatttttatttcttcctttttcatccttttccctgctctgtgtttgtgtagtttccaatgtatgctggccattttctttgtgatgtctaatcgatagcattttctttatttcagaattgkatcttttagctt

SEQ ID NO: 7834 - DNA, 187 bp, Homo sapiens
attgctggggctccgcttcggggmggaggacgctgaggaggcgccgagccgcgcagcgctgcgggggaggcgcccgcgccgacgcggggcccatgkycagkwccaccagccagctgtatgacgccgtgcccatccagkccagcgyggtgtyatgttcctgcccatccccatcaatggtgaggacccw

SEQ ID NO: 7835 - DNA, 81 bp, Homo sapiens
ctttttcgcamcgggtttgccgccagaacacaggtgtcgtgaaaactacccctaaaagccaaaaaaaaaaaaaaaaaagct

SEQ ID NO: 7836 - DNA, 307 bp, Homo sapiens
aaaacaaaaaaaggggggaamagggggggaaagaaagaaagagaaaaaggagggcgagtggcgagcaggggcctcggccgccacccacacgccccgaagcgtgctcgtcccccgcgcggggctcccggccgccgccctcggccatccgctgctccccggtggcccaggcctcggactccgcggccggcccggcgcggcccagcgccctyagggatcatggcccaggtagcagtgtccaccctgcctgttgaagaagagtcctcctcagagaccaggatggtggtgacattcctcgtgtctgccctcs

SEQ ID NO: 7837 - DNA, 547 bp, Homo sapiens
aaaaggaagagggcaacgttatcatctgactgcttgtagctgtggaagggcggcgtagaagaggaaaggctgggggtttcggatggttgtttttgaagccatcagtattcttgaagaagcagcatatcttaactgtcctatgggtgaaggctttgatgtggtcctgtaaaaactgggaagatttggaggatcatctgaatacccatccaacagagatccatgattcatgtatttctcaagacagccatacactaaaattataagatcataagaatattaattatattctaccaatgcaatacaagcattgaaatggatggcatctgatcctgcttcatgtgattcttcatttagctctggactctttacatcattaaggtaccctgaatatattcagtatggctttttctttgcaggaatttaaaagcaaccctatgaatataacatttgtcaaaaagagcaagtgccaagccagttgagaataaccttacaatgtgtacaaggattccagttctgctgctatataaaccagcctcaaadtagtctg

SEQ ID NO: 7838 - DNA, 263 bp, Homo sapiens
cttttgccctgaagggggctggatgggcaaggcggccgsgatggctcgagctcgggcggtggcggcggtggccggaggcggyggtgcctmctcctcctcgscccggcgccggcggtgatcckagcgagcggscgcggycccckwtgagactgctggcggrctggctgtgcctgascctggcgtmcgwgtggctggcrckgaggatgtggacgctgckgagccckytcacccgctccctgtdcgtgaacatgactagcggcccr

SEQ ID NO: 7839 - DNA, 465 bp, Homo sapiens
caatgtaaagttgatctaaaaaatctcgttttccgccgtgcgcggtggctcacgcctctaatcccatcactttgggaggccgagacgggcggatcacgaggtcaggaggtcgagaccatcctggctaacactgtgaaaccctgtctctactaaaaaaaatacaaacaaaattagccgggcgtggtggcactcacctgtagtttcagctactctggaagctgaggctggagagtcacttgaacccgggaggcggaggttgcagtgatcagagatcgcgccactgcactccatcctgggcgaaagagctagatttcatctcataaaaaaraaamrraamwwaaraaaaaaattacagttttggctggctgggcgcagtggctctcgcctgkaatcccagcattttgggaggcgaggctggtggatcacttgaggtcaggagttcaaaaacagcctgacccacatggt

SEQ ID NO: 7840 - DNA, 409 bp, Homo sapiens
aaaaattagccgtggcccagcaaggtggctcatgcctgtaatcccagcactttggggggccagggtgggcggatcacttgagatcagaagttagggacaagcctggccatcatggtgaaaccccgtctctgctaaaaaatacaaaaattggccgggtgtggtggggtacaccggtaatcccagctacttgggtgactgaggcatgagaattgcttgggcctgggaggcggaggctgcagtgagctgagactgcactccagtctgggcaacagagcgagactttgtctcaaaaataaataaataaataaaaataaaaattagccagacatggtggtgcatatcggtagttccagctactcagctactcaggttcaaggctgcagtgagccatgattgcaacactgcactt

SEQ ID NO: 7841 - DNA, 307 bp, Homo sapiens
taccttgccgggcgcggtggctcacacctgtaatcccagcactttgtgaggctgaggcgggcagatcacgaggtcaggagatcgagactatcctggccaacacggtgaagccccctctctactaaaaatataaaaaattagccgtgcatggttgcgggcgcctgtggtcccagctactcaggaggctgaggcgggagaatgatgtgaacccgggaggcggaccttgccgtgagccaggatcacgtcactgcactccagcctgggtgacagagcaagactctgtctcaaaaaaaaaaaamwaaaagct

SEQ ID NO: 7842 - DNA, 515 bp, Homo sapiens
cacttaaaaaaagattctgcctaaacctctctttatctcactagaagagctaaccctaaccactaccaccgccagttagtatcagggctgctgtaaattgttccaagggtacatttagtggtattgattgctgctaatagtaaaagaataaaagcaattatgaatgtacacaacaacttgttgctctaccccagtttcaccaggagataggatttagtcaagaggggatgtcacagaatctttatcctgattaggagctttttgaggggagggaccttgccttttttcattttgtatctccaggtatacagggtgaaaggcaccatagtagatgccaagcgaatgaatgaatgaacgagatggataggcccaaagacaactaaatcaaaaaacctgtgttgkttcagaggagaatgatccagtatcatttcccctttgggtaggagtagtgggtatgaatattgctatgactgcagaaatcccagacttgkctagaatctctagttatagcttty

SEQ ID NO: 7843 - DNA, 365 bp, Homo sapiens
agggacctttagagagttagcaataaggctggagaaggaaaagccggcgcgcccgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggycagcagagaggagcgctgaaacatggctgaagcggccacgggctttctggagcagctcaagtcctgcatagtttggtcttggacgtwtctgtggaccgtgtggtttcttcatcgtgctattcctggtctacatcctgcgggtgccttttaaaatcaacgacwwcttgagch

SEQ ID NO: 7844 - DNA, 308 bp, Homo sapiens
acttcccgcggaggcgctccccggcgccgcgctccgcggcagccgcctgcccccggcgctgcccccgcccgccgcgccgccgccgccgcgcacgccgcgccccgcagctctgggcttcctcttcgcccgggtggcgttgggcccgcgcgggcgctcgggtgactgcagctgctcagctcccctcccccgccccgcgccgcgcggccgmccgtcgcttcgyagagggctggatggttgtattgggcwkggttggctccaggatgttaggaactgygaagatggaagggcattgaaaccagcgactggaa

SEQ ID NO: 7845 - DNA, 562 bp, Homo sapiens
aaaaggaagagggcaacgttatcatctgactgcttgtagctgtggaagggcggcgtagaagaggaaaggctgggggtttcggatggttgtttttgaagccatcagtattcttgaagaagcagcatatcttaactgtcctatgggtgaaggctttgatgtggtcctgtaaaaactgggaagatttggaggatcatctgaatacccatccaacagagatccatgattcatgtatttctcaagacagccatacactaaaattataagatcataagaatattaattatattctaccaatgcaatacaagcattgaaatggatggcatctgatcctgcttcatgtgattcttcatttagctctggactctttacatcattaaggtaccctgaatatattcagtatggctttttctttgcaggaatttaaaagcaaccctatgaatataacatttgtcaaaaagagcaagtgccaagccagttgagaataaccttacaatgtgtacaaggattccagcttatgcaacatgaaaatggcaaggatgaagacctttatgatgatccattt

SEQ ID NO: 7846 - DNA, 488 bp, Homo sapiens
catgagactgggtgagatcaccagtgagtagagacactgcacagaataggtataaggactaagcccagtggctctctaatgttaagaggtcagcgagaagaaacaaaggagactgaggagcagccagagaggttaaaggaaaaagtgtctcctcaaattccaattagaaattatcatcttcatcagtattttactaaaaaatgttctcctatttcactctgacaatgaaaaaaggtagtgaccaccaaaattatggatctacgattgtccatttttcattgaagcaatttttttttttttttgagatggagtttcactattgttgcccaggctggagtgcaatggtgagatctcggctcactgcagcctctgcttcccgggttcaggcggttctcctgcctcggcctcccaggtggctgagattacaggcacccaccaccatccctggctaactttttgtatttttggtabagacsgggtttgccats

SEQ ID NO: 7847 - DNA, 467 bp, Homo sapiens
aaaggataatgaaaacggctcggggcaaacaggcaacagtgaagagaaaaatttcctgcaaaagaccaagaccaggagcccttgtccttaaataagaggctagtgagggaagtctttcctgccaggagatgttcattgaagtgcagactgctcggagccacaccgcaggctggcagaggaagtgtctcggtgttgccttggcccgttcaccccctgccaggccagtagaggagctgaagagtcttcgccatgttttgagaaaaagcttagaggcctgaggctggaggcagggggatcagtgaggaggctgcarcatcagtccagttttaccaggtatacttgtttcaccggggaataggtctgtagaactcacactgscatycaggaagtgaaactycccggtwcaggcataccatggacatatttcargttcagctycagaccaccacagtgaagtgaatattgca

SEQ ID NO: 7848 - DNA, 329 bp, Homo sapiens
attttcgggactttcctaagctgctctaactttcctgccccttccccggccaagcccaactccggatctcgctctccaccggatctcacccgccacacccggacaggcggctggaggaggcsgkydkyttaaaattctgggaagmagaacctggycggagccactagacagagccgggcctagcccagagacatggagagttgctacaacccaggtctggatggtatyattgaatatgakwgatktyaaatttgaactsctbcattgtggaacccaaggagccakmcccmtaaacagttkatggyccctacctggtgatcgtggaacag

SEQ ID NO: 7849 - DNA, 100 bp, Homo sapiens
ggaaagcgagcgtatctcccgagccgttgccactgacagccgcgggcgctcccatctgagtaagagccagcccgtccgcggcctctmcagccccgggtty

SEQ ID NO: 7850 - DNA, 100 bp, Homo sapiens
ctttcctcttcctcctcctcctccttggcatccgcctcttcttcctcctgcgtcctcccccgctgcctccgctgctcccgacgcggagyccggagcccgm

SEQ ID NO: 7851 - DNA, 449 bp, Homo sapiens
ataaaggaagagggcaacgttatcatctgactgcttgtagctgtggaagggcggcgtagaagaggaaaggctgggggtttcggatggttgtttttgaagccatcagtattcttgaagaagcagcatatcttgaactgtcctatgggtgaaggctttgatgtggtcctgtaaaaactggcattgaaatggatggcatctgatcctgcttcatgtgattcttcatttagctctggactctttacatcattaaggtaccctgaatatattcagtatggaagaagtgttatcaattctgttgatggaccccttaatctcttctactgattatcttctacttgaaccagtgccaaattaatgttgcaagctttgtcttgaaatattttcttctgagcagcagccagagatcactgattggttcacaggaataagcaggggtaactctaaactgc

SEQ ID NO: 7852 - DNA, 116 bp, Homo sapiens
agagagtctcagattgtcttgataattcattctttcgttctctttcttttgcttctctattyytgtttttcagtgttttgcttgttttgttctgttttaggattttattctctcts

SEQ ID NO: 7853 - DNA, 58 bp, Homo sapiens
acggcccagycaggctggggtccgygcggggcctcccgagaggcggmaaggggcgctk

SEQ ID NO: 7854 - DNA, 81 bp, Homo sapiens
agggttaggggcgccaggacktgggcgtgcaggacgccagagctgggtcagagctcgagccagykgcgcccggagagattc

SEQ ID NO: 7855 - DNA, 90 bp, Homo sapiens
ccggagggcggagcttccagtgagccgagatctgcgctccaacctggggacagagcgagactccctctcaaaaaaaaaaaaaaaaaagct

SEQ ID NO: 7856 - DNA, 118 bp, Homo sapiens
tccrwagggaagcgctgggctaccrmggctattgwrcgtcgcgctctcgmmctcctcttcccgctgcagtgyctatggagcgaggctacgttksattgccgccctggcttaacccttv

SEQ ID NO: 7857 - DNA, 115 bp, Homo sapiens
cgtgggtgagccaagaaaatactaattaataatagtaagttgttagtgttggttaagttgytgcttggaagtgagaagttgcttagaaactttccaaagtgcttasaactttaag

SEQ ID NO: 7858 - DNA, 73 bp, Homo sapiens
aaagtaggctaggcctacggaagctgggtcttcttgctgkgaggtcrcgttccccagtgttacggagggtcct

SEQ ID NO: 7859 - DNA, 56 bp, Homo sapiens
ctytktygcaacgggtttgccgbcagaacacaggtgtcghgaaaactacccctaaa

SEQ ID NO: 7860 - DNA, 112 bp, Homo sapiens
agcgaggtcaaaggcccgggcagcattgtcagactttccgggttgacccgctgttgggagtcctttaagtgcatggtagcaagaaataaagggatatatgaaagccaaaaaw

SEQ ID NO: 7861 - DNA, 100 bp, Homo sapiens
tgtctcaaaaaaaaaaaaaaaaaaaammmaamaaaaaargaagaaagaysagaagaaggmsgagtctgaagagtcagatgatgacwtgggatttggcctt

SEQ ID NO: 7862 - DNA, 184 bp, Homo sapiens
ctagccaggtgcgccccgccccctgcctgcccggccaccttcgggagccgcttccaataggcgttcgccattggctctggcgacctccgcgcgttgggaggtgtagcgcggstctgaacgcgctgagggccgttgagtgtamrcaggcggykagggcgcgagtgaggagcagacccaggcatcg

SEQ ID NO: 7863 - DNA, 237 bp, Homo sapiens
gcggagacctgggagactccggccgcacgcgcgggacacgagcgtcccacgctccctggcgcgtacggcctgccaccactaggcctcctatccccgggctccagacgacctaggacgcgtgccctggggagttgcctggcggcgccgtgccakaagcccccttggggcgccacagttttccccgtcgcctycggttcctctgcctgcaccttcctgcggyygcgccgggacctggas

SEQ ID NO: 7864 - DNA, 426 bp, Homo sapiens
agaaggagcgaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagcccgaacaagatcactcaaggtgaaggataatctactaataccagcactttgaatgaaaatttgtttctctgccacaaactgaacatctttttttytttyywytttttttttggtgggggagttgaaaccta

SEQ ID NO: 7865 - DNA, 367 bp, Homo sapiens
tatttgytaaatttgtatgttkctttaacaatwkggtgcagaaaacctatgccgaggactcctattttagaagggaaactaggtaaagaaawgtcagcagagaaaamggaraagagagaaatactgcctggctcagaaaacaacattcttttcagytgaaatagagggaatgcagctgaaagaakagaatgcttctggtggtgggtgagagaakatgagaragcmgatamtgaccatctttagctggggaaatgaagtcyatatacttgyggtagaactgtmtatatgcaggatttcagcttttatttcatgattacmtgaraaaagaagcatttgsttasctgyaaatattttttargcattttcy

SEQ ID NO: 7866 - DNA, 256 bp, Homo sapiens
gcamaacaagggcagmgggcccggcgcggtggctcacgcctgtaatctcagywctttgggaagccaaggcgggcgaatcacttgaggtcakgagttcgagaacagcctgkcccacagggtgaaactctttctctactaaaaatacmaarattagcggmgcttggytgcgggcacctgtratmccagkkactcgggaggctgaggcaggagaatcgctkgaacccgggaagcggmggttgtaktgagccgagatcgh

SEQ ID NO: 7867 - DNA, 452 bp, Homo sapiens
ctgtacctgagggaggagccaagatggccgaataggaacagctccggtctacagctcccagcgtgagcgacgcagaagacgggtgatttctgcatttcaatctgaggtaccgggttcatctcactaggaagtgccagacagtgggcgcaggtcagtgggtgcgcgcaccgtgcgcgagccgaagcagggcgaggcattgcctcacttgggaagcgcaaggggtcagggagttccctttcctagtcaaagaaaggggtgacggacgcacctggaaaatcgggtcactcccacgcgaatactgcgcttttccaaccagcttaaaaaacggcgcaccacgagattatatcgcacctggcttggagggtcctacgcccacggagtctcgctgattgctagcacagcagtctgagatcaaactgcaaggcggcagcgaggctgggggaggcgcccgv

SEQ ID NO: 7868 - DNA, 78 bp, Homo sapiens
atgttagctgtggccactgtggatttttcgcaagaacattaataaactaaaaacttcaaaaaaaaaaaaaaaaaagct

SEQ ID NO: 7869 - DNA, 303 bp, Homo sapiens
ctgggatttctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgkgcggtgctccgggggggcggygggagcccaagaagtacgcagtgaccgacgactaccagttgtccaagcaggtgctgggcctgggtgtgaacggcaaagtgctggagtgctt

SEQ ID NO: 7870 - DNA, 349 bp, Homo sapiens
tagtagagatggggtttcaccatattggccargctggtctcraactcctgacctcatgatctgcccacctsggccttacaaagtgctaggattataggggtgagccactgtgcccagygctgctccttttttcttgcaacatgcggattaccatagctttcctcttttcacctttagcccactttttccctttaaatactgaagccctcagcatcatctctggagaaaaggcacagaccakactgyttctgggattccctatttagttcttccaggcatgtccttaaccttggcaaaattaacttctaaattggyytagacctgtgtcagataatttttggtgtacagy

SEQ ID NO: 7871 - DNA, 177 bp, Homo sapiens; identical to SEQ ID NO: 7812

SEQ ID NO: 7872 - DNA, 572 bp, Homo sapiens
  misc_feature 309: n=a, g, c or t
actttttaacacttctgtcaagcatagtaaaatttcaacttaaaatatcacaagswctaaatcaatcaatgattcatttgtgcattttactttatttttgagacggagtcttgctctgtcgcccagactggagtgcagtggcatgatctcgtctcattgcaaccskccacctcccagattcaagcgattctcctttgtcagcctcgccaagtagctgggattacaggcatccactaccacgcctggctaatttttggaatttttagtagagacaggatttcaccatgttkgscaagstkggktccmaanyccckgahtttcaggcgatacgcccacctcggccttcccaaagtgctgggattataggcgtgagcamctgtgcccgggcctcattttgtgttatttaaattaaaacctttaagactgacttttttattcacacagactagggggtgtgcaatcttttgggcttccctkgggccacgctggaatgagaagaattgtcttggggccacacataaaaatacactaacactaatgatagctgatgagctaaaaaaaaaaaaaaatgg

SEQ ID NO: 7873 - DNA, 276 bp, Homo sapiens
agtttccgaggaacttttcaccggcgccgggccgcctctgaggccagggcaggacacgaacgcgcggagcggcggcggcgactgagagccggggccgcggcggcgctccctaggaagggccgtacgaggcggcggcccggcgggcctsccggaggaggcggctgcgccatggacgagccacccttcagcgaggcggctttggagcaggcgctgggcgagccgtgcgatctggacgcggcgctgctgaccgacatcgaaggtgcgtcagggcgggca

SEQ ID NO: 7874 - DNA, 216 bp, Homo sapiens
tggagtgtttktwwttttttttttttttgagacgggatctcactctgtcacctaggttggagtgcagtggtgcaatcttggttccccgtwacctccaccaccgggctaagggatcctcccgmcccagsctvtcaagtagctgggaccatakgtgcacgcctytacktccggytaatttthtttgtattttyggtmsaraccggatttcaccgtgtt

SEQ ID NO: 7875 - DNA, 106 bp, Homo sapiens
ratgtccgcgcgccaggcccgccccctccgbcgccgrmccgagcccgyccgaccctctttcaattttacctcaggatttggcgccaaagcggtctcgaagcgggtc

SEQ ID NO: 7876 - DNA, 172 bp, Homo sapiens
gaatttgaaaacttgkrgtaagcctgaaagagcaaagttgcaaccaggatgactacaatcaggacgtttctcttttttgatcctgttcacattktcagcctgattkgctgmtttgggtcctttcttgaaaactccacctgcttastkctgtgcatgcccagtgtggttaggy

SEQ ID NO: 7877 - DNA, 233 bp, Homo sapiens
aaactggagccctagggcttcagcgagacaaacgtaggatcaggctttgtgggggtgcarwgcttccctcagccttcagcacagaggtgtgagcctatttaagatagagctgyggcaggctcatgccagwgggcasaggggtctkgatgtgaaggctgvtctgaggctgccgggctgtttctggaagctacagyctaaggaagaaaccctgctatgggactgtggctgctctk

SEQ ID NO: 7878 - DNA, 155 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtstctactaaaaatacaaw

SEQ ID NO: 7879 - DNA, 83 bp, Homo sapiens
cttttcgatccghcatctgcggwrgagccrmcaccaaaatgcakatttthgtgaaaacccttacggkgaagaccatcaccctm

SEQ ID NO: 7880 - DNA, 265 bp, Homo sapiens
aggtttttgaagatggcggccctcaaggctctggtgtccggctgtgggcggcttctccgtgggctactagcggscccggcagcgaccagctggtctcggcttycagctygcgggttcakggaagysktcggagacccaagawgggaasmcaactataattgaaggccgtatymcagcgactcccamsgagagtccaaatcctsctaacccctmtggycagtgccccatytgccgttggaacctgaagcacawgtataactatgay

SEQ ID NO: 7881 - DNA, 508 bp, Homo sapiens
cagacaataattaaacacaaaattagacaaaaatggttgtgattagtactcaacatagaaaagcactgtggtgcaggggagtgaggggagaactggattagtaatttgaagccaaaaaaagggtgaaagccttttgagaaaccaaagatagattccctgttgtccatatactggaacacgttcaattcacttattgaagactctctgggcccttactcaaggcctgtttactcggatttatgtacatttctaacatggtttcatagttgacaagacattatttgcagtgggttagaagagagtggatggtgggaggacggatcagcagaaaaaataagctgatagaaccaagccctctggtattagggagtgatagcctagcattggggtggggaggaaggagagggacccagaccaaaccctaaatgctgaaaggacatgtcagttagcagtggtagagacaaagggttgaagtgtctcttttgtagcagttagcagttgtagcaga

SEQ ID NO: 7882 - DNA, 363 bp, Homo sapiens
caatgcttatggaaagccagttagttagaattggaaatctgkcttgtcattttacaagcattagattcctttcctgtgtgaagaaagcctcagtgaaacaggtctttgccakaactttatgaagtgctacagaaagcacaaagaattgattcatgttcatcaatacctgctgagagtactgtcccaggaatatccagkggatggattcatcatccaggaggttcaaaagtaagatggttttcaaatcakttktgagactggttgcataacagcagggkacctgaaagagccttctgggagttagtgaactaggtagattgttttgttcacataacgccaccatcaacttaaagtgaattgtck

SEQ ID NO: 7883 - DNA, 314 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctymgctgctccggaggctgaggcaggagaatggcttgaacctgggaggcggagattgcaagatcgcaccactgcaccccagcctgggcaacaaagtgagactccgtcgcaaaaaaaaaaaaaaaa

SEQ ID NO: 7884 - DNA, 501 bp, Homo sapiens
tggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagcagtgggaaaacagtgcaattaatcatttaccttcctaaagatggctggtgaatgtatcacctccatgagagcccaattcagaaatgcagccagaatggtgtttgacagtggatgaagaccaagaactaagatgtagctggagtgatatca

SEQ ID NO: 7885 - DNA, 344 bp, Homo sapiens
atggaatactatgcagccaaaaaaaggatgagttcatgtcttttgtagggacatggatgaagctggaaaccatcattctgagaaaactatcacaaggacagaaaaccamacactgcakgttctcactcataggtgggaactgaacaatgagaacacvaggacacagggtggggaacatcacacactggggcctgtcgtggggtsrsgrgagakgssagggatagcattaggagatatacctaatgtaaatgacgagttaacgggtgcagcacaccaacatggcacatgkatacatacgtracaaacctgcatgttgtgcacatgtaccctagaacttaaagtak

SEQ ID NO: 7886 - DNA, 455 bp, Homo sapiens
tcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgwggcaatggaacag

SEQ ID NO: 7887 - DNA, 401 bp, Homo sapiens
tcccgcagaaaccagtagtcctgacttggtggaaggaaatgtacaggcatctgactggtagagaacggagcctactcttccaggggcgcccatctccagaacattgtgtctcccagaggattaccgactgatctcatgattttkttggcacttgccaaagttctcttcttttcctctgggttctgttgcctgcctatatgtgtgccctctcttgtacccagagttggcctgtcccaaattctttccctctatcccaaagttggtacgcattgacctacctatggatgacagtgatttctgtctcctgtccttagtcctctcagcctccaactctccttcctgcaggcattgatgttgaacaagtgtctgtcgtcatcaactttgatcttcccgtggacaag

SEQ ID NO: 7888 - DNA, 171 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtcccaaaaaaaaaaaaaaaa

SEQ ID NO: 7889 - DNA, 77 bp, Homo sapiens
ccggagggcggasttccagtgagccgagatctgcgctccaacctggggacagagcgagactccctctcaaaaaaaaa

SEQ ID NO: 7890 - DNA, 328 bp, Homo sapiens
  misc_feature 105..106,236,238: n=a, g, c or t
gcaaaacaagggcagcgggcccggcgcggtggctcacgcctgtaatctcagcactttgggaagccaaggcgggcgaatcacttgaggtcaggagttcgagaacannctggcccacagggtgaaactctttctctactaaaaatacaaaaattagcggggcttggttgcgggcacctgtaatcccagttactcgggaggctgaggcaggagaatcgcttgaacccgggaagcggagnmnvtagtgagccgagatcgcgccactgcactccagcctgggcgacagggcgagactcccgtttcgaaaaaacaaacaaaaaaaaaaaaaaaa

SEQ ID NO: 7891 - DNA, 395 bp, Homo sapiens
  misc_feature 120,222: n=a, g, c or t
tatgagaataaagaagtagaagcgatcttaaagttaaatggggaatagttatataaacttgtgatttatttttctctgtctaaaaaaagtacatatttctttgttttttgcacagtaaanatttagarrcagtgacaactgagtagcagtgaatattcttagtgccctgagtatggcctctaaatactgtttgccactaacaggaatagtgtctttgcagangtcatttattccagagctgagcaggaatgcaagatatcttcttgtgtcagaaagcaggaaagctatgaaaggccgctggagacatatcaaaggttagaaggtacaacttgaagggactctcactggccgaagatgagactattggaacaaccaaaagaatgaaagcaatgaat

SEQ ID NO: 7892 - DNA, 501 bp, Homo sapiens
cattgtattttctaattgtttgctggactatatggaaattgatttttggcatgctgatatatccagcaaaaaactttactgaactctaatgttttgtttctgagaggtttctgatggtctgtttcttgcaggatgtctgaatcttccaagtaaaaatgagtagactcctattttccttagaccacgatttatcacattttaatgtgcacacaaattacctggggagtattgttacagtgtagattctgattcagcaggtttagggtggagcctcagattctgtgtttcctacaagctcagctagtattgcgamscccagaacacactttgagtagtgaggggctagccaattccttgcatgtggattcaacataaaatacatgttcctcttagattttatgtaatagatgactgttgctaatactcatgaaacaagaacatctgtagtaaagtcaggcaagactccagggaagattgtgaatgtcagagttggaagagctt

SEQ ID NO: 7893 - DNA, 329 bp, Homo sapiens
gtttgatcggaacagttacacattcctttaaatagtgcctacacctgcttttgcactgcagtttcagagttgaatacttgtagttgtgatgttgattgtatgacctacaaagcctaaaatatttgtgtatttgatgctttaaactttrgtgacccccagtctattgccttcctactcaaaagtatggtctctggaccagcagtcttggcatcacacatggtataactaaatatgcagaatcataggcttctckckgcactcacaaatacaggcacattgatgctcaaagagaatccaaggaatgtattaggaatatatggccgtacgtv

SEQ ID NO: 7894 - DNA, 419 bp, Homo sapiens
  misc_feature 258..259: n=a, g, c or t
cattatggtgctgttctctcaaatggttacaaacttgcaaagagtaaagaagacttttcattcttagtcctctgagccattaactgtaacataactgtaaagttatcttgagatgtggtacaatttcaatctgaaagagaaagcaaaaatattacagatatgcttgaaccaatcattacttaccaaaaataaatataggaaatgagttattagggaatgtactgtaatctctgagaggaaaaaaaaactattwvmawnnvacagtgtcaacttctatgtccagtagtgacctaaggaaaagagttggaggattctgaccatatctctttaactgtgatgagtgcacagaccaagactgatcaattgtgtgagtgtgatcccatcactgatcattaatatgaaactctcttacattttaa

SEQ ID NO: 7895 - DNA, 170 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtccaaaaaaaaaaaaaaaa

SEQ ID NO: 7896 - DNA, 170 bp, Homo sapiens; identical to SEQ ID NO: 7895

SEQ ID NO: 7897 - DNA, 437 bp, Homo sapiens
  misc_feature 257: n=a, g, c or t
aagaaccatggcactcgggagtccctggaagcactcctgcagagggctgtggccactgccccaaagcagaggtgctgtggctcatgggcgccaagtccaagtggctggcaggggatgtgcctgcagcaaggagcatcctggccctggccttccaggcaaccccaacagtgaggagatctggctggcagccgtgaagctggagtccgagaatgatgagtacgagcgggcccggagctgctggccaaggcgcggasagntgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagc

SEQ ID NO: 7898 - DNA, 475 bp, Homo sapiens
taaatacagtatacttctccaaaaatagttttctttcgtttatgtcagtgatgttttatagttctcagtgagcagggctataccatcttttcttaaatttcagtgtgatttactcttcaagtgagaaatcacaaggcttcttggaccaatctctaaatctgagactttggccagaattaagactgtataggctgggtacggtggctcacgcctttttaaacccagcactttgggaggccagagcaggaggatcaattgagtcaggagttcaagaccagcctggccctgtctctactaaaaatacaaaaattagccgggcatggtggcgggcacctgtaatcccagctacttgggaggctgaggcacgagaattgcctgaacccaggaggcagaggctgcagtgagcggagatcacgccattgcactccagcctgggcaacagagcaagactccatctcaaaaaaaaaaaaatgtw

SEQ ID NO: 7899 - DNA, 314 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaakkagcggggtgtggtggcacgtgcctgtaatctcagykgctccggagsctgaggcaggagaatggcttgaacctgggaggcggagattgcaagatcgcaccactgcaccccagcctgggcaacaaagtgagactccgtcgcaaaaaaaaaaaaaaaa

SEQ ID NO: 7900 - DNA, 476 bp, Homo sapiens
ctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatcatgtggatttgtcccaagattatgctagatgcaccaagcatggcccaaattggttcttttttaaatcccatgggggaagtgcaggctccttcctgtggtgcctctttatagvctcaccaccatgctaacactgagcatggtgaggaggaggaagctttggctagctaaacatgtttaataaggccataaaaactgagaaagaaaaacattcaacttttagctgaagctcctttgatacaaaagtttcattctgtcagaataagccatagtacagactcagagatagaggcagtttctagaga

SEQ ID NO: 7901 - DNA, 440 bp, Homo sapiens
tcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggctggacgaagaggcctaggacctgaagagactcc

SEQ ID NO: 7902 - DNA, 357 bp, Homo sapiens
catataatatttttggactacagctgactacgggtaactgaaactgtggaacatgaacccaccgataatggaaggctactgtattttaatatttgccaacactgagcatttgavatgagctactttggcaggaaagattataaatvattgagtagatatcaatggatgagcatcatagtgctctatcagccctttgggagaccatgagtaacctatcatttggttttagctctttgtcttgattcactttatcaaaatgggactatagatgacttgtggtaggttctagagtgcaagaaatgagaaaataagtgaatgagctttgcccagccacagattcttaacagtgctgaggga

SEQ ID NO: 7903 - DNA, 334 bp, Homo sapiens
cctgtattgtgccagttttcaaagggaatgcttccagtttttgcccattcagtatgatattagctgtgggtttgtcataaatagctcttattagtttgagatacgtcccatcaatacctaatttattgagagttttttagcatgaagggctgttgaattttgtcagaggccttttctgcatctattgagataatcatgtggtttttgtctttggttctgtttatatgctggattacatttattgatttgcgtatgttgaaccagccttccatcccagggatgaagcccacttgatcatggtggataagctttttgatgtgctgctggatcccgt

SEQ ID NO: 7904 - DNA, 164 bp, Homo sapiens
caaaaaattagccgggcgcggtggcgggtgcctgwagtcccagctactcgggaggctgaggcaggagaatggcgtgaacctgggaggcggasdtgcagtgagccaagattgtgccactgcaatccggcctgggctaaagagcgggactccgtcccaaaaaaaar

SEQ ID NO: 7905 - DNA, 429 bp, Homo sapiens
cattgataggtgttggcaaaggagcatggagcataaggctgtagtattcacagtaagcttttcaaaaacttaagtttcaaatgcaaatctaaaggatgtctctgctcttcctaagccttctggtagatagtactagaaattcctaagtgaatgctttataggatattttattattgattattgataacaattgtggcaaaatatggtgttgttgatagaagtatcgaagaagtccatagaactagcataatttcttctgaccaaccacctcactgcagtattattgtgttggcttggatgcctccagtttcagtgattaggactcacaggctgcaacaaagacaggccattccacagtgacacctctgccagggctttctctctaatccaaaatgcaactgggcaactacctctggacatgggtagagt

SEQ ID NO: 7906 - DNA, 170 bp, Homo sapiens; identical to SEQ ID NO: 7895

SEQ ID NO: 7907 - DNA, 170 bp, Homo sapiens; identical to SEQ ID NO: 7895

SEQ ID NO: 7908 - DNA, 431 bp, Homo sapiens
  misc_feature 254: n=a, g, c or t
gtactatatataaaacctttttaccttttttatatataaaacctatgattcataggttttatgtcctattaaaatatgagctaacaataattggtaaaattagttggaaaattatcagttttaaaagaaaattaaattgaaggttatgttgttagtaatttaaagatctcctgtgttttgatgtaaaaacactattttttagcagtcaaagggcttaagtagtatgactttttgtgtaacttggattgtgcaanhgcttttaaaaatgaaactatttctcatttataatgagrtwaatggactcagtgtatcggagagcagactgaacacacacttctacctcctttctccccgcaaaccctacagaagtgacaaaaaagacacatatcacaggggagtgaaacccagcagtactcagactgtgaagcaga

SEQ ID NO: 7909 - DNA, 445 bp, Homo sapiens
gacgccgagggsgctgcgacgcgccgagaggcgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtaccagttcggatggcctctctggcccctgccgcgctcctgcctcctgccccagcaggtaccacggtcctcggsccatctccaaccaaggagcagctgcggttccccgaggtgcccgggctggccggtggtatcgtggacgc

SEQ ID NO: 7910 - DNA, 51 bp, Homo sapiens
atgttasctgtsgccactgtsgatttttcgcaagamcattwataaactaam

SEQ ID NO: 7911 - DNA, 479 bp, Homo sapiens
tccagttgtcatattaatgctatataactgagattcttgaagagattatccattcttcctcattacaagataaacattttttgtttctgattatttacactgttaataattatttattatggatctttgtttacaatacatactgaagtgccagcttttcatcagacccatctgttattcacttagttatatactcattatataatacactctgttataaactcagttatatacggagttacatgttcagcacatactgattgtctaccatgtgccaggcactgatttaggtactgaggatggaataggggacacttactttgcttctgttttgtttgtgcctcactttgcaggagttccactatatagcagaagatctttatcgaacaaagaacacattgcaaagcagaattaaagatcgagacgaagaaattcaaaaactcaggaatcaggtatgaatcactattcacaacttgtga

SEQ ID NO: 7912 - DNA, 84 bp, Homo sapiens
ccggagggcggasttccagtgagccgagatctgcgctccaacctggggacagagcgagactccctctcaaaaaaaaaaaaaaaa

SEQ ID NO: 7913 - DNA, 413 bp, Homo sapiens
acaagccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagcctcatcaggttagagggtgtggaagggcgtgacccagtgggaggtgggaatctcaccaataaaaggccctcgtgtgccccttccccacaagacctgagcgcccagtggaagcagctggaggacagaggagcttccagcagaagagtggacatggctgcactcttccaagaagcaagcagctgtcccgtctgctcagactatctggaaaaaccaatgtccctggagtgtggatgcgccgtctgc

SEQ ID NO: 7914 - DNA, 52 bp, Homo sapiens
caaaaaattagccgggcgcggtggcgggtrcctrtagtcccagctactcggg

SEQ ID NO: 7915 - DNA, 123 bp, Homo sapiens
catcagaaggtaaattggaaagaggccgggcatggtggctcacacctgtaatcccagctctttgggaggccaagacgggtggatcacttgasgtcaggagtttgagaccagcctggccaacak

SEQ ID NO: 7916 - DNA, 61 bp, Homo sapiens
ccggagggcggasttccagtgagccgagatctgcgctccaacctggggacagagcgagack

SEQ ID NO: 7917 - DNA, 321 bp, Homo sapiens
tttacaaaaagtttctgccgaagatggcagggtgtgatggctcacgcctgtaatcccagcactttggggaggccgaggcaggtggatcatgtgaggtccacgagtttgagaccagcctgaccaacatggcaaaaccccatccctactaaaaatacaaaagttagccaggtgtgtggcgcacgcctgtatctcaagtactcgggggactgaggcaggagaatcgcttgaagctgggaggcagaggttgcagtgggccaagatgccccgcagcactacagcctgggcaacagagcgagactccatctcaaaaaaaaaaaaaaa

SEQ ID NO: 7918 - DNA, 65 bp, Homo sapiens
ttttaatgactaratactgtctttgattttttgttccaggtctgtcratattaacttcttataab

SEQ ID NO: 7919 - DNA, 271 bp, Homo sapiens
  misc_feature 254: n=a, g, c or t
gataagtatctccaatttagtatatccacattgagggacccaccatggataagtaggcatttttaggtatgttaagatatgttgtatttcctctgaggaattctttgtttataaatgaattacatttatttttttctggcccattaaatgttaatatacaagtagctgcagtggttttctatctggtatacatttgtattcattaatgttaccttttctggaaacccttctagataatgaaattttcaccaganagtgttgcagcgtttat

SEQ ID NO: 7920 - DNA, 171 bp, Homo sapiens
ctttccgctcggctgttttcctgcgcaggagccgcaggccgtagsagcccatggcgcccagccggaatggcatggtcttgaagccccacttccacaaggactggcagcggcgcgtggccacgtggttcaaccagccggcccgtaagatccgcagcctggaggagctcaggg

SEQ ID NO: 7921 - DNA, 356 bp, Homo sapiens
  misc_feature 264: n=a, g, c or t
aacgaaagactgcgactccccggactatcaggccgggagagtccacttccagctcacctcggagctccgggagcctttcagcacctgcttggtgagcgcgattacgtcagtaccacaggtggtcaccttctccgtgagaagccccttcacggactgaccgaaccgcgcttgaractctggcgttccagtcgccatcatttcagttagcgaacggttgcgcactgacgatggtgagtcgccggggccaaaagwcaagcaaagcgnaaggaaaagaggcgtctcttcctccatgggaaaaggaagggacgcatgcgcctgatggaggttgacctttgctcactaaactcatgaactat

SEQ ID NO: 7922 - DNA, 299 bp, Homo sapiens
taccttgccgggcgcggtggctcacacctgtaatcccagcacttwgtgaggctgaggcgggcagatcacgaggtcaggagatcgagactatcctggccaacacggtgaagccccctctctactaaaaatataaaaaattagccgtgcatggwtgcrggcgcctgtggtcccagctactcaggaggctgaggcgggagaatgatgtgaacccgggaggcggmccttrccgtragchaggatcacgtcactgcactccagcctgggtgacagagcaagactctgtctcaaaaaaaaaaaaa

SEQ ID NO: 7923 - DNA, 354 bp, Homo sapiens
tgtaatgcttgcragtktatkctttttgcttaggattgckttggctatttaggctcttatgggttccatatgartttkataattgtgttktctaattctgtgaaatataacattggtaatttgataggvagttgcattgactttctagattgctttgggcagtatagtcattttvrtgacattgattcttcccgcccatgagcaagggatgtttttccatctgtttgtgtcatctacagtttcattgttttataattctcctttgtatttcaccatcttaaatgtattcctagatagtttatgtttttgtatggctattgtaaatgggattttcaccatcttaaatgkattcct

SEQ ID NO: 7924 - DNA, 455 bp, Homo sapiens
  misc_feature 266: n=a, g, c or t
atcttaattgttcttcctactcaggcttataacatttccatattttcccaaacaatacaaacacaggcaaatccatcaaccattgtgactactgagcactctctcctttcccatcctttaatttctcaccagcccttcctccctcacagctggttcccagcatctgtgcattgtgggcctccatggtttagttgcccctgggccaagcctctgacatcttcccagtctttaacttccttgacctctttgcagcatggaaccccatngacaaggccttcttcgaaccgtctattctttgctgccatcctactatatcctcttgatattcctaccagggttcagccttgggtctgttttggtttttktcctctamcttcttctcatggtgatctcatgcattcctatagctgcaattttcatctctgtccagatgcctcccagatcgagatctctaa

SEQ ID NO: 7925 - DNA, 425 bp, Homo sapiens
abtattgttctttttttgcgatgggtctctgttacctaagctggtctgagctcctgagctcaagcgatcctcctgcctcggccacccaaagtgttgggattacaggagtgagccaccacgtctggcctctcgtcgtttttattttttaatttttgagtgggggctcgctccgtcgcccaggctgtgatgcagccgcgcgatcacgacctactgcatcctggacctcctgggctcaagcgaatctccggcttcagctcccaagtagctggaactacactcccgcgccaccacgtcccgctaaattaaaaaaaaaattgttgtagagatgggggtctcgttgtgttgccctgacaggtctcgaactcttgggctcaagcgatcctcccgtctcggtgtcccaaagtgttgggattacaggcgtgaca

SEQ ID NO: 7926 - DNA, 83 bp, Homo sapiens
ccggaggcggasttccagtgagccgagatctgcgctccaacctggggacagagcgagactccctctcaaaaaaaaaaaaaaaa

SEQ ID NO: 7927 - DNA, 313 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggagctgaggcaggagaatggcttgaacctgggaggcggagattgcaagatcgcaccactgcaccccagcctgggcaacaaagtgagactccgtcgcaaaaaaaaaaaaaaaa

SEQ ID NO: 7928 - DNA, 314 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgaggcaggagaatggcttgaacctgggaggcggagattgcaagatcgcaccactgcaccccagcctgggcaacaaagtgagactccgtcgcaaaaaaaaaaaaaaaa

SEQ ID NO: 7929 - DNA, 313 bp, Homo sapiens; identical to SEQ ID NO: 7927

SEQ ID NO: 7930 - DNA, 328 bp, Homo sapiens
  misc_feature 108: n=a, g, c or t
gcaaaacaagggcagcgggcccggcgcggtggctcacgcctataatctcagcactttgggaagccaaggcgggcgaatcacttgaggtcaggagttcgagaacagbanggcccacagggtgaaactctttctctactaaaaatacaaaaattagcggggcttggttgcgggcacctgtaatcccagttactcgggaggctgaggcaggagaatcgcttgaacccgggaagcggaggttgtagtgagccgagatcgcgccactgcactccagcctgggcgacagggcgagactcccgtttcgaaaaaacaaacaaaaaaaaaaaaaaaa

SEQ ID NO: 7931 - DNA, 483 bp, Homo sapiens
aatgtttgctttgttttgttttttctattgcattgtcaggctgaaaattctccaaacttttatgctctgttttacttttaaaactgaatgcctttaacagcacccaagtcacctcttgaatgctttgctgcttagaaatttcttctgccagataccctaaattacctctctcaagttcaaggttccacagatctctagggcaggggcaaaatgccaccagtctttttgctaaaacatgagaggagtcatcttcgctccagttcccaacaagttcctcatcttcatgtgagaccatcttagcctggatttcattgtccatatcattatcagcattttgggcaaagcattcaacaagtctctggggagttccaaactctcccacattttcctgtcttctcctgagcccttcaaactgttccaacttctgcctgttacccagttccaaagtgacttctacatttttgggtatctcttcagcagtgc

SEQ ID NO: 7932 - DNA, 125 bp, Homo sapiens
aaagagaaatgagactaraaggtcgkkcccccaactgttaaraatgtgtgcagakatcaacgtctcttckacatactggtasaggkgcgactgsagggycccctgwtataacaagagtaaccaaa

SEQ ID NO: 7933 - DNA, 314 bp, Homo sapiens; identical to SEQ ID NO: 7928

SEQ ID NO: 7934 - DNA, 294 bp, Homo sapiens
catcagaaggtaaattggaaagargccgggcatggtggctcacacctgtaatcccagctctwtgggaggccaagacgggtggatcacttgagggtcaggagtttgagaccagcctggscaasatggtgaaacacccgtctctactaaaaakacaaaaatdagcggggtgtggtggcacgtgcctgtaatctcagctgctccggaggctgaggcagggagaatggcttgaacctgggaggcggagattgcaagatcgcaccactgcaccccagcctgggcaacaaagtgagactc

SEQ ID NO: 7935 - DNA, 408 bp, Homo sapiens
  misc_feature 116..117: n=a, g, c or t
ggggcggcggaagttcgacggcgccgggcgagtggctgttgagcggcgccgcgggagttccgcaggtttctcgtgttcgcagcggascggaggcagctgaacccggcmgtgggatnnvggataggaggaggaggggacccataggacgcgttaacatggacctggaaaacaaagtgaagaagatgggcttaggtcacgagcaaggatttggagcsvsttgtttaaaatgcaaagaaaaatgtgaaggatttcgaactgcacttctggagaaaaatatgtcgtaactgcaagtgtggccaagaaagagcatgatgtcctctttgagcaatgaagaggatcggaaaagtggggraaactttttgaagacaccaaggtataccactctgattgcaaactaaagtcagatgg

SEQ ID NO: 7936 - DNA, 279 bp, Homo sapiens
  misc_feature 279: n=a, g, c or t
tatataaaaagggggtttattagggagaattagctcacaagattacacagtgaagtcccatgataggccacctgcaagctggggaaagggaaggtggtagtggctcagtccaagttcaaaagcctcaaaaccatggaagccaacagcgcascttcagtcggtagccgaagbtgagagccccaggcaagctgctggtgcaggtttcagagtccaaaggccgaagaatctggagtctgatgtccaaaggcaggaattaaggaggcaagcatctgacgcagn

SEQ ID NO: 7937 - DNA, 65 bp, Homo sapiens
caaaaaattagccgsgcgcgstsrcrrgtgcctgtastcccagctactcgggaggctgaggcags

SEQ ID NO: 7938 - DNA, 380 bp, Homo sapiens
cagcaaaacctttgatggatttttcaaaaagtattgaaggcatttagcgttasttctgtttagctcagctttgggccatggcggtggagtgctagctaggaaaacccatagaatgctaacttgctgctgagatgccggggaaggactcaacgtggatgccaccttgggaatttttctttctgtagttttcactcttctaaacaacaacaaaaaatgtctagtgaattaaaataaaatatgaaagtaaagctttcaaaaagtaaagtaaagggtgtgtttggatttgcaagtgggagcagattgggctgcaaggccaagagctgtgtgatagccctgagtttgaacattccctgcacaggtttgggggtctgatgctggag

SEQ ID NO: 7939 - DNA, 369 bp, Homo sapiens
actttcctcttggaagtggcgactgctgcggggctgagcggtgctcgcacgcgtctcgggagccaggttggcggcgcgatgaggcgcasaaggccgatgtggagcggtacgtcgcctcggtgctgggtctcaccccgtcgcctcgacagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttga

SEQ ID NO: 7940 - DNA, 263 bp, Homo sapiens
ctcctgccccagcctcccaagtagctgggattacaggcatgcgccaccacgcatggctaatttttgtatttttttagtagagacggggtttcaccatgttggccaggctggccatgaactcctggcctcaagtgatccaaacgcctgggcctcccaaagtgctgggattacaggcgtgagccaccgggcctggccgaacaatgtcttttgtatcccttccctcacactaacaatcctctggagatcatggcctgctagactgs

SEQ ID NO: 7941 - DNA, 320 bp, Homo sapiens
acatctaatcaagggctggtgaaacaggctggcagcttgggggcattcaagcagcacgcctgccagtcctggggaagcaggaaatccaggcagaaagccccctgacaacaggcttcctgcagtttccaggtgcttaggaacaaaagcatgscttgaggccggcgcggtggctcatgcctgtaatccaggcaccttgggargcccaggcggatggatcacctgargtcaggagtttgagaccagcctggccagcatggtgaaamcctgtgtctactaaaaatataaaaattggctsggcgtggtggcggacgcctgtgatc

SEQ ID NO: 7942 - DNA, 315 bp, Homo sapiens
aaaattaaattaaattgactgggcgcggtggctcgcgcctgtggtcccagcactttggggggccgaggtgggtggatcacgaggtcgggagttcgggaccggccgggccagcatggtgaggccccgtctctactaaagatacaaaaaaaatttggccaggcgcggtggcgggcgcctgtggtcccagatactcgggaggctgaggcgggtgaatcgcttgggcgtgggaggcggagtttgcggtgagccgagatagcgccactgcactctagcctgggcaacagagtgagactctgtctcaaagaaaaaaaaaar

SEQ ID NO: 7943 - DNA, 458 bp, Homo sapiens
cacttctgcttttggtgtcatatctaagaaaccattgcctaatccaaggtgacaaagatttacccctaagttctcctctaagagttttatagttttagctcttacttttgggttctgtggtcagttttttagttaatttttgtgtatgttaatgagctgggtgttcaacatcattcttttacatgtggctttccagttatcccaccaccgtttgttgaaaagactattatttctccattgaattgtctcaacacctttgttgaaaatcagttgaccatagacacaggttatttatgaactcttaattctgtgccactgattcgtatgtctatcattttgccagtaccacactgtcttgattactgttgctttgtagaaagttttgaagtcaagaagtgtatgttgccaagtatggtggtacatgcccataggcacagctactcaagagactgagacag

SEQ ID NO: 7944 - DNA, 309 bp, Homo sapiens
gcaaaacaagggcagcgggcccggcgcggtggctcacgcctgtaatctcagcactttgggaasccaaggcgggcgaatcacttgaggtcaggagttcgagaacagcctggcccacagggtgaaactctttctctactaraaatacaaaaattagcggggcttggttgmgggcacctgtaatcccagttactcgggaggctgargcaggagaatcgcttgaacccgggaagcggaggttgtagtgagccgagatcgcgccactgcactccagcctgggcgacagggcgagactcccgtttcgaaaaaaca

SEQ ID NO: 7945 - DNA, 238 bp, Homo sapiens
gaatacaggaaaacagtttttctaaaaaagcaataaggccatgttttttactttagctttaaaaactttttttattttatttttcagtagctacaaggttgtctttaaatattctttatagtaactaacaccctgtaggcatgaccagtaatagaaataatttcctcttttccttggctccactgatgcccactgcctcttctttgtgatcagttaaatgtacactttagatgattct

SEQ ID NO: 7946 - DNA, 336 bp, Homo sapiens
aaaattaaattaaattgactgggcgcggtggctcgcgcctgtggtcccagcactttggggggccgaggtgggtggatcacgaggtcgggagttcgggaccggccgggccagcatggtgaggccccgtctctactaaagatacaaaaaaaatttggccaggcgcggtggcgggcgcctgtggtcccagatactcgggaggctgaggcgggtgaatcgcttgggcgtgggaggcggagtttgcggtgagccgagatagcgccactgcactctagcctgggcaacagagtgagactctgtctcaaagaaaaaaaaaavgaaagcaaaaaaaaaaaaaaa

SEQ ID NO: 7947 - DNA, 166 bp, Homo sapiens
  misc_feature 93: n=a, g, c or t
aaaaattggccggacgcggtggtgctcrcctgtggtcccagctgctcgggaggctgaggcgggagaattgcttgagcctgggagatggaggtngcggtgagccaagatcgcgccactgcactccaggtgggcaacagagcgagacttcgactcaaaaaaaaaaaak

SEQ ID NO: 7948 - DNA, 140 bp, Homo sapiens
attatgkcattgaaacccaacacgtcctgtaarggaccattatgatcccctctctarcgatgargaaactccaggttagagaagstgragaaattgctcaagrtcatactakwacattaagtggcaaagccagacttagr

SEQ ID NO: 7949 - DNA, 316 bp, Homo sapiens
  misc_feature 233,235: n=a, g, c or t
gcaaaacaagggcagcgggcccggcgcggtggctcacgcctgtaatctcagcactttgggaagccaaggcgggcgaatcacttgaggtcaggagttcgagaacagcctggcccacagggtgaaactctttctctactaaaaatacaaaaattagcggggcttggttgcgggcacctgtaatcccagttactcgggaggctgaggcaggagaatcgcttgaacccgggaagcgnmngttgtagtgagccgagatcvcgccactgcactccagcctgggcgacagggcgagactcccgtttcgaaaaaacaaacaaaw

SEQ ID NO: 7950 - DNA, 412 bp, Homo sapiens
ctgatgtcttggtggagttcctcttggatgtaagcatttatacacagtgaccctgcatggagctgcctctcctcaaatatagggagagatagaaccccaaagaaaagggacaagctggagaacctggcctcatctgtgacaggtttttcaggattcacaaaaaactaaggagcacctatattattgcactgtctactctactgggaaagtgatctttaagccaccctagaaactgttgggggccatgtagtagtaatatgctaattctgttaccagttatacatagacgtctattgaaatctccttggttttgctccactgctactgaagaggagctggggaatgtggggagtgagggggctaaccagccacctgaagagagaggagggatgggagtaccaatcagccaggt

SEQ ID NO: 7951 - DNA, 431 bp, Homo sapiens
  misc_feature 321..322,324: n=a, g, c or t
ttaaaatgttcatactacccaaagctagctctagacacaatgcaatccctatcaaaataccaatgacattcttcaaagaaatagawaaaacaatactaaaatttgtatggaaccacaaaagaccccaaataaccaaagcaatcctgaataaaaagamwaaaaactggaggcatcacactgcctggcttcaaaatatactacaaggctatagtaaccaaagcagcatggtactgccataaaaacagacacatagaccagtggamcagaatagagaacccagaaataaatggatcggctataaatgcatggaatyattgahtnnhnggagacaacgtctcactctgtcatccagcctggagtgcagtggtgtgatcttggctcactgcaacctccgcctctcagactcaagctgtcctcccgccttggcctcc

SEQ ID NO: 7952 - DNA, 83 bp, Homo sapiens
ccggagggcggagttccagtgagccgagatctgcgctccaacctggggacagagcgagactccctctcaaaaaaaaaaaaaaa

SEQ ID NO: 7953 - DNA, 280 bp, Homo sapiens
atttttccattgaagaaattggtatgaaaggatatatgacaaaaaggaccaagaaaaaatgagtaactggaagtcagcaaagtgaattaaaaaaaaaacttttttaaaaagacaagaaggctatttgcaaagagtcttgtwattatagccargcctagttacatatgtgactttgatttattaatttgttttagttgtgacgatccagaagtggaggattatggaaacaaatggagcatgagtgctatgcttaggtacctgaaacaagaaggcagagata

SEQ ID NO: 7954 - DNA, 171 bp, Homo sapiens
caaaaaattagccgggcgcggtggcgggtgcctgtagtcccagctactcgggaggctgaggcaggagaatggcgtgaacctgggaggcggasttgcagtgascmaagatkgtgccactgcaatccggcctgggctaaagagcgggactccgtcccaaaaaaaaaaaaaaaa

SEQ ID NO: 7955 - DNA, 459 bp, Homo sapiens
  misc_feature 123: n=a, g, c or t
agagaaggctttaaaattttttttttaatttgcatttgctggggggatcgctttcacctcttttagattcttctttttggtatttatgtccacatttyccaaataacatgcttaagtgtctcnwggatttttccggagtcagcatgagctgctgacgcccgmtgcagaagatgagggcttagagccacacawttctggtctgtgccctgcacacatcacctttmvacctcctgttgcttcctgttttctcataacggagttgcatcattgtttagggttaaatcatcaggacccacacggatcacaagtgaaccacgaaagaaaccgtcatcattttacaatttttgcacaaactctctgttttccacagaattacatttcctgtcagatgctgttttcactgcgttaatgatacgctgttttcattgtattaatttctaattccatcgcaatctctgc

SEQ ID NO: 7956 - DNA, 391 bp, Homo sapiens
  misc_feature 306,313,315: n=a, g, c or t
tctccctgtggtcgtcttccacgttgtggaaggtttgttgtttcgcttcttgcaataaatcttgctactgcttgccgtttgggttcaggctgcttttatgagctgtaacactcactgcaaaggtgtgcagcttcactgctgaagccgttgagaccacgaatccaccgggtggaacgaacaactccagacgtgccaccttaagagttgtaacactcacctcgaacgtctgcagcttcactcctgaagccagcaagaccacgaacccaccagaaggaagaaactccgaacatatcctaaagtcagawnghamaananwacgtatacgctgcctttaagaactgttaacactcaccgtgaggctccgcggcttcattcttgaagtcagtgggac

SEQ ID NO: 7957 - DNA, 384 bp, Homo sapiens
ttcatgtagttcctcataagcaggggccagaatatctcagccacctgcagtgacattgctggacccctgaaaaccattccakaggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgckgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggckcagcag

SEQ ID NO: 7958 - DNA, 171 bp, Homo sapiens
caaaaaattagccgggcgcggtggcgggtgcctgtagtcccagctactcgggaggctgaggcaggagaatggcgtraacctgggaggcggacttvcagtgagccaagattgtrccactgcaatccggcctgggctaaagagcgggactccgtcccaaaaaaaaaaaaaaaa

SEQ ID NO: 7959 - DNA, 397 bp, Homo sapiens
ctacctacctgacatatttaaaataaaagcacttctcggccgggcgcggtgtctcacgcctgtaatcccagcataggccaaggcgggcagatcacgaggtcgggagttcaagaccagcctggccagcatggtgaggccccgtctctgctaaaaatgcaaaaattagctgggcgtggtggcgcttgcctgkaatcccagctacttgggaggctgaggcaggagaatcgcttgaaccagggagtcggaggttgcggtgagccgagatcctgcctgcactccagcatggtgacagagtgagactctgtctcaaaataaataaatagataaaagtacttttccacctaagtactwatcaaaagcagatgcatctgttttgacaggggggttctagaagcaa

SEQ ID NO: 7960 - DNA, 377 bp, Homo sapiens
agatcgcgcgagacagcggaaggagcaagagtgggaggcgcgcgcggaggccgcgacggacgcaagatggcgacggcgaccatagctctcctctcatggggaggttgaatggagcagctgaacttggctgacagtggcctggtggggaaggaagccagaagatgcagaagggcctcccctcccatgggcatgccttctgcctggtggctgcagaatgaggccggctgcctctttgcagcaaggcaggtcaatggccagcaaggaggggggtccgagccggcggcggcggcggcagtggtggcagcgggagacaaatggaaacctccacagggcacagactccatcaagatggagaacgggcagagcacagccgccaa

SEQ ID NO: 7961 - DNA, 95 bp, Homo sapiens
ckacctasckgacatatttaaaataaaakcacttctcggccgggcgcggkgtctcacgcctgtaatcccagcataggscaaggcgggcagatcas

SEQ ID NO: 7962 - DNA, 429 bp, Homo sapiens
cactgatcattagagaaatgcaaatcaaaaccatagtgagataccatctcacagcagtcagaatggctattattaaaagtcaaaaaataacaaatgctgaggagattgtggagaaaatggaatgcttatacactgttagtgggagtgtaaattagttcaaccattgtggaaagcagtgtggcaattcctcaaagagctaaaaacagaattaccgccggcatgctgactcacgcctataatcccagcactttgagaggccaaggctggtggatcacctgaggtcgggagttcaaaaccagcctggtcaacatggtgaaacctatctctactaaaaatacaaaaaattagctgggcttggtggtgggcacctgtaatcccagctactcaggaggttgaggcaggagaatcgcttgaactcaggaggtggag

SEQ ID NO: 7963 - DNA, 334 bp, Homo sapiens
ataggtagttccccgtttccaggaccccagacggcctgctgggacagtgtatatgagtccggaatgggctggaccagggtcaggctagcccagacttcaggaggaagcactcaattgaacaagtgcaggaaccagctggctgcctcagcactgacagaagcaaattccatttgcttggacccactgcattccatcccttgtggaagagagcatgtaagcaagtgagtgcaggaactggctggctgctttggtgctggcaggagcaaacaccatgaaggccccatggcagagtccaggacaggaccttcaggcctctgaaaaaaaaaaaaaaaaa

SEQ ID NO: 7964 - DNA, 293 bp, Homo sapiens
tttggttttgtgtgtttttctactgtatgacacttctgacccttaagggatgttgtacaggaactgtataattttctcctcaacttcatatggtctacttgtataattatatttcttatgtaattctgaaaaactttagacatgccaactctttttgtgtctgaagagaatagtacagtattataaattcctctgtatccgttattcagcattaacagttagcataactcataaccagtctatttcatctgtaccattttgtactcttaaatataattggttacctagttctk

SEQ ID NO: 7965 - DNA, 442 bp, Homo sapiens
cacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaagggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctgggccacttggtagtgtccc

SEQ ID NO: 7966 - DNA, 152 bp, Homo sapiens
cttgctctttcgcmcaggctggagtgcagtggcatgatctcagctcactgcagcgtctgccttccgggttcgagagattctcctgcctcagcctccagagtagctgggtctacaggcgtgtrccaycacgcctggctgattgtttgtatttt

SEQ ID NO: 7967 - DNA, 86 bp, Homo sapiens
ctttttcagcgcctgcagsttccgggaggycagctcccagccsabgacrtcggmygtcatcgtccttsctgcwttgccaccccatt

SEQ ID NO: 7968 - DNA, 330 bp, Homo sapiens
  misc_feature 253: n=a, g, c or t
taatgtatggaaattcaactaatttttggtgctgttattctattcttcaaatccactgcatatgttttttagttccagttgcattttggttgactctttgtgattttctacacagaagatcatgtcatctacaaagaaatagttttacttctttcwbtctgatttggatgagtttgatttctkktgckattkcawtgctctagctaggacagccagtattgattgaatagaaggggtgasagcarmhttgcancatgtgagatcctacaggaaaagcattccgwtttccctgactggwtatttctgctgtggtcatttcatggatggtct

SEQ ID NO: 7969 - DNA, 442 bp, Homo sapiens
  misc_feature 260,395: n=a, g, c or t
actcttaccaggaggcaggaaagctagaagcagagctagagccaacagcatgccttcctctctggggtcttggaagtaagggaccagacgaagaggagcagaagaccctctcaaaactcaggtcccactcaacaaggaagtgatccctaacacagaagacagtaggaggagctggtcttcctgattcacaggcagagataagtgattgaggatctgtcttaggggactctgggtggtgcctaggaggacctgcagagghntttctgcctctcagctcaggccagttctccagcgccctctgtggcggctgagagcaggccctctaaggaagagagctccgggcatagagagctcaggcctgcagcagagggagtgcagatgtgggggaagctgancctggagttaacaggctcagaccttaaagggggtagtctcacagcag

SEQ ID NO: 7970 - DNA, 67 bp, Homo sapiens
atctccctcaccagctgaaagtacgagtcggctcagcctggagggacccaaccagagcctggcctgr

SEQ ID NO: 7971 - DNA, 206 bp, Homo sapiens
caggtgaagaaactaaggaacagaggggttaagaagcttgcctggccacctgcagtggctcacatctgtaatcccagcaatttgggaggctgaggcgggaggatcgcttgagcccgtgaggttgaggctgcagtgagctttgattgcactactgcactctagtctggaccacagagcaagcctgtgtcccaaaaaaaaaaaaaaaa

SEQ ID NO: 7972 - DNA, 73 bp, Homo sapiens
  misc_feature 39: n=a, g, c or t
ctatctatctatctatctatctatctatttttgtccagntttcctggcttgtaattcccatagcccttgttac

SEQ ID NO: 7973 - DNA, 332 bp, Homo sapiens
  misc_feature 234: n=a, g, c or t
tcaataataggaattttaagagctcaaaagctgcttcttagtcaggtgcggtggctcatgtctataatcccagcactttgggaggccgaggtgggtggatcacttgagtgcaggagtttgagaccagcctggacaacgtggtgaaaccccatctctacaaaaaaatcgttaaaaattagctgggcatggtggtgtgcgcctgtagtcccagctacttgggaggctgagatghhnvggattgcttgggcccgggagatcaaggtgacagtgaaccttggtcatgcgactgtactccagcatgggcaatagagtgaaaccctcctcaaaaaaaa

SEQ ID NO: 7974 - DNA, 449 bp, Homo sapiens
  misc_feature 270,435: n=a, g, c or t
caggtgcctagtcttgagtgaattgttagatgtgcactgaactcgggatgttggggattggagagagagaattgccaaagtaacagcaaaaatatctcttactttgctttgtttataaataaatbagtagattggaaaaactagtgttagggaaagaaatcacatgttcagagcctaattcagtaggaagggcttttctctaccctgaaatgaaggtaatccaaaggcatccatwttctaggcttaaaagatatattthwgatatatttnatgatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgtngtgactgagagata

SEQ ID NO: 7975 - DNA, 424 bp, Homo sapiens
ctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgac

SEQ ID NO: 7976 - DNA, 270 bp, Homo sapiens
  misc_feature 135: n=a, g, c or t
acgtaatttacaataaccaccaggattcctccgcgtcgcctaggaaacgaccgggcgaaggactgccgcctcctccgagatcaaagccctgcagcagacccggaggctcctggcgaacgcagggagcggacgcgngtgcacaccatcagcgcagcttcgaggcgctcaggaagcaggtgccgtgctactcatatgggcagaagctgtccaaactggccatcctgaggatcgcctgtaactacatcctgtcccytggcgcggctggctgac

SEQ ID NO: 7977 - DNA, 172 bp, Homo sapiens
  misc_feature 95: n=a, g, c or t
caaaaaattagccgggcgcggtggcgggtgcctgtagtcccagctactcgggaggctgaggcaggagaatggcgtgaacctgggaggcggagttnkcagtgagccaagattgtgccactgcaatccggcctgggctaaagagcgggactccgtcccaaaaaaaaaaaaaaaa

SEQ ID NO: 7978 - DNA, 321 bp, Homo sapiens
cacaacccagattaattagtttaacatgctgagtgcagtggcacacacctgtaatcccagcactttgggaggccaagatgggaggatcacttgagcccaggagttcaagatcagcctgggaaatatggtaagacctggtctctacaaaaaattttaaaaattaagcatggtgtcctgtgtgtgtagtcccagctactcaggaggctcaggtgggaggatcacttgagctcagaaggcagaggctgcagtgagctgagatcatgccattgcactccagcctgggtgacagggtgagagtctgtctcaaaaaaaaaaaaaaaa

SEQ ID NO: 7979 - DNA, 170 bp, Homo sapiens; identical to SEQ ID NO: 7895

SEQ ID NO: 7980 - DNA, 73 bp, Homo sapiens
atgttagctgtggccactgtggatttttcgcaagaacattaataaactaaaaacttcaaaaaaaaaaaaaaaa

SEQ ID NO: 7981 - DNA, 72 bp, Homo sapiens
atgttagctgtggccactgtggatttttcgcaagaacattaataaactaaaaacttcaaaaaaaaaaaaaaa

SEQ ID NO: 7982 - DNA, 328 bp, Homo sapiens
  misc_feature 102: n=a, g, c or t
gcaaaacaagggcagcgggcccggcgcggtggctcacgcctgtaatctcagcactttgggaagccaaggcgggcgaatcacttgaggtcaggagttcgagancagcctggcccacagggtgaaactctttctctactaaaaatacaaaaattagcggggcttggttgcgggcacctgtaatcccagttactcgggaggctgaggcaggagaatcgcttgaacccgggaagcggaggttgtagtgagccgagatcgcgccactgcactccagcctgggcgacagggcgagactcccgtttcgaaaaaacaaacaaaaaaaaaaaaaaaa

SEQ ID NO: 7983 - DNA, 58 bp, Homo sapiens
tcgcacgagaccaccatgttggacaggatggtctcgatctcctgacctcgtgatccay

SEQ ID NO: 7984 - DNA, 422 bp, Homo sapiens
  misc_feature 277: n=a, g, c or t
atgttaactttctgtctcgttgatctgtctaatgttgacagtggggtgataaagtctcccattattaatgtgtgggagtctaaagtctctttgcaggtcactcaggacttgctttatgaatctgggtgctcccgtattgggtgcatgtatatttaggatagttagctcttcttgttgaattgatccctttactattatgtaatggccttctttgtctcttttgatctttgttggtttaaagtctgttttatcagagactaggattgcdacccctgcntttttttgttttccatttgcttggtagatcttcctccatccctttattttgagcctatgtgtgtgtctgcacatgagatgggtttcctgaatacagcacactgatgggtcttgactctttatccaatttgccagtctgtgtcttt

SEQ ID NO: 7985 - DNA, 113 bp, Homo sapiens
ttgtaaatwttgttgattattttaaagaacaaacttttgcttttrtgggtttatwtwtctcttttgttctagcctcagttttgtwatctctgttgtaatgtttatwttcttat

SEQ ID NO: 7986 - DNA, 163 bp, Homo sapiens
aaaatctaaaaattagctgggtgtggtggtgcatgcctgtgatcctggctacttcagaggctgaggtggamggatcacttgaggccaggagtttgaggctgcagtgagttatgatggcactgctgcactccagcctgcgggacagagtgagaccctgtctgaa

SEQ ID NO: 7987 - DNA, 312 bp, Homo sapiens
ctttccgctctcttgtgccagcggcggtggtgtggctgagctatggcgtggccagctcctacgtgctggcggatgcattgacaaaggcaagaaggctggagaggtcggtggatttcctcctggactccagcctgcgcaastctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagct

SEQ ID NO: 7988 - DNA, 171 bp, Homo sapiens
caaaaaattagccgggcgcggtggcgggtgcctgtagtcccagctactcgggaggctgargcaggagaatggcrtgaacctgggargcggasydrcagtgagccaagattgtrccactgcaatccggcctgggctaaagagcgggactccgtcccaaaaaaaaaaaaaaaa

SEQ ID NO: 7989 - DNA, 379 bp, Homo sapiens
aaatccactccccagtcctgcagggagagcctctgctggtctagcttcctccaagctccccctccacccaccactattcctcaggaagactcaagatctgggagatggaccaggcatttggaaagacctgaagaccatgggctctgtgtctctctctatattcttcatcacactgcttgttctgggtagacaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgc

SEQ ID NO: 7990 - DNA, 171 bp, Homo sapiens
caaaaaattagccgggcgcggtggcgggtgcctgtagtcccagctactcgggaggctgaggcaggagaatggcgtgaacctgggaggcggacttgcagtgagccaagattgtgccactgcaatccggcctgggctaaagagcgggactccgtcccaaaaaaaaaaaaaaaa

SEQ ID NO: 7991 - DNA, 519 bp, Homo sapiens
ctactgcacaagaataacvcagaaatacaatataaaggaagggtggatctactaaaatacattttgagaaaattgtctawkttbctggatgtaatgggagggracactggattgagagtcagaagatcattcctaccattatatgaagtttaagaattacmaawtttttgagctgggctgtgtggtgcatgcctcaactactcaggaggttaaggcaggagaatccctttagcccaggagttggagggcatcctgggcaacatagcaagaccctgtatcaaaaatcaggaaaaaaagaaggataaatttttaaactttactgcatgtttcttatttcatagtgattgctttagtaaacatttatgaataaagaatgaatttctgataagatatgtttgtagtgaacttcatttttatgaagccagttataagtaaatcaaatgtatgtaatacmaaattgracttwaaaaacctttcctcytattcycaaagtgttgtgtgagatgtaycyatatatct

SEQ ID NO: 7992 - DNA, 67 bp, Homo sapiens
ccaaaatggaaaggaaatgttctatgttgttcaggctaggagtatattggttcgaaatcccaaaaar

SEQ ID NO: 7993 - DNA, 185 bp, Homo sapiens
tacgaaaaaaaagttggccgggtgtggtggcgggasctgtaatcccagctattcaggaggccgaggcaggagaatcgcttgaacctgggaaggcggaggttgcagtgggccgggatcgcaccactgcactccagcctgggcaacaagagcgagactccatctcaaaaaaaaaaagaaaaaaaagk

SEQ ID NO: 7994 - DNA, 171 bp, Homo sapiens
  misc_feature 88..89: n=a, g, c or t
cagaacacagatgtgcagacatggccataaacaatcccacagatacaaacataccttagakdcacacaccasacacagacacatggannmacagaggtgttggtgttccctactctgaatccacaacttttccaatcaggagtttcctacccccctacacacactgattta

SEQ ID NO: 7995 - DNA, 436 bp, Homo sapiens
gagaccctcgcgaggtctgagagtcactggagctaccagaagcatcatggggccctggggagagccagagctcctgggtggtggcgccccgaggsggtagcttcagagvctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccatttgtctcctggacctgctgcctgactacctggctgccatagatgaggccctggcagccttgcacgtgacgctvcagttcccactgcaagagttcatcctggccatgggcttcttcctggtcctggtgatggagcagatcr

SEQ ID NO: 7996 - DNA, 171 bp, Homo sapiens; identical to SEQ ID NO: 7990

SEQ ID NO: 7997 - DNA, 176 bp, Homo sapiens
agttcgaggcgccgccgccgccgccgcagccgccggagccgcaatgcctaaaggaggaagaaagggaggccacmaaaggccgggcgaggcagtatacaagccctgaggagatcgacgcgcastgcaggctgagaagcagaaggccagggaagaagaggagcaaaaaaaaaaaaaaa

SEQ ID NO: 7998 - DNA, 429 bp, Homo sapiens
tgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgac

SEQ ID NO: 7999 - DNA, 68 bp, Homo sapiens
caaaaaattagccgggcgcggtggcgggtgcctgtagtcccagctactcgggaggctgaggcaggaga

SEQ ID NO: 8000 - DNA, 385 bp, Homo sapiens
aaaactgagtgcgctgagcggggaagcgcaaaggggcaagttacccgtcctggcgtttctggggttcgsctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagasgtgaaccacgccgtggaggaaacaagtcaccaagctctccagaacatgcccaaagtgs

SEQ ID NO: 8001 - DNA, 324 bp, Homo sapiens
caaaggaaacttttgtatagttatacattgcttaatgtttatacatacatccatgtagcatacttctaataatatctttaattatactagttattttaaaataacccacaaatactcaaggaattgttcagtttgtgaactgtgtgagaactacagtttttcatggtaacatttatttgtgtggtttttaaaagtgatcacaggacatctcctaaaagatamtatagttaagcagatttgcttagttaagatattaccaagagcatctagatgaataattagaataaatacttgtctcttggagacgattttgggtgtagtctt

SEQ ID NO: 8002 - DNA, 481 bp, Homo sapiens
tctccctgtggtcgtcttccacgttgtggaaggtttgttgtttcgcttcttgcaataaatcttgctactgcttgccgtttgggttcaggctgcttttatgagctgtaacactcactgcaaaggtgtgcagcttcactgctgaagccgttgagaccacgaatccaccgggtggaacgaacaactccagacgtgccaccttaagagttgtaacactcacctcgaacgtctgcagcttcactcctgaagccagcaagaccacgaacccaccagaaggaagaaactccgaacatatcctaaagtcagaaggaacaaattccgtatacgctgcctttaagaactgttaacactcaccgtgagctccgcggcttcattcttgaagtcagtgggaccaagaacccgccaattccggacccaggattacagggtcttgctctgtctcccaggctggagtacartggtgcgttcacagctcactgcagat

SEQ ID NO: 8003 - DNA, 481 bp, Homo sapiens
  misc_feature 76: n=a, g, c or t
tctccctgtggtcgtcttccacgttgtggaaggtttgttgtttcgcttcttgcaataaatcttgctactgcttgcngtttgggttcaggctgcttttatgagctgtaacactcactgcaaaggtgtgcagcttcactgctgaagccgttgagaccacgaatccaccgggtggaacgaacaactccagacgtgccaccttaagagttgtaacactcacctcgaacgtctgcagcttcactcctgaagccagcaagaccacgaacccaccagaaggaagaaactccgaacatatcctaaagtcagaaggaacaaattccgtatacgctgcctttaagaactgttaacactcaccgtgagctccgcggcttcattcttgaagtcagtgggaccaagaacccgccaattccggacccaggattacagggtcttgctctgtctcccaggctggagtacagtggtgcgttcacagctcactgcagat

SEQ ID NO: 8004 - DNA, 421 bp, Homo sapiens
actttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaaaa

SEQ ID NO: 8005 - DNA, 333 bp, Homo sapiens
mycgctgkyccccgcyccccttgcccctacccagccagtagtagttccccagcgtgcgcccggggagaccgggaacatggcgctgggagcstgtagcagctgagaaggggctgaggcaccgccgcttcgctgacagccggccaccagaaatacactgtggtgaaatgcttccacctcttgctaaaatgaacactgagaaaaaatgaagaagactgacaagcaccagcgaaaagttgcagaatagaaatagccacactcctctggagtctttaattcatccacagccatcatataaaggttttggcatcatgtttgggaaaaaaaaaaaaaaaa

SEQ ID NO: 8006 - DNA, 58 bp, Homo sapiens
  misc_feature 58: n=a, g, c or t
tgtctcaaaaaaaaaaaaaaaaaaaaaaaaaaaaaaaaaaaaaaaaaaaaaaaaaaan

SEQ ID NO: 8007 - DNA, 475 bp, Homo sapiens
tatataaatttatttcttactgtggatagcagttgaaaactttgaaacccagtggctttatgccatttctttatgtgactggaatgtaagattagggttaagttacataaggtaaagcctcagttgttgtctttcattaccttgaatgacaattcggtattgcaagatgttttctaaatataaaaataattgagcacaaaatatactctctgtttactagtggctctgtgagtaataaacttgtgagatttctgcttttaatgcttctggataaagcagctcttagctttttttgctactgtgaagaaggtttcctattcaaactagagatattttcttgagaatgtattttgtaaaagctagtgatctattagattgtgtaagatggttactatacgtgaaaacagaaagccacattattaaggctattacaaactacaaagatgtcatttattctttaattgatagaaattat

SEQ ID NO: 8008 - DNA, 435 bp, Homo sapiens
  misc_feature 238,399: n=a, g, c or t
ttatatgtggctatgcatattgaaaacttgggttctttttttggagacagggttgtacaggctgttgcacaggctgtattgcggtggtgtgatcatagctcactgcaaccttgaactcctgggttcaagtgatcctcctgcctcagcctcctaccaccccctgctaatttttgttattgttgttgttgttagagaatggggtctggctatgttgcccaggttggtcttgacctaaggncctcaagtgatcctcccacctcagcctcctaaagcactgtgaatttcaggcatgagcttgagttcttattaactgtcagcctgactggctctttcctagctaggctagtcagctcggctgaggagtcaagggaggctgaggcaggaggatcacttgaggsngggagtgcgagaccagcctgggcaacatggcgagac

SEQ ID NO: 8009 - DNA, 314 bp, Homo sapiens
acttcctgcgacgcccctgcagcagcagcagcgtggtcagagcgagcttctgagcggtggttcatctgcgttgctctwaaatgggactgtttcattattttgatggctgaagaatatttcctagtgtatgtatatgagagtttcttgatctctttatctgtggatgaacagctactttgaaatatatgatacatttgtgttaaggctagtcacgctgctgtggaatagaaggtcagaattgatcactatcatctgagagtaactttgtacccatcactgattccttccgagactgcctccamttccccagcags

SEQ ID NO: 8010 - DNA, 337 bp, Homo sapiens
araataattataacagttacatcttacatatcaggtgagatgtcatagttcagttcaggtagttttcgcgtggcagtgagttagkcccctgcatcagccagaaatcagacaaaaaacaagacaagttagaagtaccagtgggtgcaggattctttatctcaggacttttaagacctttatccatagagatcccaacattgttcakttgakccaagwrtagcacctatgcatgggataaaaaatagtatcacatctttgatttykctgattagttatttgggtcttgaaatgtccagtttatcagaaagtcttgtactgtcttctggggactatgtcc

SEQ ID NO: 8011 - DNA, 310 bp, Homo sapiens
catagtttacattagggttcactctggtgttgtgcattctgtgagtttagacaaatgtgtagtggtgkgtcktcawcawtawtagkktcatgcagagtagttttakkgacctaaaaatcctttgtgctcccctccattcccactaacccctataaacacggatctttttacatttctccatagttttgccttttccaaaatgtcatatagtagaaatcatacagtatgtaacctttcatattagtttctktctcttagtaatatacttttacattttctccatgtcctttcatggcttgatagctctttt

SEQ ID NO: 8012 - DNA, 60 bp, Homo sapiens
ctcagccgcgggtgatcgtagctcggaaatggcgggatttggtgctatggagaaatttty

SEQ ID NO: 8013 - DNA, 376 bp, Homo sapiens
  misc_feature 221..226,229,326..327: n=a, g, c or t
aagcgcctgggacgaarctgagatggggctgrggcggggcctgggggttcggggaagaggctgaagaggggtctcggaagaacccttgtgagcgagtgatcgcgggcsctgactacgtrcccggcacctttccggataaaagttcaaagctctccacgarggtgtgtcttctcaaggctcaccttttggtgsggagggaaaagcaattaaacascasccmnnnnnnvmnacggcgcaagavggtggtcggcaaagaccctgggaaatggggaagagcgagggtcagggcgcggtcgtttgagaggccggcgtctcgggacgtggmnnctcgggtgaggtctgagagttgggagggcccccgtcatgggcttacttc

SEQ ID NO: 8014 - DNA, 463 bp, Homo sapiens
  misc_feature 224,363,367: n=a, g, c or t
cacatatgtcaaggttcttgcacgtggtacccagtagtctgattagactgtcttatctcttcgtgggccagatacccaccttcatcatcctctgttctcctagtatataaacaggcctgtgatgagtgaatatttcttaggaggtccttggtttcgttgggtttacttctgtcagcattagccatcatcaagtcttgttcctgcccacatatgtgctggcavgnvttcacatacacatgtgggaatcccatcttgattttttctgctcataattctggatcacagttctctacaactggatgagatacactgatatattcaagaagccatatgcggtatgaatgcagtgtacagtaaatctgnaaanvaaagggtagtgggggtggaaagtaaagctacacagtaatttggtggtcagaaacaaatggcccatgcccacaagatcaccttcttggatagatgc

SEQ ID NO: 8015 - DNA, 329 bp, Homo sapiens
  misc_feature 9: n=a, g, c or t
cscgctgknscccgccccccttgcccctacccagccagtagtagttccccagcgtgcgcccggggagaccgggaacatggcgctgggagcgctgtagcagctgagaaggggctgaggcaccgccgcttcgctgacagccggccaccagaaatacactgtggtgaaatgcttccacctcttgctaaaatgaacactgagaaaaaatgaagaagactgacaagcaccagcgaaaagttgcagaatagaaatagccacactcctctggagtctttaattcatccacagccatcatataaaggttttggcatcatgtttgggaaaaaaaaaaa

SEQ ID NO: 8016 - DNA, 60 bp, Homo sapiens
cattttagcttttatgatggctgaagtctcaaatkckttctgctgtactatacgtacttt

SEQ ID NO: 8017 - DNA, 408 bp, Homo sapiens
  misc_feature 104,375: n=a, g, c or t
tagaaatataaaaagtaatagagtaaaataaaaacaagtcctatcagtagttataataactgtagtcagtatatttaacwraaagacatgctgatttgattaancccagctatactacattgtttacaagcatcatactaaaataacagtgtgaaagtaagtttaaagccacaagagatgcaaacaaaaagaaagcatgagtggaattttaattacaagggagatggagttaaggattaaaagcagtagacaggataaaggagcacattttgtaataggcacagtttatgggaacataacaaataaatgtaaagcctcccctaaaatagttaaaattcaagaaattcaacatggtaaaaccccgcctctattaanartacaaagattagccgggtgtgatggcatgcg

SEQ ID NO: 8018 - DNA, 103 bp, Homo sapiens
gaggttgagacaagagaatcacttgaacctgagaggcagaggttgcagtgcagcctgggtgacasagggagactccggccccctcccaaaaaaaaaaaaaaaa

SEQ ID NO: 8019 - DNA, 73 bp, Homo sapiens
gaggttgagacaagagaatcacttgaacctgagaggcagaggttgcagtgcagcctgggwgacagagggagab

SEQ ID NO: 8020 - DNA, 96 bp, Homo sapiens
gaggttgagacaagagaatcacttgaacctgagaggcagaggttgcagtgcagcctgggtgacagagggaagactccggccccctcccaaaaaaar

SEQ ID NO: 8021 - DNA, 121 bp, Homo sapiens
ctggacaaatgacttgaatagacagttctccaaagaagatatgcaaatggctcaacattattaatcattagggaacatttgtkrmtaattagkggtatctccacagtgagatatcacttct

SEQ ID NO: 8022 - DNA, 67 bp, Homo sapiens
gaggttgagacaagagaatcacttgaacctgagaggcagaggttgcagtgcagcctgggtgacagag

SEQ ID NO: 8023 - DNA, 58 bp, Homo sapiens
cttttgcgttctctttccctctcccaacatggcggcctcagcaaaaaaaaaaaaaaaa

SEQ ID NO: 8024 - DNA, 164 bp, Homo sapiens
ctggacaaatgacttgaatagacagttctccaaagaagatatgcaaatggctcaacattattaatcattagggaaccattgttaataattagtggtatctccacagtgagatatcacttcttacccattaggatggctataataaaaaacaaaaaaaaaaaaaa

SEQ ID NO: 8025 - DNA, 104 bp, Homo sapiens
gaggttgagacaagagaatcacttgaacctgagaggcagaggttgcagtgcagcctgggtgacagagggaagactccggccccctcccaaaaaaaaaaaaaaaa

SEQ ID NO: 8026 - DNA, 76 bp, Homo sapiens
acagttaactttaggaccatagccaaaagatagaaacagcataaacgccaaaataaaaagaagccaataaagataa

SEQ ID NO: 8027 - DNA, 163 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaaaaaaaaaaaaa

SEQ ID NO: 8028 - DNA, 103 bp, Homo sapiens
gaggttgagacaagagaatcacttgaacctgagaggcagaggttgcagtgcagcctgggtgacagagggagactccggccccctcccaaaaaaaaaaaaaaaa

SEQ ID NO: 8029 - DNA, 83 bp, Homo sapiens
acagttaactttaggaccatagccaaaagatagaaacagcataaacgccaaaataaaaagaagccaataaagataaacacaaa

SEQ ID NO: 8030 - DNA, 104 bp, Homo sapiens
gaggttgagacaagagaatcacttgaacctgagaggcagaggttgcagtgcagcctgggtgacagagggagactccsggccccctcccaaaaaaaaaaaaaaaa

SEQ ID NO: 8031 - DNA, 104 bp, Homo sapiens
gaggttgagacaagagaatcacttgaacctgagaggcagaggttgcagtgcagcctgggtgacagarggagactscsggccccctcccaaaaaaaaaaaaaaaa

SEQ ID NO: 8032 - DNA, 104 bp, Homo sapiens
gaggttgagacaagagaatcacttgaacctgagaggcagaggttgcagtgcagcctgggtgacagagggagactccggcccccctcccaaaaaaaaaaaaaaaa

SEQ ID NO: 8033 - DNA, 77 bp, Homo sapiens
gaggttgagacaagagaatcacttgaacctgagaggcagaggttgcagtgcagcctgggtgacagagggagactscs

SEQ ID NO: 8034 - DNA, 74 bp, Homo sapiens
aataatagctactaaaaagtaacaaggttgagaccagcctgggcaacataaggagaccccttcttcacaaaaaa

SEQ ID NO: 8035 - DNA, 104 bp, Homo sapiens
gaggttgagacaagagaatcacttgaacctgagaggcagaggttgcagtgcagcctgggtgacagagggagactccggsccccctcccaaaaaaaaaaaaaaaa

SEQ ID NO: 8036 - DNA, 58 bp, Homo sapiens; identical to SEQ ID NO: 8023

SEQ ID NO: 8037 - DNA, 104 bp, Homo sapiens; identical to SEQ ID NO: 8032

SEQ ID NO: 8038 - DNA, 90 bp, Homo sapiens
gaggttgagacaagagaatcacttgaacctgagaggcagaggttgcagtgcagcctgggtgacagagggagactccggcccccytcccaa

SEQ ID NO: 8039 - DNA, 65 bp, Homo sapiens
aataatagctactaaaaagtaacaaggttgagaccagcctgggcaacataaggagaccccttctt

SEQ ID NO: 8040 - DNA, 166 bp, Homo sapiens
ctggacaaatgacttgaatagacagttctccaaagaagatatgcaaatggctcaacattattaatcattagggaacattgkttaataattaagtggtatctccacagtgagatatcacttcttacccattaggatggctataataaaaaacaaaaaaaaaaaaaaa

SEQ ID NO: 8041 - DNA, 103 bp, Homo sapiens; identical to SEQ ID NO: 8028

SEQ ID NO: 8042 - DNA, 79 bp, Homo sapiens
actcttttcctccttaactatctaaaratavatcaccatcatmaacaacaccataactatccacactaaaaaattcata

SEQ ID NO: 8043 - DNA, 103 bp, Homo sapiens
gaggttgagacaagagaatcacttgaacctgagabgcagaggttgcagtrcagcctgggtsacagargkagactccggccccctcccaaaaaaaaaaaaaaaa

SEQ ID NO: 8044 - DNA, 150 bp, Homo sapiens
  misc_feature 150: n=a, g, c or t
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaan

SEQ ID NO: 8045 - DNA, 360 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagattaagtggccgggcacagtggctcatgcctgtaatcccagcwacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8046 - DNA, 104 bp, Homo sapiens
gaggttgagacaagagaatcacttgaacctgagaggcagaggttgcagtgcagcctgggtgacagagggagactccggccccctcccaaaaaaaaaaaaaaaaa

SEQ ID NO: 8047 - DNA, 71 bp, Homo sapiens
ctggacaaatgacttgaatagacagttctccaaagaagatatgcaaatkgctcaacattattaatcattag

SEQ ID NO: 8048 - DNA, 92 bp, Homo sapiens
gaggttgagacaagagaatcacttgaacctgagaggcagaggttgcagtgcagcctgggtgacagagggagactccggccccctcccaaaaa

SEQ ID NO: 8049 - DNA, 103 bp, Homo sapiens
gaggttgagacaagagaatcacttgaacctgagaggcagaggttgcagtgcagcctgggtgacagarggagactccggccccctcccaaaaaaaaaaaaaaaa

SEQ ID NO: 8050 - DNA, 103 bp, Homo sapiens; identical to SEQ ID NO: 8028

SEQ ID NO: 8051 - DNA, 132 bp, Homo sapiens
gcattttatagcctgcctagagagccaaccacatcacggcatcgtttcggtatcatttccttggaaaaatgtctggcagcctgggcaacatggcgaaatatcacttctctacaaaaaaaaaaccccccaaaa

SEQ ID NO: 8052 - DNA, 92 bp, Homo sapiens; identical to SEQ ID NO: 8048

SEQ ID NO: 8053 - DNA, 103 bp, Homo sapiens; identical to SEQ ID NO: 8028

SEQ ID NO: 8054 - DNA, 103 bp, Homo sapiens
gaggttgagacaagagaatcacttgaacctgagargcagaggttgcagtgcagcctgggtgacagagggagactccggccccctcccaaaaaaaaaaaaaaaa

SEQ ID NO: 8055 - DNA, 88 bp, Homo sapiens
gaggttgagacaagagaatcacttgaacctgagaggcagaggttgcagtgcagcctgggtgacagagggagactccggccccctcccm

SEQ ID NO: 8056 - DNA, 103 bp, Homo sapiens
gaggttgagacaagagaatcacttgaacctgagasgcagaggttgcagtgcagcctgggtgacagagggagactccggccccctscsaaaaaaaaaaaaaaaa

SEQ ID NO: 8057 - DNA, 57 bp, Homo sapiens
cttttgcgttctctttccctctcccaacatggcggcctcagcaaaaaaaaaaaaaaa

SEQ ID NO: 8058 - DNA, 191 bp, Homo sapiens
ttaagcatgttaacaaaaatagcaaaatatgawaataagctgggcatggtggcacacgcctgtaatcssaactastcgggakgctgasgcatgasaatcacttgaacccaggaagcagaggttgcagtgagccgagatcatgccgccgcactccagcctgggcaacagggcgagactctgtctcaaaaaaa

SEQ ID NO: 8059 - DNA, 75 bp, Homo sapiens
gaggttgagacaagagaatcacttgaacctgagabgcagaggttgcagtgcagcctgggtgacagagggagactc

SEQ ID NO: 8060 - DNA, 365 bp, Homo sapiens
  misc_feature 117,223,230..232: n=a, g, c or t
ctgttattacttgctctctgtcatatagttcacaaaacttacaactccttgccccactctgaccacagtgtctcttcgtgtttgawrkckacccactckactcccagmckacttmmnkctktgtacaagggaacatggaaagcacctggctgctctctgctactgctctaggagtcatggaagattatctgaggttatccagatgccctctgcctagacatgnkattchnnnwttkkatactctactgtgtttcactgatgtgcacaaatgcaaatcccagagtatataggaaaatgtgaatgatattkkkttccttttcatattagattttccatttagaattkkataacatacagataagata

SEQ ID NO: 8061 - DNA, 65 bp, Homo sapiens
aataatagctactaaaaagtaacaaggttgagaccagcctgggcaacataaggagaccccttctk

SEQ ID NO: 8062 - DNA, 58 bp, Homo sapiens; identical to SEQ ID NO: 8023

SEQ ID NO: 8063 - DNA, 335 bp, Homo sapiens
caaacagaattaccagataagccaaaaatactgcttctaggtatacgccctaaagaactaaaaacaggtgttcaaakwaaaacctcgkatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggargttgcagtgaactgagattgcgccactccactccagcctgggcaacagr

SEQ ID NO: 8064 - DNA, 198 bp, Homo sapiens
ttaagcatgttaacaaaaatagcaaaatatgaaaataagctgggcatggtggcacacgcctgtaatcccaactactcgggagggctgagggcatgagaatcacttgaacccaggaagcagaggttgcagtgagccgagatcatgccgccgcactccagcctgggcaacagggcgagactctgtctcaaaaaaaaaaaa

SEQ ID NO: 8065 - DNA, 165 bp, Homo sapiens
ctggacaaatgacttgaatagacagttctccaaagaagatatgcaaatggctcaacattattaatcattagggaacattgttaataatttagtggtatctccacagtgagatatcacttcttacccattaggatggctataataaaaaacaaaaaaaaaaaaaaa

SEQ ID NO: 8066 - DNA, 104 bp, Homo sapiens; identical to SEQ ID NO: 8046

SEQ ID NO: 8067 - DNA, 165 bp, Homo sapiens
ctggacaaatgacttgaatagacagttctccaaagaagatatgcaaatggctcaacattattaatcattagggaacattgttaataaattagtggtatctccacagtgagatatcacttcttacccattaggatggctataataaaaaacaaaaaaaaaaaaaaa

SEQ ID NO: 8068 - DNA, 104 bp, Homo sapiens
gaggttgagacaagagaatcacttgaacctgagaggcagaggttgcagtgcagcctgggtgacagagggagactccggccccctcccmaaaaaaaaaaaaaaaa

SEQ ID NO: 8069 - DNA, 84 bp, Homo sapiens
gaggttgagacaagagaatcacttgaacctgagaggcagaggttgcagtgcagcctgggtgacagagggagactccggccccct

SEQ ID NO: 8070 - DNA, 164 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaaaaaaaaaaaaaaaaa

SEQ ID NO: 8071 - DNA, 235 bp, Homo sapiens
  misc_feature 114: n=a, g, c or t
gctgggactgcaggcatccgccatcacgcctggctaatttttttgtactttattggagatcctggccaacatggagaaaccccgtctctacaaaaatacaaagattagccagcngtgatggcgggcaccggtagtcctagctactggggagactgaggcgggaaaatcggttgaacccagtggtggagattgtagtgagccaagatcgtgccactgcaatccagcctggcgacav

SEQ ID NO: 8072 - DNA, 104 bp, Homo sapiens; identical to SEQ ID NO: 8032

SEQ ID NO: 8073 - DNA, 177 bp, Homo sapiens
tttctttttacattgtgcctttatcagtttatggtatcagggtgatactagcttcatagtatgagttaggcaggagcccatcctcctcccattttttgaaatagtttcaatagaaaaaaaaaaaaaaaaaaaaaaaaaaaaaaaaaaaaaaaraaaaaaaaaaaaaaaaaaaaaaaa

SEQ ID NO: 8074 - DNA, 165 bp, Homo sapiens
ctggacaaatgacttgaatagacagttctccaaagaagatatgcaaatggctcaacattattaatcattagggaacattgttaataaatbagtggtatctccacagtgagatatcacttcttacccattaggatggctataataaaaaacaaaaaaaaaaaaaaa

SEQ ID NO: 8075 - DNA, 104 bp, Homo sapiens; identical to SEQ ID NO: 8032

SEQ ID NO: 8076 - DNA, 58 bp, Homo sapiens; identical to SEQ ID NO: 8023

SEQ ID NO: 8077 - DNA, 454 bp, Homo sapiens
tgtctgatttctttcactggtattttgtagttctcctcatagagatagttcacaaccttggttagacatactcctagtcattttttggggggtgtggctatttttaataggattgcattcttgatgatgtgkttctcagcttgaacattattggcgtttaagagtactgctgactgggccgggcacggtggctcacgcctgtaatcccagcgctttgggaggccaaggcgggcggatcacctgaggtcgggagttcgggagcagcctgaccaacatggagaaacccagtctctattaaaaatgcaaaattagccgggcgtggtggtgcgtgcctgtagtcccggctacttaggagggctggggcgggagaattgcttgagccggggaggcggaggttgtggtgagccaagatcgcactccagcctgggcaacaagagcgaaactccatcacaaa

SEQ ID NO: 8078 - DNA, 103 bp, Homo sapiens
gaggttgakacaagakaatcacttgaacctgagakgcagaggttgcagtrcagcctgggtgacagakggagactccggccccctcccaaaaaaaaaaaaaaaa

SEQ ID NO: 8079 - DNA, 96 bp, Homo sapiens
acagttaactttaggaccatagccaaaagatagaaacagcataaacgccaaaataaaaagaagccaataaagataaacacaaaaaaaaaaaaaaaa

SEQ ID NO: 8080 - DNA, 103 bp, Homo sapiens; identical to SEQ ID NO: 8028

SEQ ID NO: 8081 - DNA, 127 bp, Homo sapiens
cctgtaatcccagctacccaggaggctgaggcaggagaatcgctggaacccgggaggtagaggctgcagtgagccgagatcgcgccactgcactccagcctgggcgacagagcgagagtttgtctga

SEQ ID NO: 8082 - DNA, 102 bp, Homo sapiens
gaggttgagacaagagaatcacttgaacctgagaggcagaggttgcagtgcagcctgggtgacagagggagactccggccccctcccaaaaaaaaaaaaaaa

SEQ ID NO: 8083 - DNA, 170 bp, Homo sapiens
ctctttcccatcttggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccwtgtcagagg

SEQ ID NO: 8084 - DNA, 103 bp, Homo sapiens; identical to SEQ ID NO: 8028

SEQ ID NO: 8085 - DNA, 146 bp, Homo sapiens
ctggacaaatgacttgaatagacagttctccaaagawgatatgcaaatggctcaacattattaatcattagggaacattgttaataattagtggtatctccacagtgagatatcacttcttacccattaggatggctataataaaw

SEQ ID NO: 8086 - DNA, 164 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaaaaaaaaaaaaaa

SEQ ID NO: 8087 - DNA, 103 bp, Homo sapiens; identical to SEQ ID NO: 8028

SEQ ID NO: 8088 - DNA, 103 bp, Homo sapiens; identical to SEQ ID NO: 8028

SEQ ID NO: 8089 - DNA, 58 bp, Homo sapiens; identical to SEQ ID NO: 8023

SEQ ID NO: 8090 - DNA, 97 bp, Homo sapiens
gaggttgagacaagagaatcacttgaacctgagaggcagaggttgcagtgcagcctgggtgacagagggagactccggccccctcccaaaaaaaaaw

SEQ ID NO: 8091 - DNA, 72 bp, Homo sapiens
acagttaactttaggaccatagccaaaagatagaaacagcataaacgccaaaataaaaagaagccaataaag

SEQ ID NO: 8092 - DNA, 103 bp, Homo sapiens; identical to SEQ ID NO: 8028

SEQ ID NO: 8093 - DNA, 67 bp, Homo sapiens
gaggttgagacaagagaatcacttgaacctgagaggcagaggttgcagtgcagcctgggtgacagar

SEQ ID NO: 8094 - DNA, 114 bp, Homo sapiens
tttctttttacattgtgcctttatcagtttatggtatcagggtgatactagcttcatagtatgagttaggcaggagcccatcctcctccattttttgaaatagtttcaatagam

SEQ ID NO: 8095 - DNA, 67 bp, Homo sapiens
gaggttgagacaagagaatcacttgaacctgagaggcagaggttgcagtgcagcctgggtgacagak

SEQ ID NO: 8096 - DNA, 58 bp, Homo sapiens; identical to SEQ ID NO: 8023

SEQ ID NO: 8097 - DNA, 61 bp, Homo sapiens
  misc_feature 35: n=a, g, c or t
gaggttgagacaagagaatcacttgaacctgasangcagaggttgcagtgcagcctgggtb

SEQ ID NO: 8098 - DNA, 74 bp, Homo sapiens
acagtyaactttaggaccatagccaaaagayagaaacagcataaacgccaaaataaaaagaagccaataaagak

SEQ ID NO: 8099 - DNA, 377 bp, Homo sapiens
  misc_feature 327: n=a, g, c or t
agcttaggacaatacaaattctacacagagaaataggtagcattatgatgtaaactgtccccctcccaccaaacaaaaaccacatgggcctgtctttatcagagctattttattttagctgaatcattttgtagattgtagtacgtttccctgaattttattactcagaatcctttgaaataggccaggcacmwvggctcacacttgtaatcccagcactttgggaggccaaggtgggcagattactttaggtcaggagttcgagaccagcctggccaacatgacgaaactccatctctactaaaaataccaarattagccawrgwntgccggcacgtgcctgtaatcccagctacatgggaggctgaggcaggaga

SEQ ID NO: 8100 - DNA, 148 bp, Homo sapiens
tttctttttacattgtgcctttatcagtttatggtatcagggtgatactagcttcatagtatgagttaggcaggagcccatcctccctccattttttgaaatagtttcaatagaaaaaaaaaaaaaaaaaaaaaaaaaaaaaaaaaaa

SEQ ID NO: 8101 - DNA, 82 bp, Homo sapiens
acagttaactttaggaccatagccaaaagatagaaacagcataaacgccaaaataaaaagaagccaataaagataaacacaa

SEQ ID NO: 8102 - DNA, 58 bp, Homo sapiens; identical to SEQ ID NO: 8023

SEQ ID NO: 8103 - DNA, 58 bp, Homo sapiens; identical to SEQ ID NO: 8023

SEQ ID NO: 8104 - DNA, 55 bp, Homo sapiens
ctttttttcctttcsgctcggctgttttcctgcgcaggagccgcaggscgtaacc

SEQ ID NO: 8105 - DNA, 234 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatccc

SEQ ID NO: 8106 - DNA, 102 bp, Homo sapiens
gaggttgagacaagagaatcacttgaacctgagaggcagaggttgcagtgcagcctgggtracagagggagactccggccccctcccaaaaaaaaaaaaaaa

SEQ ID NO: 8107 - DNA, 95 bp, Homo sapiens
ctgctgggattacaggtatgaggtactgtgtccagccagaaaagattcttgatatgattttaattcttgtaaakkagttgagatttgtgtttttt

SEQ ID NO: 8108 - DNA, 72 bp, Homo sapiens
aataatagctactawmaaagtaacaaggttgagaccagcctgggcaacataaggagaccccttcttcacaaa

SEQ ID NO: 8109 - DNA, 147 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaah

SEQ ID NO: 8110 - DNA, 103 bp, Homo sapiens; identical to SEQ ID NO: 8028

SEQ ID NO: 8111 - DNA, 104 bp, Homo sapiens; identical to SEQ ID NO: 8032

SEQ ID NO: 8112 - DNA, 138 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaaaaaaaaaaa

SEQ ID NO: 8113 - DNA, 103 bp, Homo sapiens; identical to SEQ ID NO: 8028

SEQ ID NO: 8114 - DNA, 103 bp, Homo sapiens; identical to SEQ ID NO: 8028

SEQ ID NO: 8115 - DNA, 104 bp, Homo sapiens
gaggttgagacaagagaatcacttgaacctgagaggcagaggttgcagtgcagcctgggtgacagagggagactcccggccccctcccaaaaaaaaaaaaaaaa

SEQ ID NO: 8116 - DNA, 103 bp, Homo sapiens
gaggttgagacaagagaatcacttgaacctgagaggcagaggttgcagtgsagcctgggtgacagarggagactcsggccccctcccaaaaaaaaaaaaaaaa

SEQ ID NO: 8117 - DNA, 58 bp, Homo sapiens; identical to SEQ ID NO: 8023

SEQ ID NO: 8118 - DNA, 164 bp, Homo sapiens; identical to SEQ ID NO: 8086

SEQ ID NO: 8119 - DNA, 58 bp, Homo sapiens; identical to SEQ ID NO: 8023

SEQ ID NO: 8120 - DNA, 75 bp, Homo sapiens
gaggttgagacaagagaatcacttgaacctgagaggcagaggttgcagtgcagcctgggtgacagagggagactc

SEQ ID NO: 8121 - DNA, 76 bp, Homo sapiens
gaggttgagacaagagaatcacttgaacctgagaggcagaggttgcagtgcagcctgggtgacagagggagactcc

SEQ ID NO: 8122 - DNA, 83 bp, Homo sapiens; identical to SEQ ID NO: 8029

SEQ ID NO: 8123 - DNA, 104 bp, Homo sapiens; identical to SEQ ID NO: 8115

SEQ ID NO: 8124 - DNA, 58 bp, Homo sapiens; identical to SEQ ID NO: 8023

SEQ ID NO: 8125 - DNA, 433 bp, Homo sapiens
aggatgacactgagcctgtcgcagccacgttggggttccgcactgaagccaaaaggtttcgcgtctcccagcgtccccgaccggaagtcgcctcttggtctttgcgatctttttctctggctcaatttgggctgattccgtttgtgtccgcaattcctaaatcgagkttycttgaaaagagacactcgtcttaagggttaagacgaaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgscatgtattccagaaaggccatgtacaagaggaagtactcagc

SEQ ID NO: 8126 - DNA, 76 bp, Homo sapiens
ctttttcgcaacgdgtttdccgccagaacacaggtgtcgtgaaaactacccctaaaagccaaaaaaaaaaaaaaaa

SEQ ID NO: 8127 - DNA, 165 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaaaaaaaaaaaaaaaaaaaaaaaaaaaaaaaaaaaaam

SEQ ID NO: 8128 - DNA, 104 bp, Homo sapiens
  misc_feature 35: n=a, g, c or t
gaggttgakacaagakaatcacttgaacctgakangcagaggttgcagtgcagcctgggtgacagadggagactccggcccccctcccaaaaaaaaaaaaaaaa

SEQ ID NO: 8129 - DNA, 236 bp, Homo sapiens
aatgataattagtcgagaggatttgtgaaaagtaagaaccaatttttggtgctatttctgtttgttgttaggtaatttagaagccctatggtacctgattttgtgagtggttatttttatgaagagatgtagtaatggactttacgagaaaattgagagtatactgtccttgaattgagttgacctctctctgaaagagccaagaaataaaaataaaaccaaaaaaaaaaaaaaaa

SEQ ID NO: 8130 - DNA, 317 bp, Homo sapiens
atgaagtcttttgactaagatttgttctaatgggcccagcgcagtggctcacgcctataatcccagcactttgggaggctgargcaggcagatcacgaggtcaggagatcgagaccatcctggccagcgtggtgagaccccatttctactaaaaatacaaaaaattaactggttgtggtggcgcgtgcctgtaatcccagctattcgggaggctcaggcaggagaatcacttgagcctgggagtcggaggttgtagtgggccgagatcgcgccactgcactccagcctggcgacagaatgagactctgtcaaaaaaa

SEQ ID NO: 8131 - DNA, 463 bp, Homo sapiens
catcacgattagctcaacacaaaaatggatgagaaatagactgctaacagatttgtcatcagcaacactgaatgccagaagtyaakgggatcarcatcttcagagcttaaggaaaatttttgtacctagaatttcatagtaaggcagactgtcaagaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagag

SEQ ID NO: 8132 - DNA, 54 bp, Homo sapiens
aattgtgttcgcagccgccgccgcgccgccgtcgctctccaacgccagcgccgs

SEQ ID NO: 8133 - DNA, 352 bp, Homo sapiens
agatgactctcaaggataaggagtaacatttgtgatgacagaaatgctgccagtcaggataaagcttgagrattmmtaggacacaaaaggaaaaaactgaagcagcaggggcttagtccagctataatcaagacagtgtggtactgacataagaaaagacatgtagatcaatggaagattaagaagaatatagaaataaatccttacgtttatggacggagttaacaaaatgcagtgggagaacagtctttaaacaaatgctgctagaacaactggatggccacatgcaaaagaatggacttggacccctgcacctcacaccctgtgcaaaaattaaagtgtatcatggacc

SEQ ID NO: 8134 - DNA, 390 bp, Homo sapiens
agatactgtattctttctgctcttgttagtgccttatgtgatttgctccctggagaagtaccaggacaaraarscmraatyctttggaattacagaaagagamatgaagaaaaatgtgaatcccagatggagtctctctctgtcacccaggttggagtccagtggttcaatctcggctcactgcaagctctgcctcccaggtttacgccattctcctgccacagcctcccgaatagctgggactacaggtgcatgacacaaggcctgactaattttkkgtaattttagtagagatggggtttcactgtgttagccargatggtctggatctcccaacctcgtgatccgsccgcctcagcctcccaaagtgctgggattacaggtgtgagc

SEQ ID NO: 8135 - DNA, 441 bp, Homo sapiens
taaacataaaattaccatatgatccaggctttctacttctgattatagacccccaaaaaagtgaaagcaaaaamctgraacagatagttgtacatccatattcatagcagcagcattcgcaataatcaaaagaaagaagcaacccaagtgcccataggtggatgaataaacaaaatgtgtatacatacagtggaatattattcagccttaaaaaggaagaagattctaatgcatgttacaacatggatgaaacttgaagacattatgccaagtgaaacaagacaatcacaaaagggctgggtatggtggctcatgcctgtaatcccagcattttgggagaccaaggcaggaggatcatgtaagcccaggagtttgagaccagcctgggcaacatagtgagacccacacacaagaaaattggccaggcatggtggcgtgtac

SEQ ID NO: 8136 - DNA, 528 bp, Homo sapiens
ccattgcagcaccattccaatccaaaacaacagtgaaggcattgaagccttctgtgtctttttaggaagagatggaagtgaccgtcttgttcctcttccaggctctccttttctggttttgtccttctgtaataacaatttaaaccatttttcttttcttttgtttttcaagtaatcttagcagacaaagaaattctcttcagtctttcgttcaaggtattgctgtggttatgtgtgtttaaaatccttaatttactgatcatcccgaatcataattgtgcagtttctgtctcaaaaaaaagaaaaaaaaaagaattatacaaactgttagccagttgattagatacagtactgcwagaatgcyctttcccccagaatgtaatcattatgagattcaaggaccttgcctgtkgttgttcctctwacgttctccagaggtacaggagattcatgctaaatagtctgataaatcaattatggttataaggaagtgtataagattctatgaggccaggcatggtggctcam

SEQ ID NO: 8137 - DNA, 243 bp, Homo sapiens
acctactgcctggacctcttctctatcacaacaggttgaagtctttaaggcctctgtcagatggtagtttgtgacattttcttcataccacagaatttgtaatttccttgtgcttctaaggtgttttggaccatggttggagtacaagttttactatattgtcttgtgttgtagttaagtccatatatattcaacttcactaaactataaattccatatgtcagtgaatcacctagaattttk

SEQ ID NO: 8138 - DNA, 368 bp, Homo sapiens
cagggttgtwaggcaactcttaactgacaatatagttagtatattctgggccttcatcttcaaaattagtaggtagtatttattgagtgcatatcatgtgccaggcctggtgctgagtgcttacaatgatcattttatatatgggaaaattgaggctcagcagggtcaagtgccttgtaagaggtagcactagtaagtaacagtgctcaaattcaactaggtcttgtcagctttttaagcgtctgtcccactgactaccatatctctacaagagaatagatgaggaattgaggttatgtgggaagtacgtgtaagtttacagtattaagaaatgtacaataaaatttgtttctatgtcagcgtataaa

SEQ ID NO: 8139 - DNA, 63 bp, Homo sapiens
ttgtaaatactgcttgaccgtactctcacatgtggcaaaatatggtttggtttttcttttttt

SEQ ID NO: 8140 - DNA, 407 bp, Homo sapiens
agtatttagaagtcaaatgcttcgtttttaataggaacttacacagtcttttatgtttttttatagccctcaatgtcactgatgtggattctcccaaactcgatactttgtttgtttttatgtccccataataagtctttaagaaaacagggcaagtgagctcaaaatcaaaagaaaacccaccaacagtgaatgcattcagggctatttccaggtctttcttttgaagaaagataagactcagtccagagagcacatcttgacacaccgtgcctcttgcctttggtgcgtggcagtcatctttggctcatgctgtacattattctacattagaaaactcactgtatgttgctaaataattttttgaaaacaggcagattaataaatggacatcttatttattgcaa

SEQ ID NO: 8141 - DNA, 390 bp, Homo sapiens
agctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtcagtgagaaggtgcgcatcgcttgggggtggatgtgggtatcagaggtga

SEQ ID NO: 8142 - DNA, 393 bp, Homo sapiens
cattttctttatccattcatctgatggacacttaatttggatccatatctttgctattgtgattagtgctgccttaaacatggcagtgcaggtatccctttgatagactagtttcctttcctttggtacctaattttattagtggcttcacatgtgccaggcactgcacttggtgctttttgcattgtcccatttaatcctcccagcagttttgcaagatggataagaattatcttttatgttttacaaataagggactaataggaactgaagctttgagagatttggaaacccaaagttacgtggctggaagtggcagactgggatttgtctgaacccagatctttatgacaccaaagccgatgctcaattatgagcatttttgcttgctta

SEQ ID NO: 8143 - DNA, 499 bp, Homo sapiens
accatccatccccgagggaccaggaggttgcggaagtaaacaccgatgactcccagatctacagctccaggctgttcccttctccgtgtctcatatcagatttgccaactgtttattggacatcaccgcctgagtatccctgagggacacgattatcctgtttggagtgtattgaacttcttggatacatcgattagtgtctttcctcaagtttgagtaatttgcagtcatttttcctttgaaaattctttcttctctattctgtttctctccttgttgaacccccatcatgcataggtgtgctctgttcatttttcacattacttttatttttctgctcctcggactgaataatctcaattgacctattttaagttcactgattcttttgcctgcccaaacctactgttgtacccctctagtgacttttagttattgtacttttcaaataaagaatttctatttattttataaaaaaaaaaaaaaaaaaaaaaaaaam

SEQ ID NO: 8144 - DNA, 537 bp, Homo sapiens
ttttttttccaccttaaaagtaacaccaggaaactattgtgtaggaactgagactacataaatcattacacagggataagaccaatctcatctgcctcctgcaagaaataccatctttgtgcttgttcagactcacttgaaatagcttttctctttgtttttgtttgatttttatacctggtttatgagtactaaacatccaaaaggcaaaaaagttaacagatttaaatattaaaaaacaaaaacagcctgggtatggtggcgactcaggaggctgaggtgggaaggtggcttgagcccaggagtttgagaccagcctgggcaacatggtgagactcctctctctaaaaaacaaacagggaccaggtgcggtggtggctcatgcctgtagttccagcactttgggagcctgaggcaggtggatcacatgaggccaggagttcgagacgggcctggscaacatggtgaaactctgtctctaccagaaatacagaaatcagccgagtggtggtgcacatctgtggtccaggtactcag

SEQ ID NO: 8145 - DNA, 266 bp, Homo sapiens
attcacactggctgatatggcaacaaggctggtggccgcgcggctgatggtccgcaatgcagcagtggctctgcaggaggagaggaaggatgcagtggccttgtgctccatggccaagctctttgctacagatgaatgctttgcvatctgcaaccaggccttgcagatgcacgggggctacggctacctgaaggattacgctgttcagcagtacgtgcgggactccarggtccaccagattctagaagagctgktctggcaggggc

SEQ ID NO: 8146 - DNA, 455 bp, Homo sapiens
tcttcttgacacatggctctttttaaatgtatgttatttaattcctaaatatttggggattttgcttatctttctggtagtttctgcaataattccattgtggtcagagtacattaagacttgaattatttacatttattgagatttgctttgtggcccagaatatgggctatcttggtatgagttacatgttcacttgaaatgtatactgtactctcgtttgatgaaggggttctacaagtgttgattaggtaaaaatggttgatgttatttaagttttttctatctttattgacattctgtggttttggttccagcaattattttaagaggattgttgacatctctgaatattaaattggatttacttctctgcagttctgtcagattttgcttcacatattttagtatgtttttattaggtgaataataaatatttcctattttatgtccaa

SEQ ID NO: 8147 - DNA, 503 bp, Homo sapiens
cagtattcttgggagtcagtgttatgtgtttcagcagagtattattttgtatatgtatgccattttctccctgcaaagcagctcaacaagagaaaaagctctagttatagggcttaaattgatttctatttcaaataatttcctaagagattctagagtagaactgaagagtattctattggaaaagtgaaaggaaagaaatgtaattttctttgaacatgaaaaagaaaacaactttgagagtagtcatttagcagtagatgtgcattattatgagaaaacagttctataagtccagggttaattatattaattggaatgtcagtctttaatgtcgagcttattgtagggtagaaaagagctttctactcagctaacgattactcattgatccaaaacttaaatacatctataatttcctggggctattgtgagtactgtgtatgtatttagcaaatatttaagacctagtaagtgctcaataaattgtagctgttaaaaaa

SEQ ID NO: 8148 - DNA, 460 bp, Homo sapiens
gtccttagaacagttctgtaagaggctgggcaggccaagccaggcattcccagttacaggtggtgacttcaaaatccagagcaggcagggcatggtggctcacacctgtaatcccagcactttgggaggctgaggtgggaggatcgcttgagtccaggagttcaagaccagcctcggcaacatagtgaaaccccatctctactaaaaataaaaaaatttggccagactccgtggctcatgcctgtaatcccagcactttgggaggtttgaggtgggtggatcacctgaggtcaggagttcaggaccagcctggtcaacctggtgaaacctgcctctactaaaaatacaaacattagctgggcgtggtggtgggttcctgtaatcccagctactttggaggctaacgcaggagaattgcttgaacctgggaggtggagcttkcagtgaactgagatcacac

SEQ ID NO: 8149 - DNA, 428 bp, Homo sapiens
tcamaaattgattgttatacttacacattaggtataatttatcatttatctgaaatcacatgtagcagattgcatagtctgtaatcctctcagagggaaacttcttgtttaaacagctctatatggatttatacttktatatttataaatbtataacttcatacaaatttataaacatttctttataaattgtaatttaatagattatctcagaaaaacctctctgaatgatgacccttccttaatactgggtgatgtgygaatatttgtttgttggcagacagggkctcactttgtcacccaggctagagtgcagtggtgcaatctcagctcactgcagcctctgcctcctgagttcaagtgatcckcctgcttcagsctccctagtagctgggactacaggtatgcaccaccatgcctggctaatk

SEQ ID NO: 8150 - DNA, 412 bp, Homo sapiens
gtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgcaaaaa

SEQ ID NO: 8151 - DNA, 160 bp, Homo sapiens
tcactccatcttgatgagagttggtgtttgtgggttatttgtgaagccggaaagaagccgtgtcctggagaatgtagctgaaggcctggccactttcgacaagaacgggaaagagacgactaacttgtactaatatcttagtgcytggcagggcattttt

SEQ ID NO: 8152 - DNA, 165 bp, Homo sapiens
agaaccaggaaggcgctgagcttaaactgaagcaagttcggtggacgccggcggsyyctgatctaaagaaacgactcagggactgcggcgcttgcacgtcaacgggaggtgtgagcccaaaggtctggacccagaaatgggacgtcggtcatcagatactgaaga

SEQ ID NO: 8153 - DNA, 111 bp, Homo sapiens
araagaataaggaagtcagaggttacatcttcttaaggtgtggaaatataatattttcctaagaaactatttaaactakckcttktkkgtaaatggaagaagcagaacaca

SEQ ID NO: 8154 - DNA, 395 bp, Homo sapiens
tacttctagaacaggagctaggcctcccgaagcctttgcatgttaactaactaatcaaggggctccagcctgttgggctcacattgcctggtctttactcacttgactttccacaggcctcgctcttgaaaactgaaattgctgcatggcattcattacacacacgtatgtatatatgtgcatatgaaaatacatttgcataggtacctatccatatgtatatacacacatacacacgtttttcctcataaatgaaactggattaaattttatttccaatattcaggtgactcttaaaactgaggggaaaaattggggataaaaagcaggacaaggcaataattatcctgkagcttatctcaaaatggraatttccccaacaacattagttctaa

SEQ ID NO: 8155 - DNA, 445 bp, Homo sapiens
aggctctgcggagagcggctgccactcgcctgtttttttcttgagacctagtctggctctgtggctcaggctggagtgcagtggcgtgatcaccgctcactgcagcctcagbmtcctctcgcctcagccgctcggtagctgggaccaccagcgggcgccaccactcccggctacatttttttgtatttttagtagagacgtgggtctcgccatgttggctaggctgctgccgaactccggggctcaagcgatccgcccgcctgggcctcccaaggtgctgagactgcaggcatgagccaccgcgcccggccgagagcvtcttttggctcctcctttcgcctttccggggccaggcgtgtgcagctctgtgaagggtcccctccctctgcgggacgtcctcgctgccgargtcagargcgcggagaacatgagaccgaggtctcaa

SEQ ID NO: 8156 - DNA, 407 bp, Homo sapiens
  misc_feature 309..311,407: n=a, g, c or t
ttaaatgtattatgttagaatgatagctgtagaccggaaatggccacacttatttaaaccaaaaagtgtagagaacattacatgttcatcttaatacaagtgctgtttgttttagaagggttatcatttgaagtatagatctaagacattttagaaatattcatgtaaaaggatcaaaaattgctttgggggctgggcacggtggctcatgcctataatcccagcagttagatagagaggcctgggcgggaggaacacttcagcccaggagttggagactaagctgggcaacatggtgaaactccgtmnnntctgcccaacctcccccaccgccgcctccccgcccaaaaaaaagctgtgcgtggtartgtgtgcwcttgtggtccagctgctcaggaggcttgagn

SEQ ID NO: 8157 - DNA, 69 bp, Homo sapiens
ttgtgttcgcagccgccgccgcgccgccgtcgctctccaacgccagcgccgcctctcgctcgccgagct

SEQ ID NO: 8158 - DNA, 56 bp, Homo sapiens
aaattcaattgtgttcgcagccgccgccgcgccgccgtcgctctccaacgccagcg

SEQ ID NO: 8159 - DNA, 396 bp, Homo sapiens
agattttgagagcagccagtccagactgcagcaaggggagagagagctccaggaaggatatcttccaaaaaagggtttacgctggcagaacatatggagaggagatttscatttctgaagcagggtttgggatgatttcagtagaggtaaggagtctcctcctatccgtggggatatgttccaagacccccagtggatgcctgaagccacagatagtctgaaccctacatatactatgtttcttcctatatgtacagacctgtgataaaatttaattaggcacagtactcttggggccattattaagtaaaataagcgttacttgaacacaagcacagcgataactgcaacagttgatctgrtaaccaagatggctactaagcaaccaatgggcag

SEQ ID NO: 8160 - DNA, 377 bp, Homo sapiens
  misc_feature 140: n=a, g, c or t
gacttggatgtgaactgtcttcagaataatttaacctaaagcagagcaagaagagaggaagcgggggtagtgggtggggggtaggggaagaaacattatctcctcttgtacagagtctatttcttgtaaccatttgttangctcttttctttttctgatctcatggcatgcttttatgtattttgtacaggaggcaaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgttttttactggtatttcaaaaaaaaaaaaaaaa

SEQ ID NO: 8161 - DNA, 385 bp, Homo sapiens
ctactgaagaaaacacctggaaatacaaaaaatgtggcaaaacttgtaaccaatgcttagcatttttgcacatgatagtatttatatgtgagactacttgtacaaacataaaaatatacaaaagctattgtctacttgaaatttatagttaataaaagcattataaatgtaattdctgttgadagaccttttagaaaatataggccattaaagtgaagaatagtcttaagacagagaatacaaagataaagagggctctagtacctgtacttgtatcccagaacttactatatgcattttgtactagaggaaaactctgaagcagttgcttaaactttgttcaacatcagagaatttatattggagagaaatcctacaaatgtaa

SEQ ID NO: 8162 - DNA, 367 bp, Homo sapiens
tatgactattaccagttcttggtttatcttatgagtaagtatacatttacctctttgggaagagccaaaatcttcaagcaaaagacacatagttatgtgtgtgtatatatatgtaccacacacacacggattaaaacttcttatataaaatcactgtagtagacacaagagctctgataggtaacatgctattaaaaagaataacattgaggccgtgcacggtggcttacgcctataatcccagcactttgggaggccgaggtaggcagatcacttgaggtcaggagttcaagaccagcctggccaatatggtgaaactccatctctactaagaatacaaaaattagctgggcatggtgatgcacac

SEQ ID NO: 8163 - DNA, 153 bp, Homo sapiens
tatgttcacataggaagcactagtgtagagaaatagggtctgagggacaaggagcctgtgtgcccgtgtcggcagccgagtaactgccaagggtcccctgcttggcamtctgctgtccsacttgcttyctgccytctctggattctaacactk

SEQ ID NO: 8164 - DNA, 385 bp, Homo sapiens
  misc_feature 145: n=a, g, c or t
aggggagtaatagcttgctgaaaaacatgccaactgagttatgggtcttcacgcagccagcatgctgtgttttgggctctgctcttgtaatttttagaaattaattagtttatyctktatktatatttatttatktatttatdtncagatgggatcttactctgttgcccaggctggagtgcagtggtgcgatctcggctctctgcaacctccgcctcccaggttcaagtgattctcctgcctcggcctcctgagtagctgggatttcaggccatgaaagatcactgttttagtctgcgtggtgcagtggaacagatagacctcggtttgaatctcagctctactgtttactagacgtgaaatggggaaatctaaaatgagatgc

SEQ ID NO: 8165 - DNA, 89 bp, Homo sapiens
cgtaccccagactacttcctgtaatgaaattttaaacttgtacagtattgccatgaascatatatcgacctaatggaaatgggaagagc

SEQ ID NO: 8166 - DNA, 325 bp, Homo sapiens
tggcacatgcaggactttcctgtgtaaactagtttaattttgatgataattaagtgttgtggtgattgagagaagtcttacatttggatataatatttatgtgattgaawtttyccatggatttcttcatattattktctatatctcttatattattcaaagttaattaagaagtttttaaaaagacgggtgcagtggctcacacctctaatcctagcactttgggaggctgaggtgggaggatcacttgagcctaggagtttgagaccagcctaggcaacatagagagaccctatctctacaaaaaagaaaagaaaccagctag

SEQ ID NO: 8167 - DNA, 433 bp, Homo sapiens
tacatggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaaaaaaaaaaaaaa

SEQ ID NO: 8168 - DNA, 423 bp, Homo sapiens
tttatcacgctattttctaagaattttatcttttgttattgttataatgggatcttctgtgaaacagggtacttagaaaagaataaagataagacacacagaagcactttacttgaatagctttttcctttttggagcccactgaccaaagatgagaaatatccctgtaataaaaagatgtgtttgtttagcttaggtggctgcaggcagggaggatgcagtcctgaggagccccaggagcactgtggaaagggggaggtggggctgtagtagggttggggtgtgtgttagatgactcttaagagggagtggcatcatgaggaggggtggtcctcaactggctgctctcaagaagctgggggtacttttgtgattaggtattttaatttttatctaggagacaggaggattgaagtggggcag

SEQ ID NO: 8169 - DNA, 418 bp, Homo sapiens
cataaaattcactgttgtacatactgtactacttaatataataatttcatagccaattcttcttgctattgctgtgagctcaagtgttgcagatacacgcttaaaatgctatgtgatgctaatcatctccacataagcaatttgtctctctggtaagttggatgtagcagtaaaaagtgatcacttgtggttcttgtgtatttttcatcatgttaagtggaatactgtaaagtttgaataacaccatggcacccatatggagtgccactaatcatgccagaagtgctcccaagaagcagagagaagtcatgacattagaaaaaaaaagttcagttccttgatatgtactgtagattgaagtctgcagctgcagttgctcaccatttcaagataaatgaatacagcataaggatcataa

SEQ ID NO: 8170 - DNA, 399 bp, Homo sapiens
attcttctacatgtggcttgccaattatctcagcaccatttgttgaatatggtatcctttccccacttttatgtttttgtctgctttgtcaaagatcagttggctgtctggttttacttgtcaggagggactgaagaaagcacaggacgtaagttcctccaagagcattcttggagcagcatctcatcgctgtccttgggtgtagcctcccttttgtgaggttcactccctcagctggaggatgaaccacagtgctgctgcagacctagctgatgtcacagttgttcaaaaggttcctcttgaagaatgaaatccttgggctgccattaggaactgcatgcagttaagccgtataacctctctgatttttagtttctccatctattttataaaataaaa

SEQ ID NO: 8171 - DNA, 56 bp, Homo sapiens
aattgtgtkcgcagccgccgccgcgccgccgtcgctctccaacgccagcgccgcck

SEQ ID NO: 8172 - DNA, 72 bp, Homo sapiens
attcttctacatgtggcttgccaattatctcagcaccatttgttgaatatggbatcctttccccacttttaw

SEQ ID NO: 8173 - DNA, 425 bp, Homo sapiens
ttttcatcctctgtttggtgagcatgtgttctggcatagtgaactgttttgtttttatttatttattatttttttgagacggagtttcgctcttgttgcccaggctggagtgcaatggcatgatcttggctcacctcaacctccgcctcctgggttcaagcggttctcctggctcagcctcccgagtagccggaattacaggcatgcaccaccacgcctggctaattttgtatttttggtagtgacggggtttctccatgttggtcaggctggtcttgaactcccgaccttaggtggtctgcctgcctcacgcctgtagtcccggcactttggggggccggggtgggtggatcatctgaggtcgggagtttaggaccggcctggccaacatggtgaggcccgtttctgctagaatacagaaaatg

SEQ ID NO: 8174 - DNA, 444 bp, Homo sapiens
ttaaatgtatgcactaaacatatataaaaatattcattgtaattttktacagttgtttagaaattagaaacaatattaaatgtttatcaacagakccgcatatacattaaaagattgaggaagaagttgcgaaaagagacatataagaagatattcttgatatctaatcaaaacctacaaaacaggccgggtgtggtggctcatgcctgtagtcccagcactttgggaggctgaggtaggtggatcgcttgaggtbwgaagtttgagaccggccggccaacatggtgaggccctgtcactgctgawaatataagaattggctgggcgtggtggcgcatgctgtaatcccagtacttgggaggctgaggcaggagaatcacttgaacccgggaakgggagtttgcagtgagcagagattgcaccactgcactccagcctgggcaa

SEQ ID NO: 8175 - DNA, 403 bp, Homo sapiens
taatgataataatttgtgttcttaaccaacagagaaagggtgtttatagtactgttattcatggtgcaacagcatttcctggcacacaaatcaaacctctcctgtttgcctttggagtgckgtggcctttggcgagaagccaggtctgcccacagccccaggctctgtcctttctgcctgtgcaaggtgggagccggatattagagaagacttggccaggggctctgagcagagagctgtgctgggaaccctcaggacccctatccactccagcttcctaagatgtgttagctgcatacctctgggtgagaaaacgggcagaggaagagtgactttccgaaggtgatgcgaaccaccagctcttacagaggggagatgccggatcacgsctctgggtgtgaga

SEQ ID NO: 8176 - DNA, 386 bp, Homo sapiens
gatacataggaagatggaattagaccatctcggaccaccaggtttacaattccacctgcagatacatgcaagaagtattgtcacaatacttatgtcacgttattccgttgaggtcatcaccaactaagcttataattaatgtgtggtcaatttggtcaatgtcaccagcgtagatactaacaaaaacaagggttgcaaagtcaaatgcctataaggcagaacgtaagacggtaggaagcaaagtctatagggagctatataatagaggctgcagattcatggcagattctaaagcacagcagtccccaacatttttggcaccagggaccggctttgtggaagacaatttttccacaggcggcaagggatggggcgcaggatggtaa

SEQ ID NO: 8177 - DNA, 438 bp, Homo sapiens
ctatattcatagcatctttcatatccttaaagattctatgtacttttcagcacattgttctgtttcaaggggctctgcaaagtatacttgctgtctgtacatttccactgcgaaaactccttgaaatcatgtagacaaatgaaagctaaacatcaaataaataacctaaactggtaatactcccatttggctctcctttgtgtcttttcatgkgggktaacycythmaaccggdtcagcatataaattgagtatgtatggttatatggtgactttcaaaagtaaatactttttctgtggaacaaaagagatggatttgtggttttccaggattccttttccctgacttggtagaaagatagccaggcatagstcagcagacctgaaaataggtgagctgtcaagttgttggcagggagaggctcctctgggtgggact

SEQ ID NO: 8178 - DNA, 298 bp, Homo sapiens
  misc_feature 107: n=a, g, c or t
cattcattgtaacaataagagggctgagcgcggtggctcattcctgtaatcccagcactttgggaggccgaggtgggcggatcacctgagatcgggagttcaagacnagcctgggccagcaggctgaaaccccgtctctactaaaaatacgaaaaakkagctgggcatggtggcgcatgctgtdrtcccagctactcgggaggctgagtcaggagaatcacttgaacckgggagacagaggttgcagtkagccgrgatcacaccactgcackccagcctgggcaaaaggagtgaaact

SEQ ID NO: 8179 - DNA, 292 bp, Homo sapiens
ggaaacatttctaggtccgagccagcggcctaactggagtgtgcgcattcgaccgagcacagacacgttgcccaccgctcctctcccgaggtctgtagtcgcggagaaacacatgttgcgttactaacgttcagaggtctgcgacasttcgatttgaatgactagccgggaacaccaagtkkcactgtgtaattgcgtccccctactccggcgcctyckttkssrackctccckggagaaaagcacgcccactgcacgcgctcagtcgctacttccgctctcgagtgtctcc

SEQ ID NO: 8180 - DNA, 153 bp, Homo sapiens
  misc_feature 99,103,128: n=a, g, c or t
tcgatactttaaaaagattcatgcttaavaaataataataggccgggcgcggtggctcacgcctgtaaaaatagataataagttacacagatagaaganaganacagagaggaaggaaagahggaagnhaggaaggaaggmaggaaggaaggm

SEQ ID NO: 8181 - DNA, 352 bp, Homo sapiens
aattactttaagctcatgtttaaacaatattgatgttttcctccttgtatagcccaagaagattccagtaatttcagcatcaaataactgttttaaatgaacttaaaatkkgccttggcaammtatcatgaaaatagttaatatgctgcacaaaagcaaaatcatagtacactcctgagctaaatagaagcaatattttgattagatgcattggtyttyattctcttgtggattttgtgaaaatgttatcaaackkgcctgtgcaggtgagttttarcatgcgagccagaggatctcatttctttagtgtggtttatttcgggaaattagatgamtaataagggcataacag

SEQ ID NO: 8182 - DNA, 70 bp, Homo sapiens
caaagcaatattggggaattgatttcacagttcgttaccttagtaggtaacggtaaggttattctctttt

SEQ ID NO: 8183 - DNA, 347 bp, Homo sapiens
agaactctagaacagtgttagatagtattgctagtagtgcccaaacatatcttattcttacctttaacacaacaacttagtattctgcaaagatcctgcagaagtacagtcatgtattgctttaagatggggataccttctgagaaatttttcattaggtcatccaggcacggtggctcaggcctgtagtctcagcactttgagaggccagggtgggtggatcgcttgagttcaggagttcgggaccagcctggttgacatggtgaggccccatctctactgaaaatgcaaagattagctgggtgtggtggcacacgtctgtggtctcagctactcaggacgctgag

SEQ ID NO: 8184 - DNA, 382 bp, Homo sapiens
  misc_feature 192: n=a, g, c or t
ctagcataggccagttcatggaaccagaaagaagaggttagcaagggctggggagatgggcagttaatttcttaataggaacagagtttctatttggatgatgaaaaagtttggaaatagatggtagtgttggttgtacagcattatgaatgtaactgataccactggattgtacacttaaaaatggttaanatgggccgggcgcagtacgcctgtaatcccagcactttgggaggccgaggtggacggatcacaaggtcaggagattgagaccatcctggctaatgtggtgaaaaccaatctctactaaaaatgcaaaaaattggccgggtgaggtggcaggcgctgtggtcccagctgctcgggaggctgaggcaggaga

SEQ ID NO: 8185 - DNA, 318 bp, Homo sapiens
cggtggcccaggcgcgttaagctggttgggacccgggaaggcctccctcttaaggtctttcccacacctctgstssttgttaacctgackkdcggsttcaggatccgcagcgtgcacccgcgttccatctgtcttctgagactttgcccttctccaggaagagcactcaggagaccaggaaaatggccacagggctsstgagagccaaaaaagagctggcaagcagatgaattaactsssccaagckkctagctgtgtttctactcagtgggagagaktkggagtgaatcakgagggtcaaccacacagtgtctacaa

SEQ ID NO: 8186 - DNA, 383 bp, Homo sapiens
cttaagacaaaataattaaacatttggaacatttgaatttgaaactttaaaaaaatgttgtacgaaattttactacgtgtgatttaactgctatttgtatgaagttgtattggattacattaagttggaattgtgattatgtctgttttagttgtttaaaagaattttcctattatatggtatccaaggatgtagacacattagaattataagaagacatgaggagcaaatcatgaagagcggattggtctttgttcaacaagagctggcagagtagttaagacaaggrgttcaaaaattccatgaatcttggccargcatggtggctcatgcctgtaatcccaccactttgggagggtgatgcaggaggatcacttgaggcc

SEQ ID NO: 8187 - DNA, 430 bp, Homo sapiens
tagttttatgatttgacatcacccatcaaaattatacaagcataaatgttctaagtcatcattctcatttgataccagacttaaaaaggttgagcaggcagagaatgggcaaaaggtatcagtgagggagacaaataagataaattgagcatgatccttgatgctgacaaacctggttacagttattttaatgtgcataatacttgcagtggtgaaggattgctgccattcacaatttgtgcatcatcattatgtccccaggagttgtcagcatccccactttcatcagctttacccagaagatgcaaagatgctcttgtcacagaggaaattatccctgacctattctgagctcagaaatggtcttctcccctcattctaaaccagtattttaaagtgtattcttagctactgaactgagtttggaaaa

SEQ ID NO: 8188 - DNA, 370 bp, Homo sapiens
tacatttataattaggaaaaggatagtttcttttaaatggtagaacttccccaatgagtcagctacctgtatttctggcctgtcaggcwagacactggagaccattctgcatagaattgtacctccctgaactactgttaggccttagggtggggattcatctttcccttctmcccaccatggagacaaaatcctcttaaacatatccgggcctggcatggtggctcacgcctgtaatcccaacactatgggagtccgaggagggtggattacctgaggtcggggratttagaccarcctkamcaacatggagaaachcggtctctactaaaaatacaaaattagccgggcatggtggcacatgcctgta

SEQ ID NO: 8189 - DNA, 283 bp, Homo sapiens
ctggggtagattattgcctgccccttatacataggaatatgctgcataattgcgcataacttccatctcccttactggsyttgtaggcagaggaaactgtatatgttactgccttgtacttttctcatacaccaaaaacacaccaaaaaaatcaataaaataagcaatcttctattctcattccttttcccagcagcatattttagaggcacatacaaaacctacattctctagttgggagtggatttttaaagttttccttttatcttttattttttttttk

SEQ ID NO: 8190 - DNA, 379 bp, Homo sapiens
agaagacccggccgcccagatgatgcggtggtgggggacctgccggcacgcgactccccccgggcccaaattgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcasagccagatctgtccaaagcagtttcactctcaatgggactgtatatgggagagacagaaacaaaagtgatggga

SEQ ID NO: 8191 - DNA, 63 bp, Homo sapiens
atactttctttgcattttgtcacacaaaatattaaaaagatatgagctcaaagattgagattt

SEQ ID NO: 8192 - DNA, 50 bp, Homo sapiens
ctttccgctcggctgttttcctgcgcaggagccgcaggccgtaaccacca

SEQ ID NO: 8193 - DNA, 310 bp, Homo sapiens
gccgccgggggcttgggagccgccgatcccggagcccgagccgggagagggagccgccgcagscgccggcgctggtdgagakrtkctctaagccgctktsatcatgggagaaatagagcagaggccgaccccaggatcacgactgggggccccggaaaattcggggatcagtaccttggaacgtggacagaagccgcccccaacacctkcaggaaaactcgtgtccatcaaaatccatatgctggatgacacccaggrggcatttgaagttccacaaagagctcctgggaaggtgctgctggatgcagtk

SEQ ID NO: 8194 - DNA, 157 bp, Homo sapiens
acagttggtggtaagtatttggctttatttctgggttctctattctgttccattctatgtgcctgtttttatgccagtaccatgctgtttttggtaattacaggcttgtagtataattagaagtcaggtaatgtgatgcctacagatttggttttty

SEQ ID NO: 8195 - DNA, 183 bp, Homo sapiens
cagcaagatgatacaacaattttaaatatatatatgcacccaatatgggagcacccagatatataaagtaaatattaatagagctgtacagataaataggtcttctacaataagaacaagagatttcaacaccccacttctggcactggacagatcttccagatagaaaatcaggccgggcac

SEQ ID NO: 8196 - DNA, 408 bp, Homo sapiens
agacacatgagaaaatatgggaaagtcggagagtggaagaaaatgtaaagacccccctcctccccaaagagtacgttgtgtagtggggtagagtggaaaatcaatccaagaaaagtagcaaacggacccaaagatgaagaggaagaaaagaaacagcaacacgaaacgaaaaaaaaagccaccagatttgttgcaacgttgatgtaaacctggccgtctgaaccagtgacccagggtttccgcttccctttgctgtcatcttgctcaagtctagaagctgaaatatcatcatcaactcgacatgaggggataacctctagatccactcatcagatgctcatcagacgttccaattacaaaactgaacctcttcttagtgctggggcggttagaatgcaaacatttcaa

SEQ ID NO: 8197 - DNA, 460 bp, Homo sapiens
tgaatgctatgaggaagatgcatgcttacctcattggttattatgaagcgccttagcctactgagttctttttgtgtgttacttgkttattatggcttatactccggccccacctcctgaagcaggaagggccaaatcgcagaatgatgagtttatttcctgttcacagtggaagaatctaggtactgatcaagcatcgttttgcagagtagcacagactaccctatgaggttggtccccagatggatctgtatgttgtctctgatagcaaattaaatccattaaagtaataatggacctcaggtgaagagagcagcagtctctggagggagctgtgagtatgaacaggtgattgggtttaagagaaacttccatatttcattttggttttaaaactgtttggtacccagtcagccacaggccttatgtatcaactggatgaaataatttaagaggccta

SEQ ID NO: 8198 - DNA, 459 bp, Homo sapiens
tactaaatatgaaaataagtcatttgaaaaaaatacagtatgtaaaatttgttcattcgttgaggtaatggtgctatgttttttacaaaattgttcctacaccttttttctacttcaggtattttatttcaaccatttccatcaattgaactgttaccattgcctttttctgttgagaaattgcctctgaaaaatagtgctatttttcagcttaagtgttcttaagtgaatgaaattttcaaagtactagatcaccttaaaattatttcacgtactgaagacaattaagtccgttatgtttagagtagaaaatgtttaggttaaagagcatctgtcaacagaatctacaaaaaagattcccttgcatttgaattagttctctattctcctattgctaaatgtgtgatatatagagaggatgtataaaaggaaatggaaatagactatgtacttgtctgg

SEQ ID NO: 8199 - DNA, 447 bp, Homo sapiens
aaaagttacgtgtgaccttgcgacgcgtgttgcgctccggtcgcataagcgtcagtgcctgtcgctgcggctgcgtggcgggttgtccaggtaaccacgggagttgtcgctgtctaggagcatctgaaagacaggtgtgcgtcatgcacttgaagcacctgaggacccccctgagccctcaggatggagctgcaaaggtgacctgcatggcttggtcccagaacaatgccaaatttgctgtctgcacagtggaccgagtggtcttgctgtatgatgaacatggagaacggagagataaatkctccaccaaaccagctgacatgaagtatggcaggaagagctatatggtgaagggcatggctttttctcctgattccactaaaattgccataggacagactgacaacatcakctatgkctacaagattkgagaagattggggtgaca

SEQ ID NO: 8200 - DNA, 62 bp, Homo sapiens
gaagggatagaggccttggaccaagatatacaggtatctttttttttttttttttttttttt

SEQ ID NO: 8201 - DNA, 398 bp, Homo sapiens
caagtctttaaaatagttatgttcaaaatgaataaatatattaatgaaggaataaaaaaagagaaacaaagctcaacaaatagaagaagctaggtagatttgaaaaaagaatcaaatagaacttctagaacaatatagtagtcactgacattagaaactcaaaggaagagttatggagcagattagatgcagctaaaaagagaatcagcaacttagttaaaatcagtaagttagaaagtttatgaataaagaagagtgcaccagaaatagttaaaaagagattctttctttggataaatgaatacatctttttgggttatattggactagaagatcttcattctctaaggtgacttttatacatttctgttctgatccgtgctatattataaagtcag

SEQ ID NO: 8202 - DNA, 448 bp, Homo sapiens
aaatctattaaagactcaaatctaagatctgaaactatgaaactaccagaggaaaacactggagaaatgctctttgsawtcaccatgtttatkgcagcactgtttgctgcaataaccaagataatggagtcaatctaagtgcccatcaaagagcgaatgcataaagaaaatgtggtatatggttgagtgaggtggctcacgcctgtaatctcagcactttgggaggtggatcacttgaggtcagttcaagaccagcctgcacaacatggtgaagccccgtctctactaaaaatacaaaaattaaccggtggtggctcatgcctgtagttccaactactagggaggctgaggcchrrgaattgcttgaaccctggaggcggaggttgcagggagctgagattgcgctactgcactccagcctgggtgacagagagagacgctgtctcaa

SEQ ID NO: 8203 - DNA, 429 bp, Homo sapiens
  misc_feature 310: n=a, g, c or t
ataaacttagctgggctactcaggaggccgagagaggaggatcccttgaacccaggagtttcaggctgcagtgacctgtgattaaggccaykgcactccagcctgggcaacagagcaagacactgtctcacgaaaaaatattttaaaaaagaatgatgaaaatgtaatatgtcatttgggaacatgtcctaataatgtaataacatgtatatgtrgaataagttcatttttataaagcaagcatataattgtataaaagtacaaaaaaatggccaggcatggtggctcatgctcgtaatcccagcattkngggaggccgaggtgggtggatcgccagaggtcaggagttcgggaccaacttggtctacttggtgaggcctcgtctctactaaaaatataaaaaaattggctgggtgggcgtggtggcag

SEQ ID NO: 8204 - DNA, 344 bp, Homo sapiens
ctagcagctccatttttgtctgttttgcgtattagatttctgcttaagattacttgtgaagaaaagaatttgagaacattacattatgggagaggtcctaaccattatttagtgcagaatattgtccctaattttagatttgcctctccctgccttctttccttttttttcacaaagatctggtaaagccctgcttgtgccagtcgctagtaagtttggaggttttatagagatgagtaaaaaagccttaagttcaggaccaggtgcggtggctcacgcctgtggtcccagcactttgggaggctgaggctggcggatcttgaggtcaggagttcgagaccagc

SEQ ID NO: 8205 - DNA, 85 bp, Homo sapiens
ccactatggcttccagcactgtcccggtgagcgctgctggctcggctaatgaaactccctctcaaaaaaaaaaaaaaaaaaaaar

SEQ ID NO: 8206 - DNA, 321 bp, Homo sapiens
  misc_feature 146: n=a, g, c or t
actaaaaacatttcttgcagaaataggaaaatacatcctaagattcataaggaggccgggcgcggtggttcatgcctgkaatctcggcactttgggaggccgaggcgggctgatcacctgaggttgggggttcaaaaccagsvtgnccaatatggaggaaccccgtctctgccgaaaatacaaaattagccgggcgtggtggtgcatatctgtaatctcagctactctggaggctggggcggcagagtcgcttgaacccaggagccggaggttgcggtgagccgagattgtgccattgcactgcagcctgggcaacaagak

SEQ ID NO: 8207 - DNA, 452 bp, Homo sapiens
  misc_feature 322,325: n=a, g, c or t
catgacttagtatttggtaatggacccaaccttaaagaaaaagagtattttattaaattaaataaacatttcttaggctgtgaaataaaatcctgagaagagtctttgattaaggtctctacatgaaggaaagagatctagatacttaaatgaactacaagttcatctgcagtatgaacttgggagaaactggatctattgactaggaggccttctcagctgccagggtttccttatttccctttattcattgtttgtctgggtgctaggagcaaaaggtaatatttttaggcagtctttctgtttgaaatacaaakkatknbancaacttggtattgaattgttgctttatatcattaccttgaaggtaacaaagaagtgaagcgctggctgggcacggtggtttgtgcctggggtcccagtgctttggaaggctgaggcaggaagattgc

SEQ ID NO: 8208 - DNA, 231 bp, Homo sapiens
caatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcaaaaaaaaaaaaaaaaaaaaaaaaaaaaaaaaaaaaaaaaaaaaar

SEQ ID NO: 8209 - DNA, 490 bp, Homo sapiens
aacaaaaactgctaaacaaggagttatttaagagcagataaattccctgaagcctcaaggttggtgcagctgtagctcagtcgtgctttatgtctaactgagaattgacatttagaatgaagaacctgagccctgtatgatgctgagtcctatatggggacaaatcattttaaggtactttgttgaagaaggattatgggcaaaaatattttaaagcttttttaatcagctgaggttgaacaatagtggtaattggccgggcacggtggctcatgcctataatcccagcaccgtgggaggctgaggcaggcggctcacttgaggtcaggagtttgagaccagcctggccaacatggtgaaaccatctctacaaaaaatacaaaaattagctgggcatggtgatatgcgcctgtaatcccagctgcttgggaggctgaggcagaagaatcgcttgaactcgggaggtggaggtcrcagtgagctgagattc

SEQ ID NO: 8210 - DNA, 297 bp, Homo sapiens
actgccggccggacgccatcttgctggtttgcggccggtcttggatgaagcggcggccgtggtgagagcgtggggaagggtggggtsaggggrcgaggccgcagctagggcggcgaaactctcctcccctcggccccaccgcgtgggacggcgtgaacgtggtgtcggagggatgtcarccttctctgagrcggcgctggagaagaagctgtcggagttragsaactcgcagcagagcgtgcagaccttgtccctgtggctcattcascascgtaaacactcgcggcacatcgtcam

SEQ ID NO: 8211 - DNA, 167 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttttttttttttttb

SEQ ID NO: 8212 - DNA, 403 bp, Homo sapiens
  misc_feature 257,270: n=a, g, c or t
caagaagtagaattttgggtcagaggatatgatcgtttaaaaacaacattgtttgatcagattggcagatacttaaarawkgggtggmcaggagccattgctggcaaaggtttgggtaaggggcacttgagtatgctgctagtgacagggaattctacacatttgtgcatagaatctgggaatgactattaagatttatttattccctctctaggtaaaatccctctctaggtatataaataaataataaataaatnvtcagtttcagcngggcacaatggctcacacctgtaatcccagcactttgggaggccaaggccgatggatcacttgaggtcaaggagtttgagaccagcctggccaacatggtgagaccccatctctactaaaaaaaaaaaaaaat

SEQ ID NO: 8213 - DNA, 466 bp, Homo sapiens
aagccatcgcccgagccgccggcgtctcctcccgcccagcagttcctccacgcaggggctccggaatcgsccgaccggamamsgktggccaccckgaggtctttctggaagtggatatctactcagacagtaagaattataagagctgtaagagctcattttggaggaataatggatgaaccatctcccttggcccaacctctgtagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggcttgcacataagttcttggattaaaaggtctggatcagtggttcttggttctcactgttcatcagaatcacctcggggagc

SEQ ID NO: 8214 - DNA, 389 bp, Homo sapiens
tacacataatctatgaatagcttaatcctttatatattccttaaaataggaattcctcgacatcactcctggccamacttttcytggcctgtgttgttgckatgtgtatttgaaagtaatatctgcattccttttaagatgttctgtaagtcatatttgtcagttatacagagtagtcttccttttccccacgttcagtgtaatctcactgaacagtaataatagcaatagckaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtat

SEQ ID NO: 8215 - DNA, 428 bp, Homo sapiens
  misc_feature 108: n=a, g, c or t
caaatgtttcttcatgctttgttcagttttctgcaagtttatatctgccataagatagggctactcatcttcaattttgaaaggatggattgtgctacttagtaactngcacaacaccttacatcccattaacccaagagcaggaacaatactggtttgacactgctaaatgtcagtcctatgcttccagtatccgaggcgcccattttaaaagtggttaaggcactttgggaggccgaggcgggtggatcacaaagtcaggagatcgagaccatcctggctaacacggtgaaaccgtctctgctaaaaatacaaaaacaaaaagccggatgtggtggcgggcgctgtagtcccagctactcaggaggctgaggcaggagaatcgcttgaamccgggaggcagagcttgcagtgagctgagatcatgc

SEQ ID NO: 8216 - DNA, 403 bp, Homo sapiens
agcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggaca

SEQ ID NO: 8217 - DNA, 368 bp, Homo sapiens
caagaaggaaaatttgatgaggaaggaaggaatggatatcttcagaagggcttcgctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgac

SEQ ID NO: 8218 - DNA, 292 bp, Homo sapiens
gcggggctgctggaggcggagaggcacggaggagccgctggggctgccgccacggccgcccggagtcctgggtcaagctgagtatctbcacgtttaggtgcacaaatactattttgtgaagatcttaaathtgtggtataagaacttgaaggaaatagaactgatttgttacttctaaaagatttgtaagactccaggcctcccagccgtgaataatctgatggttcctgaaatgactggggaagcagacgcttcgtatggcagttgaagagtgtgtgtctatgtgcattta

SEQ ID NO: 8219 - DNA, 377 bp, Homo sapiens
atctcattgtccaaaagccatgatctgctaagtttcaattccttgatacaatctgggaggcctgatggttgctttcctgagaaaggaactcagatttcaaaaccaagatcaaggcatggaaagtgagactaactacatcaggccagaaatgaaaagcaacttaggagtcaattttagaaacatcatcagtggtgtagaagagctcagggaagcaaggagggctgctgtgaatgacaccatgaatttctgaatgtgatgtcccttcaattcatgagtccaacttcaaagcactgacacatttggtgtctgatgatgtccagctttctcatagacggctaccttcttctcactgttacctcatatggtggaagtgagtg

SEQ ID NO: 8220 - DNA, 386 bp, Homo sapiens
cattcaaaaatccaaagggattacttagatcctggttgtcagcacatagaggttactcaagatcttaaaaatgaggagataaggccaggcatggtggcttacgcctgtaatcccagcagttttgagaggctgaggcaggcagatcacttgaggtcaagagttccagactagcctggccaacatgaggaaaccccatctctactgaaaatacaaaaattagctgggcgtggtggcatgcgcctgtdatcccagctactctggaggttgaggcaggagaattgcttgaacctggcagcggcagaggttgcagtgagtcaagactgcaccactgcactccagcctgggagacagagcaagactctgtctcaaaaaaattcttgttgtga

SEQ ID NO: 8221 - DNA, 50 bp, Homo sapiens
  misc_feature 2: n=a, g, c or t
anttgtgttcgcagccgccgccgcgccgccgtcgctctccaacgccagck

SEQ ID NO: 8222 - DNA, 359 bp, Homo sapiens
  misc_feature 65,94,183,219: n=a, g, c or t
aaaatcctgcattctatktaatgtcatattttttcaagacagccatctagtggcaaatdagaganatgaaggrtcccmaggkdcrcvatgarantbgtttcattagtatgcctatgagadatgaagtttgctgtgttactgaatgtagcagatgtttcagttggtatgttgcatgtatatganaaaatacacataggcaatcacaaatttatattttknrrtattaagagtaagctgggcgggtgcagtggctcacaccttaattccagcactttgggacaccaaagtgggtgtatcacctgaggtcaggagtttgggaccagcctgggcaacatggtgaggccccgtctctgcgaaaa

SEQ ID NO: 8223 - DNA, 468 bp, Homo sapiens
cctcttttctctgtatctctctgcccagttgcttagaaatgcttctgtttgtgtatttgtatccaccttctttggggagagttatgaccctggtccttatgccatcagtggtattgcaattttgtatgtagcatgaccatttttaaaaatgacatttcatagtgagtgattcagacacctatcattcagcttacctgccggggccctccaaaatgagcagaaggcctctgtctcattctagaagcttgaaggtctccacgtggtttgcccaggggcccacaacctccctgcagtccaggagtgctcccattaaccccagctgtgtgattcaggccagattcttaggactttttaagtgaaatgggacagaaaattgcttgatgtattttgccacatgaagtacattttgctgccgcttagttctttattgtcgttagattaaaaactctcctaacgttgtgtgggtaa

SEQ ID NO: 8224 - DNA, 407 bp, Homo sapiens
atttggaggaaagaagccacgatgcctttttgagttcccatggcagacatccagctgatcacactgtgtccacataaggcaaatgctgagctgtaatccatyaagckgtttccgcmtagagaaaaggccakatgagtacacagccagaaggkgtctgcctacaagacaaagagggaaaacttacctgaaaccaaccctgatggatattggatttctaagctccagaactgtgagaaaattaattttatgtgctttaagacactcaatttgtggtattctgttatggcagcctatgctagtcaatttgcattaccataaagcaacacctgagagtgggtaaattataaagaaaagaagttgaatcggctcatggttctgcaggcagtacagaagcatagtgctggcaa

SEQ ID NO: 8225 - DNA, 83 bp, Homo sapiens
cgaaagtgtgatgttctaccactttaccaakaactrattttaaatacacattgtcctctcgatttttggaccaaacagacgck

SEQ ID NO: 8226 - DNA, 473 bp, Homo sapiens
cagtatatggagagagtgaccatttcccaaatattcacaagcacatagtggggctgaccaagggccttttattcaaacagttgcaagaatccttaatctagagcaakkagcaacaacatttaactgaattgtgttactcatgccagaaatatttctgagaatttcactaggacagacaaattaggactgtaaaagtatatctgtatttgtgcagaatctctcataattcatctaatcaatattgactgtacatcttctgtgcattagtgattccagctatgaactgtttctcaatgcactgacaatttttgaccaatgtataaaatttatttgtgctacacctttgtatgcgtattgttacagtgatgccatatagagtggggttcaccttgctttaagaggttagaagcaactataattaattkcaagccactgtcacagaaatattgggtgtactggaaaaagacatgaat

SEQ ID NO: 8227 - DNA, 535 bp, Homo sapiens
taaagcaaatgggtaaaatgtcaacaaaaggcaaagataaacagtatagatatatatctatgcctatggaagatagaaggtacacaatttttttttactactttttcctacaactttgaagattggaactcattttcagataaaaagttttaaaatgcatggaaattatcaagtagatatcacaaaatgtctgtcaaaggacatttgctcttaatccccagtttgtctttatcttttcatgtgtttggagatgatatctctgctctttcttacagatgaagttgtttatttgtctaatatttgatgttgaaacaactgctgtcaaagattgtatgggactctagccatatctttgagtttagacaaagactggaagagtttagatttactgtcattttactttttgtcagatcagagctttgatagcctagtgattccagctttttaatactctgagatctccaaaatggatgatgtgcacatgtgtaagatgcatgaggccagcatttgggtgtgactctatcactttttgtcc

SEQ ID NO: 8228 - DNA, 378 bp, Homo sapiens
agactctctggaaagcctgggagctgaattccggaagatccccacatcgatgaaagcaaagcgaascamcaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagamagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagag

SEQ ID NO: 8229 - DNA, 432 bp, Homo sapiens
  misc_feature 113,297: n=a, g, c or t
caaattgcttttcagaaagaatatgccagttcacactacctacagcatatataaagagaattcctagctgggcacgggaawtcttttttgtacttttagtggtggcgtatgcntgtaatcccaactacttgggaggctgaggtgggagaattgcttgaacccaggaggtgcaggttgcgttgagcagagatagcaccgctgcattccagcctgggtgacagagcgagactcagtctcaaaaaaaggaaggaagaaggctgggcgcagtggctcacgcctgtaatccgagcactttgngaggctgaggcgggcagatcacgatgtcaggagttcgagactagcctgaccaatatggtgaagcccatctctgctaagagtgcaaaaattagctaggcgtggtggtggcgcgtgactctagtcccagatactcag

SEQ ID NO: 8230 - DNA, 404 bp, Homo sapiens
tctctaggcaattaaactatttaaaaaatcaaatgtgattatttcttcttttataaacaagtgctttttcccccaarcctamccsattgttttccaaccctccagagctatgctacattgtctgatttgtttctgtgtaacctaaaaatgtttttctttcattcttgtctatattacttttaacgtctacaataacaagctrtttgaacatccatctgttatcagacatacttacatcccccacacacaagtcttaaaagtctggcwgtgatctaaggcttcattgtccattttcttgttcttcacagtaattaaggcttttaggtgtggttatgggactatttaagataaacagacaggatccaaggtactttckactttcagtcacgtagaagttgcctgcy

SEQ ID NO: 8231 - DNA, 72 bp, Homo sapiens
gagcctagattrtgccattgcactccagcctgggcaacaagagcgaaactctgtcccaaaaaaaaaaaaaaa

SEQ ID NO: 8232 - DNA, 410 bp, Homo sapiens
caggtgtgatgctggttatactggacaacactgtgaaaaaaaaggactacagtgttctatacgttgttcccggtcctgkacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacwrcaagagcgtccacgaggttaatctaaagggagcatgtttcacagtggctggactaccgagagcttggactacacaatacagtattatagacaaaagaataagrcaagagatctacacatgttgccttgcatttgtggtaatctacaccaatgaaaacatgtactacagctatattt

SEQ ID NO: 8233 - DNA, 356 bp, Homo sapiens
  misc_feature 279: n=a, g, c or t
aagcaacgggatgccttggaaagcatcgttctgcagcaggactgctcaaccggccaatcagaacacagggaaccatgaaagagaggatagtgcatgcccagcatgcagactcgcttccatcgcgacacagaggacagcatggagcccagctcgagtgccgtccccccaccatgacagcgcasatgggccttccaagccacagagccacagggaagccagtcctcctggaccgtgtgtggctgttttggagccagttgtgtcctgtgaagagcgcaggcncgcaggtgaggcaggagtgaagatggaggaggcggccatctctctggggcctggcaacagcgagagcttttgccaag

SEQ ID NO: 8234 - DNA, 122 bp, Homo sapiens
accccatccgctggctctcacccctcggagacgctcgcccgacagcatagtacttgccgcccagccacgcccgcgcgccascaccatggctaggtamcaagcgactggggctgtccggactg

SEQ ID NO: 8235 - DNA, 452 bp, Homo sapiens
tgtttttcagagttgtataggttaaggtgttgggaactccataacccatggttcttgcctgtagttctaaaattctcacatttagcagtctgcactcatcaaacatctagttgaactagatgactgattaatcacctcgtgattcattgtgttttacttctcatctaggaaataaaagattatttctgaaattagggctgacttagttaataacggtttatcgtagaaagacagtctgttatgtcttactgtcctatataactaagtgataaggttatgacaacatttggtaatgcagtttaacaattttgttttaaatagaatgttcgttgaatacctggatataaatgtttggttagcttgcagatccaattcaaaagtttaaaaatttcagagcctgcccttggggaagtcagtgtggtgattcctcagggatctagaactagaaatac

SEQ ID NO: 8236 - DNA, 155 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttt

SEQ ID NO: 8237 - DNA, 432 bp, Homo sapiens
ctgctgtttaaataaaatagaaacaatacaaaatggaacgtaattgagtgtgaatttgtgtgattcaggcggtaactgttttacagaaaattagagatgagacattgatataaacaaggcttcctagtttcttgttttgttttaagacagggtctggctgggtgcggtggctcacacctgtaatcccagcacttgctaactgaagatgcaaggaccgaggcgggcagatcacttgaggtctggagttcagggacagcctggctagcatggtgagaccccgtctctactaaaatgcaaaaataagccagccattgtggcatatgcctgtagtcccagctgctccagaggctgaagtgggaaaatggcttgagcctgggaggcagaggttgcagcgagccaagattgtgccactgcactccagactgggcacaa

SEQ ID NO: 8238 - DNA, 444 bp, Homo sapiens
  misc_feature 41: n=a, g, c or t
ttcataagttttaaagggcatggtgctcccagcaccagaanactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttg

SEQ ID NO: 8239 - DNA, 445 bp, Homo sapiens
cctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtgttctaagtgctgactggctacgtagttcgggcaaatcctccaaaagggaaagggaggatttgcttagaaggatggcgctcccagtgactactttttgacttctgtttgtctt

SEQ ID NO: 8240 - DNA, 455 bp, Homo sapiens
tacaaataacctagctgacaaagaaatcaagaaaacaatctcatttacaataacatcaaagaaaaacatatacttaggaatgaatttaaccaataagacggaagatgtgtacacttgaaaaccataaaacattgatgaaagaaatttagatatgaacaaatgaaaagatatcctatgtttatggatcagaagaattaatattgttaaaatgttcacactacccaaagcaaatatatagatttdacacaatcctcatcaaagttctggtggcattcttcacagaacagawaaaaacaatcctggccaggtgttgtggttcatgcctgtaatcccagcactttgggaggccgaggcaggtggatcacgaggtcaggacttggagaccagcctggccaatatggtgaagccctgtctctactaaaactacaaaaattagctggatatagcggcatgtg

SEQ ID NO: 8241 - DNA, 189 bp, Homo sapiens
agaagtcaaggaactggaggctgaggaacccagcggaccacgaaagcagggagataactagacagcatgctcggctggaaggaccaaagtcagagaaggaaaaatgaataagaaaatgagcagtcagaggcagctagggtgacggacagacagcatgaagcgcasagaatgaatagccagaagactcgg

SEQ ID NO: 8242 - DNA, 450 bp, Homo sapiens
tcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagtagcaaacattgtgttggggttataataattcattaaatgtcttgttgcctgtaaaaaaaaaaa

SEQ ID NO: 8243 - DNA, 243 bp, Homo sapiens
ccatttctactaaaaatacaaaaaaattagacaggtgtggtggcagttgcctataatcccagctacttgggaggctgaggtaagagaatcacttgaacctgggagtcggaggttgtagtgagctgagatcgtgccattgcactccagtctgggcaacagagcgggastccatctcaaaaataaataaataaatarracccaccackacrraaaaacagaawwattacccaggtgtggtggtgt

SEQ ID NO: 8244 - DNA, 463 bp, Homo sapiens
taagtcttaaatatgtctaatttggaaaaaatatatttcacaaaatatgaacatagaaggcaaggcttctggtagtataaggctagtagctatgattacttacccattatatgatatacttaatctagcactaaaccaagtgtttagcacctaattaaaaagggccaggcatggtggctcatgcctataatcccagtgctttgggaggttgaggcaggaggatcaattgagcccaggagttcaagaccagcctgggcaacatagcaagaccccccatctctacaaaaaatttaaaaattagctggacatggtggtttgtgcttgtagttccagctactcgggaggctgaggtaggaggattacttgagaccaggagtttaaggctgcattgagttgtgattgcaccactgcactccagcctgggtgacagagcaagactctgtctccaaaaaaaaaaaaaaaa

SEQ ID NO: 8245 - DNA, 446 bp, Homo sapiens
tagggctaattgttctcaggttgagagaataggaactatcgcatgtcggaatttatgtaatttaaaggatggctttaaattcacaataaagacaaattttgttaagtaccagccacatcgttcatgtttcataggaaagattaaaaaaggccttcaaagccaaccatgtttgtttcctgtttttatccttcctatgaaggaccaacagtgttggttggtacttgaggaaatttgtttttattgttggtttaaggccattctttaaatcacataaattcaggtctgtgatatctccttttctgtcaaattgagaacagcttcattactttatctctgcaagtaggatgtgaacagtataaatacagacttggtgcgtaastactcctggagccattggggcctgaaacggcgccttgtgtattccacaaacgcgttcctactgctaa

SEQ ID NO: 8246 - DNA, 473 bp, Homo sapiens
ttaccaaaacagaaatagtcattcagaattacttcaattgattttctaaaaggctgcttggagatactttctttggaaatagtcactagaattacagtagtttaaagctaccagaatgaaatattctggtttctgattccacttagtaaggtaacatattctgtagaatttgacagatttaacattgtgagaggactcagttcatgaaacaaacactaccatcttttttgttgttgttgtaattaaatgaccctaagaaataaaagtggaatgcacagtctcactgtaatgtgatttactaggatatgagctccctgagggcaggggcttgatctgttttgtttcctgatgttcttttcagtaggtggttatatttgttgtatgaatggatgatgaatgccacagagtaagcacaatgttttgttatttgaaattttgttaaaataactactaagatgtctggaaaacacatt

SEQ ID NO: 8247 - DNA, 549 bp, Homo sapiens
  misc_feature 155..156,159: n=a, g, c or t
ccagcttgagtttttctgtgtattacaaaataagaaaacaaaaatgacacaataatctattttgtctggttttgctctttattagtagaaatagacaagtgaggagttgaaggaagaaattgcttctgatctgttttagatacagatgaaactcnnccnmmctmcccgccccacccaatctttctctgtctccctccctgagcctattcttgcttcttccctttacaaataattaactgctcaggtcatgttgaaccaaaaaatagcatctgtagcccctgtgtgcttactttaagtatatgtwactgaaaaatgcggagtgagcacttacaactcattctcctgggaagcacagtgatactataccccaaatgcttttctttatcattttaattkttatcttctttacttacatttccaacatcagttaagagggtcttgtagttttctaactgaaaggagattgtaaaatctccttgctcaaaactcagatgcagaatattatttkkactacaataaatacatctacacaatggtattatatctggt

SEQ ID NO: 8248 - DNA, 506 bp, Homo sapiens
  misc_feature 262: n=a, g, c or t
caccaccacgcctggctaattttgtatttttggtagaggcagggtttctccatgttggtcaggctcgcctcgaactcccgacctcaggtgatccgcccacctcrgmctcccaaagtgctgggattacaggcatgagccactgcacctggctgtttttctatttttttaaacagagttattgaggtataattcacatgccatacaattcatccatttaaaatacacaattcaggccaggcatggtggctcacgcctgtaatsncagcactttgggaggccaaggctgggggatctcctaaggtgggagttcgagaccagcctggctattatggtgaaacccgtctctactgaagatacaaaaaaattatccaagcgtggtggcaggcgctgtaatcccagctactctggaggctgagtcgggagaattacctgaacctgggaggtggaaattgcagtgggccaagatcacaccattgcactccagcctgggcaacgagcaaaactcc

SEQ ID NO: 8249 - DNA, 525 bp, Homo sapiens
ctgtaacaaaagatgccaagccctctgtggcttaacacagtatatgttttatttctcgttcatgtaacagtttagtgggtgtttagtgggacatgttctatttggcaattcaaggacccaggctccttctagcttgtgggtttgccatcccctggggctgcagagccttctgctggaaactgtgcttctggcaggtagatgagagaagagagaaacttagaggatcttagagaatctgggtggcaggtatggtgaggaaattgacggtcacaggctattggccagaaacagatcacatggctgcctctcattgcaagggagcttgggatataccgtctagctgagtgcccaggaggaaaagggacaggaggtagggtgagcagcccgacttccttaggcttcagcagtgaggagactcatccaggccacatgaaaggaggaggcacgcctcacctcccatgctcctcctcgtttgaaattatgtgtgtcctggaccagtaccccagatgggagggtatagtggac

SEQ ID NO: 8250 - DNA, 435 bp, Homo sapiens
taggcagaagctcgtggcgttactgagtaacagtgatatttacgggtcttcagggtgtgttaatgaaatcactaraaaaattttttttcagatgctaaggtttatgtgttctcagtcttcaccgagtcttcattgataatgtttaaaactgctagcctgaggctgggtgtggtggctcacgcctgtratcccagcactttgggaggccgaggcgagcgaatcgcttgaggtcaggagttcgagaccagcctggccggcatggtgaagccccgtctctactaaaagtgcagaaattggccgggcatggtggcgggcgcctgtggtcccagctactcggaagttgaggcaggagaattgcttgagcctgggaggcagaggttgcagtgagctgagattgcaccactgcactccagcctgggcgacagagtgcgactc

SEQ ID NO: 8251 - DNA, 413 bp, Homo sapiens
aacagttttggtgagcccaggcaggagaacaagtcactctgctcagtttagaggctgtaaatgggaccctgggacaaactaacaaaaaagccagccaagaaagctatctacagtttacgggaatatgggaaggtgtacttttgtgtgcagaattgaaattttttttctccctacctgatccctccagagtttggagactattttcagagtgactctacacacttcctgcttccacgtttagcatccccaagtgaagagatatgaagagtgttcaaaagatgctacaaaatgagaggaggagaaccagtgtgagcttttattattctgccagggaaatgtcctgggcatcctgttaattgaaatggacaacttcctaggctcaaaaaatctgtcaggtggacttgttgcagcaa

SEQ ID NO: 8252 - DNA, 299 bp, Homo sapiens
  misc_feature 58: n=a, g, c or t
gattcaagaatctttctttgctgaaatgaactcggctaaacttaattttctaaaatdngtcttttaacacttggktaaggtggtgtctgataggtttctccctattttwccctttccagtctatatacagaagtgggtctacatgtccagcccacactcaaggggaaaggaaataagctccattttaaatttgtggttatatttktaaattaccacactgattagtaaattcagggagagattctttgagactatgcaaatacctatttctactttkctactgattttagttatcattb

SEQ ID NO: 8253 - DNA, 350 bp, Homo sapiens
  misc_feature 243: n=a, g, c or t
caaatattagctgggcttggtggcccacaactgtagtctcagctacttgggaggctgaggcaggaggattgcttgaacccaggaggtggaggttgcagtgagccaagattgcaccactgcactccagcctgggagacagagcgagactccatctcaataaataaataaataagtacttcataaaakkcaacattatttcataataaaacctgtgcaaggaaaccaaggtggctatcctccarnrtcattagcagacatcatactgaatggtacaatcttggaagcattcctaggaaaacagaggacaggacatggatgtctgctatttccgcacgtatcctgtaggttga

SEQ ID NO: 8254 - DNA, 430 bp, Homo sapiens
aaaacgtattgtttaattttcaaacatttagggatttcccagacatctttgttgttggtttctaatttaattccattatggttagggawcatackcattatgatgaattaaaaaaaatgtagaggtttgtatatggcctgaaacattgtttgtttaggtcaatgttcagtttgtaataggaaagatgtgttctgctgccgttagtaaagtgtttcataaataataattaggtcaagttggttgatcgtgttaaggtcttccctatccttgctgatttcctgtctgcttgttctagtgattactgagaaaggagtgttgaagtctgcaactatkgttatgggtttgtwctctttctccttgaaattctgtcwgttkatgcttcctgkatttkgaggcactgttattagatgcagaaacatttacagkktkt

SEQ ID NO: 8255 - DNA, 230 bp, Homo sapiens
tgaatgctgacatgatgtgcaaaggaaatgcttattggaacattttatgttttggatttgggatgcccaaccagtaggtataatgcaaatactccaaaatctgacagatttagaaatccaaagcacttctggtctcaagcatttcggataagggatactgaatctatataagcagaggcttagaggtaggaatgttcatgagaatgagtaagtcagtttaactagagcat

SEQ ID NO: 8256 - DNA, 54 bp, Homo sapiens
arttgtgttcgcagccgccgccgcgccgccgtcgctctccaacgccagcgccgc

SEQ ID NO: 8257 - DNA, 63 bp, Homo sapiens
gaagggatagaggccttggaccaagatatacaggtatcttttttttttttttttttttttttk

SEQ ID NO: 8258 - DNA, 426 bp, Homo sapiens
taaatttctttagagtaaatacctcggaataagattgttgggtcatatgattatgtttwaccatctgagaaactgccagactgttttccaaagtggctgcacaattttacatgcccaccagcagtgaattaaaggttctgacttttctccttcctcatcaatacttgttattttctgactttttgatgatagtcatactagtgggtgtgaaatggtatctcattgtggttttgatttgcatttctttgatggctaatgatgttgaaccatcttttcatgtgtctcctggccacctgtgtatctttggcgaagtattcagatcatttgcccattattaaattgagttatctgattattattgagttgtaagagttctgtatatattctagatacaattctctgtctgatacctggtctacaaatatt

SEQ ID NO: 8259 - DNA, 420 bp, Homo sapiens
  misc_feature 370: n=a, g, c or t
aataccttccttctaaatbacagaaagtaacttttccatacacactgtaaacagcagacactctaacagagcatcggttatgctccatctcctaacctgaaggactcttgtcacacacccacctctgagaacccaagctcctcagtttttttaatcttttggccacatttcatccaattaccatcataccttttatacgttagatttccaaggaggtaagtgaatcacgtaatgggggtgaactgtacccagtcaaaataaccttatctgactttttctatatttttgatattttttctctaaatattaagtctttctcccaagctcatgtctattccttcctaaaagtcaaattgacatgaagtgaaanvtgatgtgttgcttctgaagacaatggattgcttggcatttgggatcttt

SEQ ID NO: 8260 - DNA, 438 bp, Homo sapiens
tatttattaagagcatcacctgggaggacttcagcctgctggctcctggtatgaatgtttgctgcattggcasccagatttgaatggaaggatggagtattttthaacataaaaactaataagcacctggaaacgtaactttgtgggtggtgctgatgcagtgtatttctttatatatcagtaagctagtttttcagtgattcatcaaactaattagcatgggagcaccagaggtgacaaacccatgggttaactctggcttgatgtggtttgtttggcctgtaccaacgatatttaaaatgttattttaggccaggtgcggtggctcaccctgtaatttcagcactttgggaggctgaagcaggcgtatcacaaggtcaggagttcgagaccagcctagccagcatagtgaaaccccatctctactaaaaatacaaa

SEQ ID NO: 8261 - DNA, 419 bp, Homo sapiens
catcagcctagtcctaaaattcatttcctagtagttccagtattctcctgaattatgaggatacaattaatttattggatttttttctgaagaatttaaggttccctgccagcgattcacagtgaggaggcacactcccagagcaggatgggaagggagtttgtttcaaattatcttcattttgtctcataaattctgataaacctacttggaggatcagagtgggtgggaggttgccacttcccattctggtatcactctgcacacagttgtattgtgaactcaaaacagtggagatgcagaaaaaaaagattgaaccactattctatgcagaaacctcttgaacaataaatgttacttaaccactataatctatcacaaggaaagaaaggatcaggataaatatctgatgtgtgaga

SEQ ID NO: 8262 - DNA, 319 bp, Homo sapiens
gcaatatccagaagctattctctgaacgtattgatgtgttcagccctgtggagttcaacaaggtgtcggtgctgaccggcatcatcaaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgargtcatctgcgagcgcg

SEQ ID NO: 8263 - DNA, 89 bp, Homo sapiens
tgaatagatgatcgtggttcatgcctatactccctatactcccagcactttgggaggccaggcttgccaacatggcaaaaccctgtctc

SEQ ID NO: 8264 - DNA, 139 bp, Homo sapiens
  misc_feature 49: n=a, g, c or t
acggaagaaccaggagtttggcgtgaccatggggaagcaaaagaaaacnaggaagtatgcgaccatgaagcgaatgcttagtctcagagatcagaggcttaaagaaaaggatagattaaaaccaaaaaaaaaaaaaaaa

SEQ ID NO: 8265 - DNA, 188 bp, Homo sapiens
gtttttccgcgccavgccctttgaaggggtggtggtcgacgggcaagtagagaccgagagggtctggaggggcgaccsgsctkggcacagaaggggaaggawgagagcgggatgctaagtgccgtctggggagccggagggcccggggcgggcggggctgctcgaggacagccgagcagaaaagagtt

SEQ ID NO: 8266 - DNA, 459 bp, Homo sapiens
ttcattcagttggataaacagggcaggaaagaagaaaacccgattttactaaggtaaatgggcaaaaactggaagraaagggraktgtggttttggagagggtcccgatggtaagatcctgattggaaggtgtgttggttaaacaatttctgaactaaccgccagatggcatcactggccaggactgtttactacctgctagaaggggtagggcaaagtgaaacgaagccactctagggcgaatggggtaaggggaaagcaacgaataaattgccctttataaagatgatcacagattggatatttattactcagtgtgtctgtatgcagtactagggtggactaatgtctcacttcaaaaaaaatatgagtgtagtatacttggcctaaaattgttactcagtgttactaaagtgtaatcattttccacatctccaaatatattccaagtctctgaaa

SEQ ID NO: 8267 - DNA, 447 bp, Homo sapiens
gaatttgtaaatgctgacatagctatcaaagtaattctgtatttcataaagctaaagaaatggaaggaaaamgtttttcytcmagctggagcaaagtgtaacaaaatattgagatatctaccatttcaagaatttccaactttgtgccaaaaaagaatctagaagaagttgccagagaaagtatggttttcgttctttcagggataaattttcctctcctgccagaagttgctttgtagcttgcagtcatttcgagacattactggtcttttgctttatagttaggtgttcagcattcctaagaaattctcagtatagaaaaggaccatctgcactccaaaagcacatgtcccctccttctaccttactgtatttttaaatgagtgtctgtctggccacttttcattctttataaaaatatagtatcaacctgaagttctaaagagt

SEQ ID NO: 8268 - DNA, 451 bp, Homo sapiens
aattacttgctccaacagctagatcaaaggctgaacattttgctttagtatagatgagggaaatgagcaagtcctaaaaggktttgccctgttacggtgtttcatcactcatactggaaggagaaggaaaggagccatatgactcatttaaaagaaaaactgatctgacacatcctcttggtttcctaagtcttatgactagccaatgcgtgaaataatgaactcctccaaggcaagaaatctgttttgaagcttctctgcgttcacacacagcagcctggtttcctggaagggcattttccacattgtgcgttatggatgatcatcccaggcatcaggtgtgaagccctgcatccacatccaggggctatcaaatctctctgcaaaaggagaagctggactcagttctgtgaaggaagctgcagaagaaaaaggtgaaagaggtgaggaa

SEQ ID NO: 8269 - DNA, 467 bp, Homo sapiens
caattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaacccttctctgctaaaaatacaaaaattagctgggtgtggtagcgagcgcctgtaa

SEQ ID NO: 8270 - DNA, 342 bp, Homo sapiens
agactcgagcagtctctggaacacgctgcggggctcccgggcctgagccaggtctgttctccacgcaggtgttccgykcgccccgttcagccattggtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggcgtacagcagctgbaggcggagggcctgagcccgcgcttccaccagstggacatcgacgatctgsagagcatccgcgccctgcgmracttcctgcgcaaggagtackggggc

SEQ ID NO: 8271 - DNA, 374 bp, Homo sapiens
gcggatttggtctctgtgaggtccctctctgtatatccactgtctgggttgggtgtgttgagaagcaggtgttgggaagttgtctcaggggactggktttycmaggggagttgaattagggcagccacagaagggaagacagaagggctggctgtcaggatgcatgactttgcccggggtgggttctgagccatgctgtgtgggagaccaccgctactgatggccagtctgggtgtagtgctctggggcagggctagacttgtttggggcaatgactttggcccatttataaatatgatcaggttttgcaagtaaaagctgtggccaccacagacagctgtgtctgaatgcctttggtggccgggtgtggtggc

SEQ ID NO: 8272 - DNA, 196 bp, Homo sapiens
ttttccactastcatttcacttctaacttggtataggaagcttagctctctacatacctatcatgtgccctgtatcacagaagattcaggraaaawkgcacttggggaatcaaagamaatggaacttctttttgaaaagacaagcaaccatgttaactgtattgacacatcctcaataaaacctgttgcaaaaaam

SEQ ID NO: 8273 - DNA, 468 bp, Homo sapiens
ccctcctcatcttgtgcatagctcagctggttcctggactgtgggcctgacagcggctttacttcattgccaatagtgtcttcctccttgagargktycakgtgttgcacagaacagtagccacacttattgagtattgtacttattctttgtttttgagatgagatcttgctatgttgcccaggctgctgtcgaactcctgggctcaagtgatcctcccagcactttgggaggctgaggcaggtggatcacttgaggtcaggagttcaagaccagccttgccaacatggtaaacacctgtctctactaaaaataaaaaattagccaggctgggtggcgcacacctgtggtcccggctgcttcagaggctgaggcaggagaatggcttgaacctgggaggtggaggttgcagtgagtgaagatcgtgccattgcactccagcctgtgtgacagagcaagactcagtct

SEQ ID NO: 8274 - DNA, 374 bp, Homo sapiens
tctaatctgatgtgagctcatgttacacagacttttagtaagtaacccgtgactagaaaataaactggatgcttaggagagagtgtcagatgtataagatgctaataaaacctgtttaatattattgttagctgtaagtttttgggaaatactgaacaaattagtccacaatcaagtgtctacttttcccttcactgtagggcctctccctgcacagagcagtctgtttagctgtgaacaccacaatctgcagatgttcaagtcccttacataaaatggcatagtatttatatgtaacctatgcatattctcctgtatattttaaatcatctctacattaaaatacctgataaaatgtaaaaaaaaaaaaaaaa

SEQ ID NO: 8275 - DNA, 395 bp, Homo sapiens
tgaatttataacactttacagtttatgaaagactatataaaggttccttctcacaggctgtaaggggtacaaggacaatgaaactcagatgacatccttaaatgcactctactattatatggctaatttaagattaaaaatctggtttcataattattagtctagtggtccttttataggcagcataatacagttgtaaggagtacaractgcctgtttttgratcactggtccatgctaactagctggcttaccttgggcaagttacttgagtttctctgtgcctcagtttccccagctatcaaatagatctaagagttgtgaaaattcaatgagttgatacatataaaaatacttaaagcagtgcctgtccaacataaatgcttaataaatgk

SEQ ID NO: 8276 - DNA, 498 bp, Homo sapiens
caaggtacacaccttttcctcatatgacctggttcaagagcaaatggaaattcctcagggagggtagagaacagtccctaaatgttactgctttcagggccactttgggtacatgctagaggtggttcaatttgggattatgtartatagtagtaaaaagcagggaccttgcatagaattatacacarraatataccacaaaarrtaatagtggtgcagtggctgggtgcagtggctcacgcctgtaatctcagcactttgggaggccgaggcggatggatcacttgaggccaggcgtttgagaccagcctgggcaacatggtgaaaccccgtctctactaaaaatacraaaatcaactgggcgtgttggcacacacgtgtaatttaagctactcagaaggctgacacatgaaaattgcttgaacctggaaggcaggttgtggtgagccaagatgacgccactacactccagcctgggtgacagagcgagattctatc

SEQ ID NO: 8277 - DNA, 240 bp, Homo sapiens
agtagaggttccacatcagcatcgacagcagtggcagaaacgtcaggccgtagccgaagcctcggaaggagcggsccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaaaaaaaaaaaaaaa

SEQ ID NO: 8278 - DNA, 479 bp, Homo sapiens
ttttcatcctctgtttggtgagcatgtgttctggcatagtgaactgttttgtttttatttatttattatttttttgagacggagtttcgctcttgttgcccaggctggagtgcaatggcatgatcttggctcacctcaacctccgcctcctgggttcaagcggttctcctggctcagcctcccgagtagccggaattacaggcatgcaccaccacgcctggctaattttgtatttttggtagtgacggggtttctccatgttggtcaggctggtcttgaactcccgaccttaggtggtctgcctgcctcacgcctgtagtcccggcactttggggggccggggtgggtggatcatctgaggtcgggagtttaggaccggcctggccaacatggtgaggccccgtttctgctagaatacagaaaattaaccaggcgtggcgatgggcgcctgtcgtcccggctactcgggaggctgaggg

SEQ ID NO: 8279 - DNA, 413 bp, Homo sapiens
  misc_feature 365..366: n=a, g, c or t
ccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatctkatcaannatwcctgtaggtaaaagtacaagacgacctctagatgtcttttcttt

SEQ ID NO: 8280 - DNA, 70 bp, Homo sapiens
aattgtgttcgcagccgccgccgcgccgccgtcgctctccaacgccagcgccgcctctcgctcgccgagc

SEQ ID NO: 8281 - DNA, 180 bp, Homo sapiens
tcgatactttaaaaagattcatgcttaaaaaataataataggccgggcgcggtggctcacgcctgtaaaaatagataawtaagttacacagatagaagawagaaacagagaggaaggaaagaaggaaggaakgaaggaaggaaggaaggaaggaaggaaggaaggaaaaaaaaaaaaaaa

SEQ ID NO: 8282 - DNA, 62 bp, Homo sapiens; identical to SEQ ID NO: 8200

SEQ ID NO: 8283 - DNA, 442 bp, Homo sapiens
ctattttcaaaggctattagaaggcgttagtagcttttcagaccttgtagtaaaattgtgttaataaaaataaatraataaaagtcacccagtgaagacataaataagtgtagaaacacaccatgttaatggattagaagactcaacatagtgacaatgtctactttccccaaattgatctgtagatttaaagcagttccaataaaaatcccaacaagacttgtggatataagtaagctgattctaaaatttatatgaaaaggcaaaggaactcaaatagccawaacaattttgaaaaagagcaagaagataaggagactcacactagccaatttaaagacttactataaagctacagtaatcaagaatgtagtattggtggaggggtagacacatcgatcacaggaacagaatagagtcwagaagtagaccacacaattca

SEQ ID NO: 8284 - DNA, 480 bp, Homo sapiens
ataaatgactccatgagagaaaaatgagaagagttcaactttggactggatagccaaagaccttgagatagaaaagagtgaggatataaagaatggcaaacccactaaggaaagaggtgaaaagtgaggtaagggaggtgcccagggcttagtcattagaaccagttgtactcagaagccattaaaaaatcccagcaggagaggacccacggtccagtccatttctcaaagaagtaaggtaacctactttcatgttatatagctagtcagtaggaagacttagattcagcttgtagttttttaaagacacgtaacagattcagaaaattagataagtgaaatttttagatctgctcagaaatatcaaagtatatcatataaatatatctcccgggccgggcgcggtggctcacgcctgtaatcccagcactttgggaggccgaggtgggcggatcacgaggtcaggagatcgagaccatc

SEQ ID NO: 8285 - DNA, 404 bp, Homo sapiens
ccctctatgtctctttgtgtcgctttcattatgtctcttggtaactggcttcggttgtgtctctccgtgtgactattttgktctctytctccctctcttctctgtcttcagtctccatatctccccctctctctgtccttctctggtccctctctagccagtgtgtctcaccctgtatctctctgccaggctctgtctctcggtctctgtctcacctgtgccttctccctactagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaacccatctctactaa

SEQ ID NO: 8286 - DNA, 202 bp, Homo sapiens
  misc_feature 137: n=a, g, c or t
ctttttcaggckssggtcggctgccatcaccacagaagcggcttccaggccttcggcgggaggctggccctcttcctgcccggctttgatcgccacatgaccgcgacccccaacaactcggatctggggagtaccgncacggcccgcggcatcctggggtacgcccccctyctctgaaggcggtggaggcgggagcgcgacs

SEQ ID NO: 8287 - DNA, 353 bp, Homo sapiens
attgttcggctgggggtcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggavgagcagcagcgggaggaggagccgtgtgccctggcactgagcggccgcggccatggcgtacgcctatctstbgrrgkacatcataatcggcgacacaggtgktgggtaaatcatgcttattgctacagtttacagacaagargtttcagccagtgcatgaccttactattggtgtagagttcg

SEQ ID NO: 8288 - DNA, 296 bp, Homo sapiens
ttaatatgtgrkdktgagcaatatagagaagttgaaagacaaatatatagaaaggtccatgtttcctttgaccatataaactgtcattaaaaaaacaaacagaaaaatagaacaaaacaaaaacaatctggtaagagggccaggcactgtggctcacacctgtaatcccagtgctttgggagaccgaggcaggaggatcacctgaggacaggagtttgagactagcctgggaagtgtagcaagacctycatctctacaaaaaataaattagctgggtgtggtggcatgtgcctgtg

SEQ ID NO: 8289 - DNA, 316 bp, Homo sapiens
cacatttcaacatggggatttgcagaggccagtatctaaactatagcagatactgttccacgtctttggatttttttttgttttttgagacagagtcttgctatgttgcccatgctggagtgcagtggcargatctcagctcactgcaacctctgccgcctgggttcaagcaattcttgtgcctcagccaactgagtagcygggattaaggctggtctcaaattcctggcctctagkgakssrvacgggttggcctyccaaggtcctggcattacargagttgagccaccacaccctgcccagatctttggatatk

SEQ ID NO: 8290 - DNA, 290 bp, Homo sapiens
cttgcgatagttkvctgagaatgatgatttccagtttcatccatgtccctacaaaggacatgaactcatcattttttatggctgcatagtattccatggtgtatacgtgccacattttcttaatccagtctatcattgttggacatttgggttggttccaagtctttgctattgtgaataatgccgcaataaacatacgtgtgcgtgtgtctttatagcagcatgattcatagtcctttgggtatatacccagtaatgggatggctgggtcaaatgacaagcaatgggga

SEQ ID NO: 8291 - DNA, 327 bp, Homo sapiens
gaaaccggktgsscttagaggttagacttttgaagaaaaaaaaaaaaaaaagatacagatcttttcccctggccaaagggaagttgtattagtctgtgacatcttgtgatgctgtttatcttggtttgacattggagatacgctagtaactgkgataccatactataaaacagaagaattttctgctactaaaaactgcctttttacaaaatgactgtaaatatttgtaaaataaaataacactaaactttaagcccaaaaggagagatagagccatgtgttcagttgtggacctgtscgtggggcacagtgccaccccatcacagk

SEQ ID NO: 8292 - DNA, 457 bp, Homo sapiens
catgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctaaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaaaaagttttcccggt

SEQ ID NO: 8293 - DNA, 241 bp, Homo sapiens
aaaaaaaatcctrgagkgactgaaccagaggattggaaagaacattttctagggtgcattttccagatagtaatcactgttttgktttatttttgkttttctctatcttttaggtctgttttgcctgaacccatcaacagctgggagattaatcaaccacactgaaaatgtggagggatttatgggggagggggttgaaatkgggtgttttgaaacaaaagtgtataaacaaatgaattgk

SEQ ID NO: 8294 - DNA, 287 bp, Homo sapiens
cagtttarkbtgktcttttttcttttttctttttttttttttttggagacagagtctcgctctgtcgcccaggctggagtacagtggtgcggtcttggctcgctgcagcatctgcctcctgggttcaagtgattctcgtgcctcggccttgcgagtggctgggactgcaggagcgcttcaccacgcccagctaattttttgtattttggtggagacagggttttaccatgttgcccccatcattctcagcaaactatcgcaaggacaaaaaactgaacaccgcttgk

SEQ ID NO: 8295 - DNA, 218 bp, Homo sapiens
gccttttcccggaatcctgagagcaacgcaggccaaggcaaagtcccaaaaggaccagtgaggacatacagaccagctcgcaccagggcacggtcgccggctcctgacggsggggccctcggtccgcgaggtgaatgaaccagggctgaagagaaacaggccctyctygcacccgggcctycgcgcactctcggggaagcgaactaccgtcggccgcg

SEQ ID NO: 8296 - DNA, 292 bp, Homo sapiens
caagggctcagaactgaaggcaattatttcttttggtggacttggaatctccgtttgtctacactgtcctcttcacagtggagtctttttatttcagacctacagattgkttttatattggwttgtcacagtgtgacaattttttgtacagtcggttttaaggtcttctctgccattagagccagtaggttacagctattgatgtaactatagctgcaatttttgtgcaggactgakaaacacagtgcattatttattgcggaatcattgctgctaaataactactgwctgd

SEQ ID NO: 8297 - DNA, 280 bp, Homo sapiens
  misc_feature 120: n=a, g, c or t
acacrscgggcccggctcctgagggcgccagcgcggccccggggagcgcgaggagccggcgaagcgcgcggyctgccgttggcggcctggtccgmarcgccctgcgmccaayysgkcccngracktggggcccaagcccccgtgaagatggtgtmctggatgatctccakagccgtggtgctggtgtttggaatgctttatcctgcataattatttcatacaaaagctgwgaaaacaaaaaacgtgaaakgaatatgttcgatggatgatgtactggatt

SEQ ID NO: 8298 - DNA, 100 bp, Homo sapiens
agtgssagcggcggctacggtggtggcagttccggcggcggcggcggcggctacgggggcggcagctccggcggyggcagcagctccggcggcggatacg

SEQ ID NO: 8299 - DNA, 339 bp, Homo sapiens
actaakrrtcctctagaaagaaccctgttagatcttggtttgtgataaaaatataaagacagaagacatgaggaaaaacaaaaggtttgaggaaatcaggcatatgactttaatacstwaacwtcagawctttyctataatatcctactactttggttttcctagctccataccacacacctaaacctgtattatgaattacatattacaaagtcataaatgtgccatatggatatacagtwcattctagttggaatcgtttactctgctagaatttaggtgttgagattttttgkttcccaggtatagcaggcttatgtttgatggcattaaattggk

SEQ ID NO: 8300 - DNA, 369 bp, Homo sapiens
actckkstgttctattcttcctaactagatgttctacaaaattgcttgtgccaatagctcattatatttcctcttgtcagtcttttgcaaatacaccttatttggtctgtaacgccctcttttttgcagtgttttaaaactgcttggaatcatcttttttttgaatcattgtccgctttcccagatagaaaatagtttgcctacagccgggcatggttgcttacgcctgtggtcccagcactttgggaggctgaggcgggcggatcacgaggtcgggagatcgagaccatcctgaccaacacggtgaaaccccgtctctactaaaaatgcaaaaaaattagccaggtgtggtggcatgcaactgtaaty

SEQ ID NO: 8301 - DNA, 346 bp, Homo sapiens
ttacgtgtttcagagtttgtattgtgattatcaattaccacaccatctcccatgaagaaagggaacggtgaagtactaagcgctagaggaagcagccaagtcggttagtggaagcatgatttggtgcccagttagcctctgcaggatgtggaaacctccttccaggggaggttcagtgaattgtgtaggagaggttgttctgtggccakwatttaaacctatactcactttcccaaattgaatyaccgctcacactkctgatgattttakwgtgctgtycggtggagatcccacccgaacgthttaatctaatcatgaaactycctagkttccttcatgtaacttm

SEQ ID NO: 8302 - DNA, 168 bp, Homo sapiens
gagccggagccgccgccgccgccgccgccgccgcgggcttcgttcgtaaggaagggggcctaggcccgggcctgcggtggtgggggttgctgcgcgccgggggtygctyctgvtgrgyctttcgmtcyagcttcggcccayttccccttgccagyggggtgggcgcgk

SEQ ID NO: 8303 - DNA, 66 bp, Homo sapiens
cttsskgcggyggccgccaccagccggaatmgcaaccggcggagcccgtgcgcaccgcagcgcagc

SEQ ID NO: 8304 - DNA, 106 bp, Homo sapiens
agtskgcgcctcccgctccccgcctccggccgggtccgggacgccgcggctgtggggtcggcccgctaaggacaaggtcgggagactgggtggcgatgcccgagtg

SEQ ID NO: 8305 - DNA, 358 bp, Homo sapiens
taaagaaaaagaggtttaatggactcacagatccacgtgactggggaggcctcatgattatagcagaaggtgtaggrggragcaargtcacatcttacatggcagcaggcaagagagcttgtgcaggggagctcccctttataaaaccattagatcaggcagggcacagtggctcacacctctaatcacagcactttgggaggccgaggcgggtggatcacctgagatcaggagtttgaggctagcctggccaacatgttgagggccccgtctctaataaaaatacaaaaattggccaggcgtgatggctcatgcctgttgtcccagattcttgggaggctgaggcacgaaaattgct

SEQ ID NO: 8306 - DNA, 425 bp, Homo sapiens
acctgagcagagattgtttcctatttcagataaaatacagtgaaagtgagcaaggcagaaaaagtcaacagatgsccaggstycctactttattctggagatactgtcagagctctaatacagagcactggccataatgaaaagcagttcactccttgtgctcctctgcagatgtttttcccagtgttctaggttaatgttttatttggttgcctgcataatccctgttctgtttcactgatggtgtttgcagcaccactgttcatggtggtccactgttatcctatgccagggtgctaagaattgcatgatattcatcttccctgctctatttaaatttacatctataagagtcatcttgacattaacactgaaatgtgatctaggtccttaaccaaaattgctgggcaacttgtaataaattt

SEQ ID NO: 8307 - DNA, 393 bp, Homo sapiens
actgggctgtacggtgcgcgtgacggctgcgtgcggcgggaatcatggctgctcgcagcrkctgcacttcgtattcaagtgggaaaccgcttccagacggcgcgtttctatcgggacgtcctggggatgaaggttctgcggcatgaggaatttgaagaaggctgcaaagctgcctgtcaatgggccttatgatgggaaatggagttaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagcttggccactgacggaagttgcagaagggtgtttttgaaaccg

SEQ ID NO: 8308 - DNA, 338 bp, Homo sapiens
  misc_feature 31..33,36..38,45: n=a, g, c or t
ccactacacctggctgaggttcctctrcctnnnccnnncccagtncccacccctgcccccagccccggggkgagtycawkybkcccagggtaccagctgcgcttgcktkkctgtatttwatttagacaagagatgggaatgaggtgggaggtggacaagggagaagaaaggtgagtttgagctgccttccctarctttagaccctgggtgggctctgtgcagtcactggaggttgaagccaagtggggtgctgggaggagggagagggaggkcactggaaaggggagagcctgctggcasccaccgkggaggaggaaggcaagagggggtggaggggk

SEQ ID NO: 8309 - DNA, 272 bp, Homo sapiens
acttttccgggagtctccagctggccctcatttgtgtccggagctcaggagttcccaaaccgactcagtcgcaccaagtttccgtcttttggaattggggaaggagtttctttctttcttttctttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaar

SEQ ID NO: 8310 - DNA, 333 bp, Homo sapiens
caaacatattatccctgtcttcaacttgttgcccagatgatttcatttaaataatatagaagtacaaaaattagctgggtatggtggtgcatgcctgtagtcttagctacttgggaggctgagataggaggatcgcttgagcccgggatgttgagtctgtagtgagtgatcatgccactccactccagcctgggtgacagagtgagatcttgtctcaaaaaataataaaaaattaaataatatataagatacatatatatgtatgtgtgtgtgtatgtatttgaaattttaaaaagtgggatattctgccggacagctggtttgggttttttd

SEQ ID NO: 8311 - DNA, 414 bp, Homo sapiens
cactttatagtattattaatattatatttcagacaaactgtaggtcatgtaggtgctgagggaaagaattgggaactgtgaaaaccattgtttatatagaagctgtcttttgagttccaaacaaatgtggagaacgtaagacattgacagcagctgggtaccgcctgcactgtctccttctccaaggcagcaggatggcatagacccacaggaaggactctctaattatgctaattggccaagatccaggcagcagagttatctatgctaaatggaagaaagatttcttgtctgtgcatggtggcttatgcttgtaatcttgaccctttgagaggccaaggcaggaggatcacttgagcccaggagtttgagaccaacctgtgcaacaaagggagatgctatctctacaaaaaa

SEQ ID NO: 8312 - DNA, 228 bp, Homo sapiens
ttcttcttgataattttcctgtgttttacaaatatttaataatgaatatgtactactctaagaaaaacagtacaaaggttttcaaagttttttgacagtcatttacctgcagtaagtacgttatacatcccaaccccatataaactagcatttatgtatttataaacttaaaacaaacattagttaaccatttttttctacttgtcttgctttttttttttttttttk

SEQ ID NO: 8313 - DNA, 432 bp, Homo sapiens
caatggccagaaaataatctatatgttaatttgttaatttgatggttcatggttcaaggctgtacaatttaaaaatttgaagtcaaacaacacatgatggataatcctgatgttacagattctcagggcagaatatgtatttgttttttctaccaattgttctagtatttacagacaaacttcttaattatactgggttggttaataagtatttttctttactctttcaatctaggtccagctatgcatcaccccttcgctgatgagcatttagaaaatccaaatttggccgggcgcggtggctcacgcttgtaatcccagcactttgggaggccgaggcgggtggatcacgaggtcaggagatcgagaccatcctggctaacacggtgaaaccccgtctctactaaaaatacaaaaaaaaattagccgggc

SEQ ID NO: 8314 - DNA, 107 bp, Homo sapiens
aaaacctcgcctggctcctagctggtgctgaagctcgtcagttcaccatccgccctcggcttccgcggggcgctgggccgccagcctcggcaccgtcctttccttts

SEQ ID NO: 8315 - DNA, 361 bp, Homo sapiens
ctttgggatcccaaggcgggcagattacttgaggccaggagttcaagatcagcctggccaaaaatggcaaaaacctgtctctacaaaaaakrccaaaaaattagccaggcgtgatggtgcacacctgtaatcccagctacttgggaggctgaggtaggagaatcacttgaacctgggagacagaggttgcagtgagctgagatcatgcactgcactccagcctgagtgacagagcaagactctgcctccaaaaaaaataaaaaattagccaggtatggtggtgggctcctgtagtcccagctacttggggagctgaggcaggaggaacacttgaacttgggcgcaggagtttgaggttatg

SEQ ID NO: 8316 - DNA, 341 bp, Homo sapiens
gagccggcctttggtaacgccacctgcacttctgggggcgtcgagcctggcggtagaatcttcccagtaggcggcgcgggagggaaaasaaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagsgtggttcctttcgtgctggcgccgsgayctccggatgacccgggcttcggsccccamcagagactcgagaagcttgattctttgctctcagactacgatattctcd

SEQ ID NO: 8317 - DNA, 416 bp, Homo sapiens
ttatttgttgaggttatttcctctgagcagtctgcctctcccaagccccaggggacagtggggaggcaggggagggggtggctgtggtccagggamcccsaggccctgattcctgtgcctggcgtctgtcccggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggtdctttcagttcaaaagtgagatgtctggagatcatatttttttatacaggtatttcaa

SEQ ID NO: 8318 - DNA, 353 bp, Homo sapiens
taatgaattatccaagattcgatgggatttatcagtgtgtagatagctctataatgcttgaattgtacacttctaagtgtgcagtgcaagmrctttsdtkaawakkkcatacttkttatactttgaggaraaaaagtcaaagaaaaattgtatttgagggaaaaaaccatgaccaattaaaggataaattcaaaaaatagcctcatgagacttggcatacacactcgtgggattccagttatkatggagtgcttccatccctctccaccccttccccccaaaaggttttctttgcaagtgcttttggaactaagagctagtatcttggattaactgatgcctgctagkgcttt

SEQ ID NO: 8319 - DNA, 433 bp, Homo sapiens
acaatttatgtgtttagtgtagtttgcagtgttcccttattatgttttgctgtgtgatatgcccttcatttctgatattgataatttgkatatttctkatttctcagtcttgctgaggggatgccgattttattaatcttttcaaatacgcatgttgttcatcgatttctccctgttgtgctgttttcatttttgcgtacttgtgctcttattttctttctcttctgctttaggctgattttgctcttcttactcttgttttttgatattagacctttgattatagatttgagacttttcctcttttctagtttatacatttattgctattacttttgctgtgagcactgctgtagctgtgtcccacaaattttgatatgtggtatttkcattttcattcactccaatttckttktctttcacttgagacttc

SEQ ID NO: 8320 - DNA, 337 bp, Homo sapiens
caaaatttattatgaagctaaaataatcaagggagtgtggtactggcataaggtcagagagattgataaattaaatagaattgagaatccraraactaavccctaatatttatgaccaattgattttcaacaagtgtgccaatacatctcaatggtaaaaggaaagtcattttgggctgggtgtggtggctcatgcttgtaatcacagccctttgggaggccgaggtgggaagatcagctgaggtgaggaattcgagaccagcctggccaaaatgatgaaaccctatctccattaaaaatacaaaaaattagctgggcgtggtggagtgcacctatk

SEQ ID NO: 8321 - DNA, 398 bp, Homo sapiens
cgattttttgtagaaacggggtcttgcccagccatcccattactgggtatatacccaaaggattataaatcatgctgctaagrcacatgcacacatatgtttattgcggcactattcacaatagcaaagacttggaaccaactcaaatgtccatcaatgatagactggattaagaaaatgtggcacatatacaccatggaatcctatgcagccattaaaaaaggatgagttcatgtcctttatagggacatagatgaagctggaaaccattattctgagcaaactatcgcgaggacagaaaaccaaacactgcatgttctcactcacaggtgggaattgaacaatgagaacgcttggacacagggtggggaacaccacacactggggcctgtcgtgar

SEQ ID NO: 8322 - DNA, 396 bp, Homo sapiens
tcatgattagctaactttcaccaacatcagtaaggaagcagcctgaggcatccttctattcctttttcttcttcaaggttgttatgtttgtcctttgagttgtcagcacccttcaaaacgctctctgtaattttagaacctttaatatggtgaacatcaagcatctcatcatgccaaatgtaattttccacacccccagcatttaatgtgttcacaggaaatgaaaaaagaatcacacttcctctctttgcttgttccttatgctttatcgaacaccattttaatgccaggcacagagtgagagaccagagattaaaaaataaaagatgaacagggcttatcactgcccacaacaaactcatgatctaggcaacacattattttgtgtactgggga

SEQ ID NO: 8323 - DNA, 353 bp, Homo sapiens
ctaaacaaccttttctcctgagtctttggcatcagttagaagttaaaaagcactgcaagttttttgtaatcctgaagaggaggaaaagatgccaaaccagagtttattcaagataataagtggtatttttgagagatttattctctctcctctgaagcctgtttctactttagtttcacttccattttcctgcttctttgataggcagtgagatgatttttaatagcacatacactctgtcctgtttataggttgctatcatttaatgagaagaaagtcaaataggacaaaaccgcaaatctttgaaacaaaactagaaagccataatggaggctgggcatagtggctcatgc

SEQ ID NO: 8324 - DNA, 459 bp, Homo sapiens
gtaaaataagatattcacagtaaatgatagactattatagtgctgagaatgaattgttcggcactagaaagaaagaacaaataggtaggcagagattttgtgcatataggtatttgaaatgtccaattaataacttaagcaagatatggtgaaaacatgaatatagaagtgagggacagattgaggactagatttcataaatatttagaaaggcaaactgtcagtaatgaattttgatattggatgtagatataagcgttaagcagtctaaattccaaaatttttagtcagtgctgcatgaactgaaataagcagcaaaagaaaactaaaacaatgtctgtgtgctgatcccttgaaattaccttgtaacactgccaaaggaaaatggcactgagcaccaagtttgttatagtttcagttgtgcccaagtgagtctccagagttggtgaaatctcaagc

SEQ ID NO: 8325 - DNA, 401 bp, Homo sapiens
tagaagagagaggggaggctggtgggtgaatgggatgggagtattttaccgcagtggataattggttttgtcaagagtgatggatagtagacctacagtttgaaagtcagaaagactgagaaatttccctttaatctggtagatagtactcaatttgaaaactttttctttccaaaccagcaacagcatgttcgaaaaatgttgttcgttagcaaactaaaacatcttagtaaaaattaaggctaaaaatcatagtttctttattattttgtcagtttgagtaaagttgtktctttttctcttccagaagaatggttgagaccggtgatgagaaaagagaagcaagtgttagtgcattggggcttttacccagacagctatgatacttgggtccatagtaa

SEQ ID NO: 8326 - DNA, 412 bp, Homo sapiens
aatttctggatgatgatgattgttatttaatagccagaggtcatataattggcctctttggaagaggcctcatggctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactc

SEQ ID NO: 8327 - DNA, 277 bp, Homo sapiens
ttggatgtaccagttcttttttggtttatctcagagtgaaaactacttctttttccaaactgggagagagatacatgtttcaccacaagggcagccaggcaagggggcacctttactctcacacatctaggaggtgttttagtctaggctctattgctaaggggccaataaaaatatttttttctcactggaccatttttgtttatatacatatatatttacacaaatatatgtaaaattcaaaatgcaaaaatatatgtagtggccgggtgctgtg

SEQ ID NO: 8328 - DNA, 378 bp, Homo sapiens
gggactgtgtctgccgagctcggcgggctgtgcttggtgagtggaggagcggcgcgtggaggcagaggcgagcgcgggcgatcgcggcggcgggacgtctccggcggccgcggcaccagcgcggcgctctgtgtggagaagcaggggcagctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggktctttttgacctgttaaaa

SEQ ID NO: 8329 - DNA, 360 bp, Homo sapiens
ttttgatgtataggttttgatgcatagattttaaaagttcatgaaaatgttactttaatgttcaagagagagatgaaggtgaatggaaaacgkaacattattttgttggccctatttggtcgttctggttgttgctggagaatgtgagagattgtgattcaggtcagatactatcttgaaatcaaatatgagttccagatactcttatagcccagatatttccaaggctttgctgacagcttaattatttcaagcaatatttgatatggctgaagacctgttgtccaaagaatttggatgtccttttgggctctttttttcaatgkaagccttgccaaaagatgtgaaaatckgcatgak

SEQ ID NO: 8330 - DNA, 349 bp, Homo sapiens
ttgtgatattaaatttaactatgatagttaattaaaaagacatatcttgtattcattaraaatattttaatttarartattctgatttctaaagtgtgttagcttakcagttattyybgtttataaatagactttaatagctctctaagaatatgacctctaaaggaaaagatgattttttacaatacatacttctggaactttgagatttgagaaagcttccatgtatattgataaatctaataaaataaagagatcaattataaacvtggttgttctataaaagtagagtgcacaaaaaaatgtcttgtgttttatactgtctaagatttggaggaaatgtggcaaa

SEQ ID NO: 8331 - DNA, 457 bp, Homo sapiens
tggataaagagtgaaaatgaataaaaactaatggattgttcagtcgaatagcagatggtacaatggtacatggccagtagaatagggggacccaataaaattgaagaccagtcagagtgggagtgatcaatccagcaaagtggaatggcaggggatcgtaggcacaaggtccagagtgtaacagtgacaatgtgtggctgatgtgggatcgaggaagtgattgttttttttctaaaagttttccttgccatctcaggataccactccgttaaatattatggctagaaagaggaataagagatactaggaacataggaaatttttaaaattcttatctagcatgtatttcttaccttacatatgtcaggcagtaaaccccccaaaacataaaacgaatgggacagtatgttccttggtttaccgttgtgcttgagctcgktatgctgtacagtctcac

SEQ ID NO: 8332 - DNA, 90 bp, Homo sapiens
tgttacgctgcagatcggcgccgttacagacgtggctactatggaaggcgccgtgrscctccccggaatgctggtgagattggagagats

SEQ ID NO: 8333 - DNA, 167 bp, Homo sapiens
acagttggtggtaagtatttggctttatttctgggttctctattctgttccattctatgtgcctgtttttatgccagtaccatgctgttttggtaattamcaggcttgtagtataattagaagtcaggtaatgtgatgcctacagatttggtttttttttttttttg

SEQ ID NO: 8334 - DNA, 386 bp, Homo sapiens
ctttgagacctcctacctgaagggggctgctggctgtggggtcccgcttgtgcccgcctcctccttctctgtcttctatgtcatgtgaggctggcattcccacgcgtgattccaggcttgttgttcatctacacaaaacttttaatacgattttgacaaaaaacatagaaaaggatgacttgccctactgaatattgaaatgaaccgtggactaactatgaactttcaaacaatccattagtggctgagaaataaacagaaaaatcaatggcccaacacagacagtggagaaacaggctgaggagcatgtccaagtttgtatggtcaggagtgtgcctttcaagtctgtggggaaatacgtgtggaaaagcaagacaggagtgtat

SEQ ID NO: 8335 - DNA, 389 bp, Homo sapiens
agtggaatcgcgactatgggagctccggggggaaagatcaaccggccccgaacggagctgaagaagaagctgttcaaacgccggcgggtgttgaatcgggrascsggsgtctgaggcaccgggtggtcggggctgtgatagaccaagggctgatcacgcggcaccacctcaagaagcgggcgtccagtgcacgtgccaacattacactgtcagggaagaagcgcagaaaactsvtccagcagatccggsttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaa

SEQ ID NO: 8336 - DNA, 356 bp, Homo sapiens
  misc_feature 95..97: n=a, g, c or t
taattcggaatatacctctgtagatagcaaatatcaaatgcatattgttctccttttccccttctacttctccagacaactgagvcattttgagnnnwaatgcagaaccaaatcttcagttgagaatacttattttttaacgtataatctttatatacatattctctagactgttacttgaaaaaaaagtactattttgccagtgtagtcatattattttcatgtatgtaatgtgctagcttttaaggagcatcatatagacttccagactaggtttaaaatgctaaattgcctgcctatgtgtatcatttttcacagggtgaacaaaggagataatgattcctttgacttctgac

SEQ ID NO: 8337 - DNA, 56 bp, Homo sapiens
attgggtatcattcattacattcttgagtttttttgggtttttttttttttttttk

SEQ ID NO: 8338 - DNA, 311 bp, Homo sapiens
  misc_feature 66: n=a, g, c or t
gcgcggagggatctactacgagtcactggccccgtccgcatccttctccagcggccccgggggcgnkgcgccttaactcgatcagggctgcagcggctcgctggcttgaccagtgcagaaggggcgtgggggtgaggggggtggggtaggactctgaacttcaagcactggagtttgccgggatcgtgaacttgcagggagaggcggtcctcatccagtgaggtactaacagtctaagcagaaaaagaagaacagatggtggtaagacctagaatgtttaccccattaagatctatatctgaatccagaag

SEQ ID NO: 8339 - DNA, 289 bp, Homo sapiens
ctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacggtgtctcacagtccaggctggagttcagtggcattaacataactcactgcagccttgaacacctgagctcaaacgatcctttcaccttatcctccagagtagctgggactacagtcgcgtgtcaa

SEQ ID NO: 8340 - DNA, 289 bp, Homo sapiens
aggcaggccacggagatacctcgtggaaggaggaacagcaagtgcatgggccgagtgtgggacttgcctggtgtgctcaaggtggraggctttagggccaccatggcgcasgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgkgctgactccataaacattctctgttgag

SEQ ID NO: 8341 - DNA, 440 bp, Homo sapiens
ctttgctattgtgaatagtgctgcaataaacgtacatgtacatttgtctttatagcagcataatttataatcctttgggtatatacccagtaatgggatggctgagtcaagatggtatttctagttctagatccctgaggaattgccacactgttttctacaatggttgaactagtttatagtcccaccaacagtgtaaaagtgttcctgtttctctacatcctctccagcacctgttgtttcctgactttttaatgatcagatagcctcctatttttttaactatgagttggaatttgctgcttttgatatgataagaaagttcaaagtttctcttccttgctttgttgtgtgttctaattcttttctgcccatcccccagtaaagaaaaggctcagtatgatttcttgaatagattgtttaagctattttcaaaacag

SEQ ID NO: 8342 - DNA, 391 bp, Homo sapiens
tatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggagggatt

SEQ ID NO: 8343 - DNA, 422 bp, Homo sapiens
catgaaatctttgccagttcctatgttcaaagtggtatttatttggttatcttccagggtttttatacctttagcttttacatttaggtctttaatccatcttgagccccactttgttaacaagacgctattcctctttggactttagcttgatgaagccacattttgagaaagagtgcattttggaaatatagcatcttagaagtgatcttagaaagtgaaagattggtagtaacctgctgtgagcagtacaaggaaaataaaactgagttattcctgtgggactacagctgactctcaggtccagcctggcctggagagcatgtgcttttctgctcttccctccatactcttagttagtggtcagcacatgataataggatgtaagggaagaaataaatctctacttgttttattctcaa

SEQ ID NO: 8344 - DNA, 445 bp, Homo sapiens
taataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaa

SEQ ID NO: 8345 - DNA, 359 bp, Homo sapiens
ttttaagaatgttactagcacatttgctaaagaatttccagaatttttacaataaaaagcaatctcacctgattccacagataatcttttggatattgtctcctttcctagtatgatgtttttgaagttttcctgggactggaccagctggtccctctgaaactgtccatttataaaccaggaagagggagagctttggatcaaaatttccctatgtcagttttggaatatctaaattttcctctgcaccccaaccccattgaagttggtgagagaggcacacatactttgtttggggagattcattactctctagtgacttcctgtttccttagtcactgttaaacctacataaaaaa

SEQ ID NO: 8346 - DNA, 387 bp, Homo sapiens
aggagagcccggggactgcatgcgtctgcgcastgcgaggttaagccgccctttggcggtccccaggacggttcctggtgccagacggtcccmaggccytgggcaaggtggcttatgcctgtaatcccagcactttaggagaccgaggcaggtggatcacttgaggccaggagtttgagaccagcctggccgtggtgaaaccccgaatctactaaaaatataaaaattggccgagcatggcggctcatgcctgtaatcccagctacttgggaggatgaggcagaagaatggcttcaacctgggaggtggaggttgcagtgagccgagatctcaccactgcactccagcctgggcgacagagtgagactgtctcaaaaaaaaaaaaaa

SEQ ID NO: 8347 - DNA, 304 bp, Homo sapiens
atgaaacgtggctttccccatatctccctactttcactccacttaattaatatacgtggctgtacattgrcatactatatcatckawtbcttaatrgaggggttttgcttccttagattttaattatcaataacttcattgcagtattctctgctttcttggtttccagctaattgccccacttgttttttgtttgactagttactttcttcttcatttatgacccctgtctgtagcttatcttggcttctactttctcttatgttctcccctgaattcctttacgtatgttaatattaagctk

SEQ ID NO: 8348 - DNA, 365 bp, Homo sapiens
tatcattgctcttatacatgcatgcattaatgatacattcactccttgtttaatctagcattggcatcaggaataggtccttgataactcccattggaaacaaaattgtagtgacttataactatataagagtaaataaatttttttcacaaaacaagacctaactgagtaattctgcttacaaccactacattactctaccaccaactacatctggaaggaaaggaggcacatcttggagctggaatttattggtgcctagtaagagagagttctagagctagggctccaaagacctcccccccaccacctgstacatasacacatatacatatactcagtcaatctagttgtggacaagttgg

SEQ ID NO: 8349 - DNA, 327 bp, Homo sapiens
ttcagaaaactttcccaatcatttcacttcaatcttaattgaacccaagagtcaaagttattattttctccgaacgtgtttggtgrtcttctgttatattttggggcatgttacctttatggtatataagctgtagtgcatactctttgtattgcaaaaaactggtcagtaatttatgtacatgtattccacattttagtgtgcttgaagtgacaatccatagtttgtagtagtttgttatttgtcaactttaccctgtgttttaaggacatctaaacattccttgtcctatcaagatgacaaaagcagaatgtaattttttwwdrd

SEQ ID NO: 8350 - DNA, 393 bp, Homo sapiens
ttctctcccctccactccattctccacctacccacagtgggtcattctgatcaccgaactgaccatgccagccctgccgatgggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccctaccggccagtactggagcccctacccctctgttggaatccctgcccaccttcttctggaagtcggctctggagacatttctctcttcttccaaagctgggaactgctatctatt

SEQ ID NO: 8351 - DNA, 477 bp, Homo sapiens
aagatagaaacaaagaactggtagccagcccaaggggagggctgttggtagcaggaggaaagccagcagcatggactaattagtctcctggggctggaagttctgggaaaatatcactcaggtgatttgtgggtcctgggtggagtttccactcatggtctattgtaggctttaggtttggatcctgggtgggaaggatggaagagctggcgttgctggtgtttagtgaattgatgatattgaatattttaatgggaggatacagctgaagttgaggtttgatccagctcatggccaaatagtgctagagagaacagacaacagttagcctggggtggcaagctgaagacgctgtccccagagtcatcccgagaccacctttgtccttgcccccatggctgccactcaccggagctgaatagatgaagttaaacagcataagtgctataatcgatatgaccataaaggctatgagtt

SEQ ID NO: 8352 - DNA, 425 bp, Homo sapiens
aataaatccagttggagcagcagtgatgagaagaggggatcgacacgttccgatcacaacaccagtaccagcacgaagagsctycctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgsttttggtgtaaataatgtacaatttgtggatgtcattgaatctagaggactttcccctttttatakkkgtattaactttaacttatt

SEQ ID NO: 8353 - DNA, 272 bp, Homo sapiens
tgtaaataaagacaaggtatggtaaaaataaggtgtaaaatatttttaaatggtatacctaaggcacttaccatgaatgtggcttgcagcactgraaattatggtaggtgagccagtgagtgaatgcaaaggcctcagacataattgtacaccattgtaaactttataaatgctgtatacttgggttccactaaatttataaaatatttttctatctaaaaaaaaaaaaaaaaaaaaaaaaaaaaaaaaaaaaaaaaaaaaaaaaaaaawww

SEQ ID NO: 8354 - DNA, 203 bp, Homo sapiens
cactgtggttttgtattgagttttgaaattagaaagtrtgagtcctccaactttgttcttctttttcaaaattgttttgtttaatcygtgycccttgcatttctttgtgaatgcagggatcatgttgagactgtagatcatttgggggggcattgccattttaatggtattaaaaatcttctcatccaaaaaaaaaaaaaaaa

SEQ ID NO: 8355 - DNA, 83 bp, Homo sapiens
ttttcttctctttttatttgattcagggacctagcctctggattttgagtgtttgtggttacctaaaattttgttactttttk

SEQ ID NO: 8356 - DNA, 534 bp, Homo sapiens
ctctttggtatcttaatctatagattctctcttctctcactatttttcctttttctcttcttttccttgaattttattttcgaagaaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctcaactcactaaaatgtatttaacctgwatcctttaattgtagcttagaaatcaaaccaaatgtaaaacaccttgcaggatgtatcttggcagagaaatgtatacaatagaaataacttcagtggtaaacaaggttgckgtatagctgtakatttkkctkcattctgstctgttggttcacaagccattagaatacttgtttcacattggkagttactattcttcctaggagaataaaataagatgacacacaccctcatggatacactctgcatack

SEQ ID NO: 8357 - DNA, 211 bp, Homo sapiens
agaatttaggcgctctcaccctagctaaggccctgggagaaaagactgcctccagggaatcatgtccgattagggacaaaggagggcasaagcccaakkcagtcacacgtgagarcacgggggccgggtggggggagttaagagccaacagggaaggtggaggatgagtttgcaaaccagactatggtcactgcagagctgsttccagacs

SEQ ID NO: 8358 - DNA, 472 bp, Homo sapiens
ttacaatattttgtagagacagggtttcactttgttgcccaggctggcctcaaactcctggcctcaaacgatcctcctgcctcggcctccaaaagtgctgtgatttcagacgtgagccacctcacctggcctgacccggcctttctgagccttcagccctcatctttgtctgggggcattctaaaaaccaaggaatagaataccagggtcagactcagactttgcgttcagtaggccatgaatacttgggttttcgctcagtttctggggcattgagactgatagaagcaactgacccccttagctaaggcaggcaggcaggtattgtcaccaagagaccctggagatcaggagaggttatttggggttggggatctccaaggaggggcagggaagttagtaccatcgtcgggctggaaatgggaagcgtttggctcgttggaagtggtgaagctggggtgtgggacctcgc

SEQ ID NO: 8359 - DNA, 416 bp, Homo sapiens
  misc_feature 185: n=a, g, c or t
cttttgttttattataaaatattcaaacatggaagtatatacagtagaaaataagttttctccctgatttgatttgtattagtaccatctctgctatttagcccccactgttaaatttgactggcttaaaaaaaataccatctctgaagataactacttagaagttggtcatatgtttttccagnbttcccaatgtttatttatatataaacataaataattttaggccaggcgtggtggctcacgcctgtaatcccaagactttgggaggctgaggcagggggttcatgaggtcaggagatcgagaccatcctggctaacacggtgaagccccgtctctactaaaaatacaaaaaattggctgggcgtggtggcgggcgctgtagtcccagctactcgggaggctgaggtaggar

SEQ ID NO: 8360 - DNA, 424 bp, Homo sapiens
aacaaagaaaggtatgagaccagaaggtttcactggtaaattctattaaacactaacgaaaaactaaccaccaatctttttcaaattcctttcaaaaaactgaagaggagggaatatttactaactcattttatgaggctagcattgctctaataccaaagacagaccaaagacactataggaaaactacagactgagcaggcacagtggctcatgcctgtcatcccagcatttcaggaggctgaggtgggagcactgcttgagcccaggagttcaagactaacctgggcaacatagagagaccccatctctacaaaaaattaaaaaattagccgggtatggtagcatgcgcctgtggtcctagctacttgggaggctgaggtbagaggatggcttgagcctagaagatcaaggctgtggttag

SEQ ID NO: 8361 - DNA, 349 bp, Homo sapiens
ctgttttaaaaataaaaaaaaggccatgccagacaccatagccctatcccatatgcaagcatatctttggctgcaggtggctggtttgcatctgctggccaaagggagaggtccattccatccagtcttctgggtcctgttcagtcttatcagacagctttgaagactgagtgccaagattacgtgaacttagtactccccagagttccctttaccttgtgctttaaatggtctacaactttaattttaactgaaggttaacataagaagaaaccatatgaaatccacatatgtgtgaaactggctgaggagactggcatcacatcacttcacaccacgtatgaagtac

SEQ ID NO: 8362 - DNA, 307 bp, Homo sapiens
atacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagac

SEQ ID NO: 8363 - DNA, 361 bp, Homo sapiens
aaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgca

SEQ ID NO: 8364 - DNA, 344 bp, Homo sapiens
ttgctaaatggacaatcataggcccagtgtggtggctcgcgtctgtaatcccagcactttgggaggccgaggtgtgcagatcactgaagtccaggagtttgagaccagcctgggcaacatggtgaaacccatttctacagaaaactacaaaaattagctggacacggtggcacacacctatagttcctgctactcgggaggctaaggtgggaggatcgcttgagcccaggagatcaaggctatggtgagccgtgatcgtgccactgtactccagcctggatgacagaggaagaccctgtctcaaaacaaacaaaacaacagcaacaacaagaaaacaataatag

SEQ ID NO: 8365 - DNA, 180 bp, Homo sapiens
  misc_feature 9: n=a, g, c or t
cttcctccncagcgccggccccggggcgaccgcgggaccttttccggcgctggatgctttgctgccggggttcgggagtgacctgcgcctagagcaggtcgggcgcactgcagtcccgcactcggggctcttcttccggtcacctgtagagcccggccgaggaatggaataacaggcgtc

SEQ ID NO: 8366 - DNA, 268 bp, Homo sapiens
aaaacaaagaatgtgtatttcttcaatagccgggtatttggattgttctcttgataatatttgaatgtgactcttggatttaagtgcactattattcatggcttatacaataaaattgcactgtatggcaaatatgtctataatgtatgctttgctgaaacctcaagagtgctgtaaggtacaggtttccatattgtgaacctgtgtacgcacacacacatatacatacagtcttagggaaaaaaaaaagcrgaacttttgtaagtct

SEQ ID NO: 8367 - DNA, 370 bp, Homo sapiens
cgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtc

SEQ ID NO: 8368 - DNA, 327 bp, Homo sapiens
tgtatacccgttaccaggttaaagagttgctttctcattagtgtttttgttatgaatgggtgttgaattttattgcatgcttcaaatggtaatgaaaattttctttaatctgttaatatggtaaattatagtatttttctgatgttaaaatatctttgattcttagggaataaggacaccttggtgtcttgtattagtttttaatacactgctagattgctaatgttttatttaggactttgaaattaatgttcataaatgaggccagcctgtaatttttgttacactgtatttgtctagttttagtattgaagttacacaggcttt

SEQ ID NO: 8369 - DNA, 360 bp, Homo sapiens
ttatttattttaagtttttatgtttttgcgtgttgctaatgtaagctggcagtccatcttcaagtttgctaatgctttcttttgsccagttwaaatctactcttgtgcgcttctagtgaatttttcatttcagctgttatacttttcaatttaagaatttctggccgggtgcggtggctcatgcctgtaatcccagcactttgggaggccgaggcaggctgatcacaaggtcaggagattgagaccatcctggctaacacggtgaaaccctgtctctactaaatatacaaaaaaaaaaaattagccaggcgtagtggcgggcgcctgtattcccagctaytcgggaggctgaggcaggar

SEQ ID NO: 8370 - DNA, 498 bp, Homo sapiens
caatgtaatagtgaacactccacacagaaaactcatcaccaaaatgtggaggaacttcttcccaccagcaatgcattttccatccgacactaactgggtgaacttatacttcaactcaattctgacactgtccagctagaattaggatcagatgctgtttactggttggtcagttccacagggctacccccacttcaaatgccggtcacaagttgcaggttgggacctgaacttctgggcgaccaackgtaaattggggattcacttgacccccctcctcaggttgtagtaatttgccacggtcattcaccgaactcaggacaacacttagtttactcatttattataaagtatgttgcaaaggacacagatgaacagccagatggaaaagctgtgctagctagttattcaaacccaaggaaagtgttagggaagcacattgaccaggtcagtcagagcgtacagsatatgaagtgagggcagtctgtgcgactgaac

SEQ ID NO: 8371 - DNA, 77 bp, Homo sapiens
tgccctcccaaagtgctaggattasaggcgtgagcactrkcacctagsscactgatcactcttctgcttacagaatw

SEQ ID NO: 8372 - DNA, 389 bp, Homo sapiens
ccaggatgtctcctgctgccctttcacaaccacacctgctacccttgttcctgccatctatcccctcgaggttcctaaccccgwyactaatctgttctctatctctagaatgttgtcatttcacgagtgttatataaatgaaagtatacagtatgtgactttttttgtttttttttgagatggagtcttgctctgtcgtcaggttggagtgcagtggtgcgatctcggcttgctgcggcctttgcctcccgggttcaggcaattctcctgcctcagcctcccaagtagctggggccagaggcgtgcgccatcacacccggctagtttttgtatttttagtagagatggagtttcaccatgttggccggggctggtcttgaactctggac

SEQ ID NO: 8373 - DNA, 358 bp, Homo sapiens
cagaggagcaaaagttattgctacaggatttgctgatcttggttttgatgtggacatagcccctcttttccagactcctcgtgaagtggccagcaggctgtggatgcggatgtgcatgctgtgggcgtaasaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgkatttggtcctgggactcgaattccaaaggctgccgttcaggtgcttgatgatattgagaagtgtttggaaaagaagcagca

SEQ ID NO: 8374 - DNA, 398 bp, Homo sapiens
ttatatgtttatctgtgccttcattagactagaatggtctctgtcctgatgttcctaatttttattaagaatttcctctctamccbtatccctgtcccaactctcaccgtgaattttgtcattctttgaatttgagtcaaaattgatttcttcttggaaataatattttgcttagtcaaatttaatgacattactatcctgggacattaagttgaacatttcttctgtgaataaaatgcattacatgttaatatatatttatgtttgagtgtgtatgtttgagagacagggcatgagaggagaaggacggaaagagagagggaagaagagacggaggggaagagggaaggtggaagaaagggagagaaaagaaggtggggaagaagaggtggagggaa

SEQ ID NO: 8375 - DNA, 405 bp, Homo sapiens
caagtatagtaactaatattccctcatgttttcctgtgtgccaaacacttcacaagaagggaaagtacttgcaaattcctkggbagcgtataagaccacaagatacctcagaaggggcggaataagaatcaaatgtacagcatagagtaatggaacctgagaatggagaatctggtgtttgcttgtgtacagctgaagggggccagcccckccacacctgtgggtgtttctcgtcaggtgggatgagagactgagaggggaaataggacacagagachmggtatagagagggaacggtgggcccagggggaccggcactcagcgtatggaggacccacgccagcactggkctctgagtkkcttcagtakttattgatcactatctttacaatctcggtgaggggg

SEQ ID NO: 8376 - DNA, 383 bp, Homo sapiens
gcggacgcagccggcccttctcaggtgcattttagtggttaccaggttgccacgtatttgaagtggtgtgagarctactcgttttggraccgttgtggatttkcaaataggaaaatcaaaaggcccaaagagacagctcactggaatcaaaaaatacaacttgtatgtgaacttgtgcaaatgtgtgaaacaaattaaggtgacagggcagaagcaacaaaatgaagctcaaatgaaatccacctctcaaagcaggtgaccatgctttgggattttcatagtttgagtaattcctatgggctctaccacccagcgagttaaagaagacaagattccasccccagggggttgtggttctgggaatgtgagcagcttgttttcag

SEQ ID NO: 8377 - DNA, 150 bp, Homo sapiens
aaaacaattactttacagctcagtgcaatgtagtatttaaagaaaaggtaggcattttgattcccaagtaaactaaagagaagaaaactgaggcttaaagaggcaatctttaatattggtatccttatttacaaagaaaatgagtgcaga

SEQ ID NO: 8378 - DNA, 412 bp, Homo sapiens
catgaacatattacacaaatacacatataatgcatgttgtgaacacagatgaatacaagcaggttcaacattaacttagtrtttgatwattaatcchaatacacataaatagataactttaatatcctcaaaactctcatacatatacatacttgtccactttttgcttctctattgataatcaacctcttacagatgtggctctacatgcagaagctgaggagagtgtggtattacttaaatcaccacaggtatcagatctgaatttctcaacaaagttgatagttttactttcctggcatatgtaatatggcattgcttaakattactatgaaataatgatgcatttaaatataaattttgakatatkctgaaccagagttcatktgatattttgaaccagatttgggtc

SEQ ID NO: 8379 - DNA, 378 bp, Homo sapiens
tttctgtgtgtggttttttttgtttttttttttttgagacagagtttcgcttttgttgcccaasctggaatgcagtggcatgatcttggctcactgsgacctctgcctcctgggttcaagcgattctcctgcctcagcctcccaagtagctgggattacaggcatgccctaccaggcccgactaacttttttgwayctttagtararacggggtttcaccatgttggtcaggctggtctcgaactcttgatctcaagtgatccacccgccttgacctcccaaagtgctgggattacaggtgtragccatggtscctggctggtttgagcttttckgatattacatamaatgctgtaacaataaacgcgtgactaaagt

SEQ ID NO: 8380 - DNA, 464 bp, Homo sapiens
caataagaaaattagcctatgtgcaaaatttaactgtatatactttctaaaataaatccaaaatccaaaaagtaaggtcaaaaggcattctgaaattttaccagtttgctaaagatcatattgagtaattaatagattctagaatgattacttatctgctgtaatacatctaaaataattaaactctttggtttgtgaaaatttcatttttattacttgatgtctacagtggtgaatcttcagtttttgtctttacttggaaagattactgattgttcagatatattatatgccaaattaaaggaaagaaaaacagcaggtagagcatgcattaagtgattaattcaaatgagctaggcctaaactttaggattcctggaacaaaaaatcagaaatctctgttttccttgattaatttttaaaagttagatttctaactcctcgtttgtaaaaactattatgac

SEQ ID NO: 8381 - DNA, 351 bp, Homo sapiens
cactgatcattagagaaatgcaaatcaaaaccatagtgagataccatctcacagcagtcagaatggctattattaaaagtcaaaaaataacaaatgctgaggagattgtggagaaaatggaatgcttatacactgttagtgggagtgtaaattagttcaaccattgtggaaagcagtgtggcaattcctcaaagagctaaaaacagaattaccgccggcatgctgactcacgcctataatcccagcactttgagaggccaaggctggtggatcasctgaggtcgggagttcaaaaccagcctggtcaacatggtgaaacctatctctactaaaaatacaaaaaattagctg

SEQ ID NO: 8382 - DNA, 51 bp, Homo sapiens
gtttacgtctcgctccggggcggaaagtgggtcagggccgggccggcggas

SEQ ID NO: 8383 - DNA, 159 bp, Homo sapiens
ttgtaaattttgttgattattttaaagaacaaacttttgcttttgtgggtttatttttctcttttgttctagcctcagttttgttatctctgttgtaatgtttattttcttatggtataagactgttattgagtttttttttttttttttttttttttd

SEQ ID NO: 8384 - DNA, 440 bp, Homo sapiens
ctctgccgcgcgtctctcaacctccgtggctagtcttgacgtggcgggttgctttccaaaatggcgcgggtgctgaaggctgcagccgcgaaatgcccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgrhcatggagtatctgttgtttttgtcaacctgggaaataccaagatggaactgcttcatccattgggacttgacagtccaattgcaggttttctgcagaaaaacaaggctggaggaatgcatcacatctgcatcgar

SEQ ID NO: 8385 - DNA, 438 bp, Homo sapiens
  misc_feature 401: n=a, g, c or t
aaaaagggattttctgatactcagaagactcagagactgtcagtttaaaaaatgaaagtaatatagaaggggcaaagtggcatttatcattctatctctccaggctcctgtctctttaatcagctagcctgatttgcccagtaaatgattcctgagagtgtgtgtgcgtgtgtgtgtgtgtgtgtgcccgcgcgcgtgtgttgtagctctgtcaatccttggattagaaccaatgattgcagcttgtaggagggctgtccagggccagattgtacaatgtgtctcagtgccagagtatgagtggagataattacggagaagtcatactctctcacaccctcggctttcttgttgtgtccttcagcaaaacagtggatttaaatctccttgcacaagcttgngagcaacacaatctatcaggaaagaaagaaagaaaaa

SEQ ID NO: 8386 - DNA, 421 bp, Homo sapiens
tgtgaaacaattcagaatctggttgataatataaagactgtgctcactggtcataaccgacagcttggagatgtcaaacatctcttgaaaagctatggctaaggtaagactaataccatgaacacacatttactctccctctgttataaaatttacaagtagttttatttataggaaaaacagtgacattttgtaaataacagtttatctcatcacatcttccaatttgtttgtaactgagttaacttgtgttttcatcaactattttttaaagccagtagtagtagtttgaatttcatacacagagaagctaaggcttaattagattcctttattgtgatataacttgtaataaaaccaagatatgaacctagtctgagcattcagatatccagcttgtctttctctttcttagctatac

SEQ ID NO: 8387 - DNA, 401 bp, Homo sapiens
aaaagctaaccctcgggcttgaggggaataggctgactgtacgttccttctactctggcaccactctccaggctgccatggggsccmagcaacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccrctgctggaggtggcagagaaggagcgggaggcactcagaactgaggccgacaccatctccgggagagtgkwtcgtctggtagcgggaggtagactatctggagacccagaacccagctctgccctgtgta

SEQ ID NO: 8388 - DNA, 75 bp, Homo sapiens
attaattggatattgatgaaatcattggcctggcaaaataaaacatgttgaattccccaaaaaaaaaaaaaaaaa

SEQ ID NO: 8389 - DNA, 445 bp, Homo sapiens
cccagaggtctcacttcatcatctaggctggagtgcagtgcatgattatggctcacctcagcctctacctcctgtgctcaggtgatcctyccaacstcagctcccaagtagctgggaccacaggcacacatcaccatggctggctgatatttttttactatttttgtagagttggggtctcactatgttgtctcagctggtctcaaattcctggactcaagtgatccttccaccttggcctcctaaagtgttggtattacagttgtgaaccactgcacccagcccacaattttttttatttgcattaatatcaaagtaagattggagcatctcagaccatctaccatttacaatttacattaaccggccaggcacggtggctcgcgcctgtagtcctagcactttgagaggctgaggtgtgagtggatcaccggagtcgggagtt

SEQ ID NO: 8390 - DNA, 442 bp, Homo sapiens
acacacttgctccgttaggggcagaacacgagttttctctctgccctccaaccttcttagctgagactccctgtaacaaagaccgagtaagaagagaaaaacaaacagaagttwattagtatgtgtagctagtgtgcacttgggaggcacccagagaactgagtatgtctctggagttgatctcaaacaggtagtttaaacttcaggcttagaaaccttctccatggttcaggagtctagagatctagtcgttcttctctctctggtgcagagaggaaggcacccttacaaatggacagttcctttattgacggacatttcctttacaaaatggctgccaacatgaagacactggatgcggaatcaggaggagatgtatacagctcagtctccaaagccaggacaagccagctccaacacactactggctgaatctcaccaa

SEQ ID NO: 8391 - DNA, 419 bp, Homo sapiens
  misc_feature 1,242: n=a, g, c or t
nvccaccccccgcgcctacgcaagttttccggatccgtccacccccgcctccctcctagtgtacggaagctgagagggcccgcgggtaggcatggcggcgcaccttaagaagcgggtttatgaggaattcacgaragtggttcagccacaggaggaaattgctactaagaaactccgactaacaaaaccaagtaaatctgcagcactccacatagatctgtgtaaagctacctccccagcgnvatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgc

SEQ ID NO: 8392 - DNA, 74 bp, Homo sapiens
ctctttccggtgtggagtctggagacgacgtgcagaaatggcacctcgaaaggggaaggaaaaaaaaaaaaaaa

SEQ ID NO: 8393 - DNA, 463 bp, Homo sapiens
aatgccagatgatctatcattgtctcactttgcccccagataagaccatctagttgcagaaaaataagctcagagcttccactgattctacattatggatatgtgccgccgaagcaagcacaaagccctacttttacacatgcctagtgatgcgtcatggacaaggcttggctctgttgagtccaactaacctacctgagattctgagatttctcttcaatggcttcctgtgagctagagtttgaaaatatcttaaaatcttgagctagagatggaagtagcttggacgattttcattatcatgtaaatcgggtcactcaaggggccaaccacagctgggagccactgctcaggggaaggttcatatgggactttctactgcccaaggttctatacaggatataaaggtgcctcacagtatagatctggtagcaaagaagaagaaacaaacactgatctcttt

SEQ ID NO: 8394 - DNA, 393 bp, Homo sapiens
aaacaccacagcgttctcggtggtgggctgaatggactcgtccacatgagggggatcttcatcaccatcaactcttarrrtccgrgaacmtavssacgaaaggagsagcccccagatcagagagcaacgcatgactatctgcgtgtgcttctgtgactacgcggatgttgtgggcggctacatgcgtgcgggggcccggcgagctgggcaggtgccccctccgggccgtgggatctgctggtctcttgtggctcagcgccgtgcggaggttgaagcgtacctgcggaggtcgcaccagggcgtgaggasgaggaggaagggcatgagccgagcttgaggaatccgtgctccaaactctacactcaagggtggcccttgggtagggtgaagatc

SEQ ID NO: 8395 - DNA, 360 bp, Homo sapiens
cttttttttcctttcctgattccttgtgtatgtgtggctgggccgcccctcttctcggctcagagtcacggagtgccttgaactaggscccacstcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgacttccactgttcatcaaagaaaaagggttcttttggtcamccaccactggccccatggctgccgtgcagatggatcctgagctagccaagcgcctcttctttga

SEQ ID NO: 8396 - DNA, 314 bp, Homo sapiens; identical to SEQ ID NO: 7928

SEQ ID NO: 8397 - DNA, 439 bp, Homo sapiens
  misc_feature 268..270: n=a, g, c or t
atgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaannntactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaag

SEQ ID NO: 8398 - DNA, 328 bp, Homo sapiens
gcaaaacaagggcagcgggcccggcgcggtggctcacgcctgtaatctcagcactttgggaagccaaggcgggcgaatcacttgaggtcaggagttcgagaacagbmtggcccacagggtgaaactctttctctactaaaaatacaaaaattagcggggcttggttgcgggcacctgtaatcccagttactcgggaggctgaggcaggagaatcgcttgaacccgggaagcggaggttgtagtgagccgagatcgcgccactgcactccagcctgggcgacagggcgagactcccgtttcgaaaaaacaaacaaaaaaaaaaaaaaaa

SEQ ID NO: 8399 - DNA, 398 bp, Homo sapiens
ttcattttttccatgtggatgtccagtttttccagtgccatttattgaaaagagtgtcttttctccactgcattgtccttgctcttttgtcaaagatcagtttactatctatgtgggtctatttctgtgatttccaccctgttccattgacctgtttgttctttcaccaataccacactactctcttgattactgaagctttatagtaagtcttgaggtcaactaatgtcagacctctaactttgctcttttccttccatagtatgttgctattctgtgtttttttgctaatctgtataaactttaggatgagtgtcaatatcctcaaaataacttgctgggattttgattgggattgcattgagttagtttacagattagcaaaaaaaaaaaaaaaa

SEQ ID NO: 8400 - DNA, 96 bp, Homo sapiens
tacataagaaagcagtaagaagcaacattgcattatatacttttctccatccctgttcaaagaaataagtcccaccacaaaaaaaaaaaaaaaaaw

SEQ ID NO: 8401 - DNA, 557 bp, Homo sapiens
atgggttttcatggagttgatcttattacatccaccattatgctgcattctgtagggaacacaaaatgattcctctcctcaataaaccagtcacctagttgaagataaagggtgttcagaaaagatggtcacaaaacaattaggggctagattctgtgatccatgtgagatgccaatgatgtgattctggaaagcagaaggtgaggttgtgagataccctgcagcacataatgcccaaggctagggtggcgagtagagggcccctggtctggatctgtctacccagcttcattcctcccattcgtgaaacagtggctgcaccagccaggaagcatctgagaccacctgattctctggaataatagctgctgaggtttgtgctgtgagctataacactgaattgccatctggtttcccacagcaggtggccatttacatcaccacgacagtgtccacaggagttccagttccctaagttctcaccaagactggtcattttctgttggaaaaaaaatcctaataggtgtgarggaaagctgcacctgtgcacatgacag

SEQ ID NO: 8402 - DNA, 446 bp, Homo sapiens
aaaggccagcctgatgaggtctcagatggaaatgaggaagttatggggaactggagcaaaggtcacccttgttaagccctagcaaagaacttggctgcattgtatctatgtcctagggctttgtggaaggctgaacttaagagtaatgacttagggtatctggtaaaagaaatgtctaagcatcaaagcattcaagaaatggcctggctgcttctaatagcctatgatcagatattggagcaaaggactgacttaaatttggaactattaaatcaaactaaaatctggcctgagaaagcctcctcactcccatacttgagtccttaaggatgaaccataacctaactttgtaggtaggccaactgaaaacctaacttagaaggatgcttctgtagcaatagctgagcgtcascmaatcgcagcagccatgcttcagtgactcacag

SEQ ID NO: 8403 - DNA, 379 bp, Homo sapiens
ccttgtgcctttgtttttcagagggctctgaactcctacttcgagcctccggtggaggagagcgccttggaacgccgacctgaaaccatctctgagcccaagacctagtaagtgatgaggggagcgggascagtccgcacggaggcagtttgataccaggtagccctgcgcgtcctgggacctgccgtggagctgggcggacgatgctgaggcagatctccaagctgcgtascagaggagcagggcttgcgttgctgctgctgcgcggagttgcgccccagcagcggatctaacactgcaccagactgtcgcttcgaacgtgatttggggtccagggaggaaaagatggaaatgtaatgtttaactcaaatgaaaggaa

SEQ ID NO: 8404 - DNA, 155 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtcca

SEQ ID NO: 8405 - DNA, 73 bp, Homo sapiens; identical to SEQ ID NO: 7980

SEQ ID NO: 8406 - DNA, 221 bp, Homo sapiens
agcaaattgagattccagamagacctcacagccagcaagttggagagctgctttttgatgctagacagttggcctctgcttgtaatcttaataccccagaccatctttccatgtggccctcataggccctaraacasbtgctcaggggaatcccggagcaagasrtgagcacaggtgggagattcttcgcasactgtctgcagctcasgctaaggtgcgak

SEQ ID NO: 8407 - DNA, 68 bp, Homo sapiens
aaadcttaccacctgcacccggaragctgtgtcaccatgtgggtcccggttgtcttcctcaccctgtc

SEQ ID NO: 8408 - DNA, 398 bp, Homo sapiens
  misc_feature 37: n=a, g, c or t
agaagggagcgaaggtttttgctgcgccaacgcatrnccgaagctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgargtgctggtgctgggtgggggcartggcggaatcaccatggctgcccgcatgaagaggaaagtkggtgcagagaatgtggccattgttgagcccagtkagagacatttctaccagccaatctggacactggtgggtgctggtgccaaacaattgtcctcatctggtcgtcccacggcaartgtgattc

SEQ ID NO: 8409 - DNA, 229 bp, Homo sapiens
cccagcaatagacggtgcctcagcctgccgagccgcagtttccgtggtgtgagtgagtccgggcccgtrtcccctctcccgccgccgccatgggctgcacgttgagcgccgaagacaaggcggcagtggagcgaasaakatgatcgaccgcaacttacgggaggacggggaaaaarcggccamrakragtgaagctgctgstactcrgtgctggagaatctggtaaaar

SEQ ID NO: 8410 - DNA, 108 bp, Homo sapiens
tggatcaaagacctaaatgcaagatctaaaccttgcattagaaaccttcccataagaatatggargaaggmcgggcacagtggctcacacctgtaatgccagcacttt

SEQ ID NO: 8411 - DNA, 329 bp, Homo sapiens
agtgcagcgcaccgcggggagcgaggagcgcgcggaccggccatgggcaagtcagcttccaaacagtttcataatgaggtcctgaaggcccacaatgagtaccggcagaagcacggcgtccccccactgaagctctgcaagaacctcaaccgggaggctcaacagtattctraggccctggccagcacgaggatcctcaagcacagcccggagtccagccgtggccagtgtggggagaaccttgcatgggcatcctatgatcakacaggaaargaggtggctkatagatggtacartraaatcaagaactataacttccagcagcytgr

SEQ ID NO: 8412 - DNA, 271 bp, Homo sapiens
  misc_feature 208,210: n=a, g, c or t
tttgttttcgctccggattctccatgttggacccaaactgaggagcccggagctgccgctgggggatcggggccgggggsacccsggggravcagykgcccgggccgcccgccctttgtacaggccgcctcccttcccggtccggggaggaaacgagaggggggatgtgaacarctgtggaagtcggagtctcgggagccggagcgdnhncccgcccakgccccccagcccagcccarcccgcgcgcccgchcgthctcccgcccagccar

SEQ ID NO: 8413 - DNA, 492 bp, Homo sapiens
atacatgagctatttatagcatttcaagttaatccttttgcgccggggtggaaaggtgcttgcaatggatctgttaactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctastgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcataga

SEQ ID NO: 8414 - DNA, 391 bp, Homo sapiens
attattttaactcttctccttaggacacgcagcccccaatttgtccctccggcctgggcggcccctggtcccgcgcgccagcatggggagagcgaagggacctgcccgcggcccgccggcgtgtgcaaggaggtccagccgccgcgcccgctacccggagtctgaggacgggtgtccagggacggagaggcaggtgagagggaggtggctaagctggctatggtgacaggacgatgttggccagaaagagtatcatcccggaggagtatgtrctggcgcgcatcgccgcagagaacctgcgcaascgcgcatccgagaccgcctccccaaagcccgcttcatcgccaagagcggggcctkcaacctggcgcataagaacatccgtgagcaa

SEQ ID NO: 8415 - DNA, 73 bp, Homo sapiens; identical to SEQ ID NO: 7980

SEQ ID NO: 8416 - DNA, 283 bp, Homo sapiens
  misc_feature 232: n=a, g, c or t
agtctccgcgtctccctcgcgaactcggtgaaaggaattggcgccgttcgacaccaggcggatccgctctgcagcacgaacccatctccagccgcagccgsagccgccgcccgggccgaggagcakccgcagcagccgccaccartggccgagtgarcggaccgagtkkgaggcagcgcctagcggtgaatcggggccctcaccatgagttcctcccctgttaatgtaaarnagctgaaggtgtcggarctgaaagaggagctcaagaagcgacgcctttctr

SEQ ID NO: 8417 - DNA, 340 bp, Homo sapiens
agcttccgcctggacccagcctcgtgggagccccgcgggtcctgcccagatgtggaagactgaggcctgttgaaagtgsagagstcagccctggcaccctctgttcccaagagctccatgcaggtgccacaggatggagaagaccttgctggccaaccttggtaccacggcctcctgtcccccagaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccas

SEQ ID NO: 8418 - DNA, 226 bp, Homo sapiens
aaaaacccactgatcctgatgcgcgcgcctccgctgtgccaggggcgccgggaagcccgacgacgacggtgtcgtaaaagsgksgsgaaggygtscgcccttggcggcttcctgccacctgkataagtkgagcgtgctggggtgtgtaaagtagtatggaggcagcggtagcccagtgtctgartrgttvccgggtctccatggagaagcggctcgccagtgtccc

SEQ ID NO: 8419 - DNA, 53 bp, Homo sapiens
cttcgccctttgtgtcctccttctttcactaacttctggactttccagctctt

SEQ ID NO: 8420 - DNA, 67 bp, Homo sapiens
taccttgccgggcgcggtggctcacacctgtaatcccagcactttgtgaggctkaggcgggcagatc

SEQ ID NO: 8421 - DNA, 484 bp, Homo sapiens
cagttgccagagtgcatagaggagggatgaggcatgagaaggtggtagggaaggagacaacaggactgattatacagaagcaagaagacttaggaaccatctgaatgtgagattcaggacaaaggcaaagacaaggctaaccgtgaacgttatcacatgtcttcttgtgcgaaacataattcaggagttagctgatgcttggtgttgatgatgtaaaatatgaagagcttacaggacatccagatgcaagtcttcaatagacatttaggaataagatctggacttctgagctgttggtattcaaattagaaattttagagtgaaacaggaggtgacagttatagctgtggaagtagatgaaatgccctaaggttgcataaagcattttaagtatgggatctgcatctcaggaataccactgcttaagtgacaaataatgagacacatttaatgggaaagaaagagaggatcgtatgagggtatt

SEQ ID NO: 8422 - DNA, 52 bp, Homo sapiens
twtttctctagacgcgtcttgctgggagagtgtccgttgcttcccgtccgtg

SEQ ID NO: 8423 - DNA, 50 bp, Homo sapiens
argcgcgcggggattdgcgggatgcggcgcgccgcgcgtgaacctccttg

SEQ ID NO: 8424 - DNA, 490 bp, Homo sapiens
  misc_feature 188: n=a, g, c or t
aaaattcagtttctcacacatgtgaagtgtccagtagccacacgtggctagtggtgaccgtattgaagagcaccgctcatagcacacctccctcactgcggaaagttctgctgtacagcacccagcacagccctgctgcccaccctgcagcctgtggcccagtagcaccagcacccaccagggtgagnactctcaggcctgcccaacctactaatcagaaccagcatctcaaggagatctcgggtgatttttgcaaacactgaagttggggcagccctgaccggagtaaccttccctcatttcctcctgcagctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagc

SEQ ID NO: 8425 - DNA, 157 bp, Homo sapiens
  misc_feature 96: n=a, g, c or t
caaaaaattagccgggcgcggtggcgggtgcctgtagtcccagctactcgggaggctgaggcaggagaatggcgtgaacctgggaggcggagttvncagtgagccaagattgtgccactgcaatccggcctgggctaaagagcgggactccgtccam

SEQ ID NO: 8426 - DNA, 83 bp, Homo sapiens
ccggaggcggagttccagtgagccgagatctgcgctccaacctggggacagagcgagactccctctcaaaaaaaaaaaaaaaa

SEQ ID NO: 8427 - DNA, 504 bp, Homo sapiens
ttaaggccagccaaacaaaattttttccccaaaattcttaaaatgcttaaaataggcaaagtgattcagaagtttttaggagtaggaaggagaggcggtacgtacagatatgtttctgtatgaatttcaaatgaataagcaagggaaaacttaataggtaggaggcattagtcttccttaggcagggaataattattatttcagcaatgtacatgtagtaaagttctacaattttaattcattctagctctaaaaattctatgattttatccttttttctgttcttttaaacttgttcctgtacaatttatagactttttttctgagaaaaatcttcctggagaaaagattgttaggcccttcaataatagggagtttctcttaaaataagtttagccgttttgttatttaagaaatgatttggccgggcgtggtggctcacgcttgtaattgcagcactttgggaatcgaggcgggcggatcatgaggtcaggagtttgagac

SEQ ID NO: 8428 - DNA, 395 bp, Homo sapiens
caataatactttttctgggtagacattttttaatgatagtgataggctttaaattttagaactatttagaactatttaagatacyttttkkaaatctaaagatttttaaagctgtaaaaagcatgatgaaatcttagatcactgctgtatctaagtttaagtggtatagttatccttctaataagtctgcttttctgctaatttcaaaacactttttttcactgaccattaatcgacagttcttaatgatcacaagtgtcacttactcacagctgtcttagcaattctttttagtggaactacagctactaattccttgaactcagttgacacacatgagttatacttkcttgttcatttttcctttcactatgttaggcaccccctgtaatggc

SEQ ID NO: 8429 - DNA, 438 bp, Homo sapiens
aaggtcggcggcggcggcccgcagtcgtggaggagcggtgggagcgtcggcggccgcgggcgatgcaacttccggacgggactycccctctgtccgcgcctcacatctccccttcctctcgcctagtcctgtgccgttttccgtccgcgactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttact

SEQ ID NO: 8430 - DNA, 73 bp, Homo sapiens
ctatctatctatctatctatctatctatttttgtccaggtttcctggcttgtaattcccatagcccttgttac

SEQ ID NO: 8431 - DNA, 79 bp, Homo sapiens
ccggagggcggasttccagtgagccgagatctgcgctccaacctggggacagagcgagactccctckcaaaaaaaaaar

SEQ ID NO: 8432 - DNA, 232 bp, Homo sapiens
cacaacccagattaattagtttaacatgctgagtgcagtggcacacacctgtaatcccagcactttgggaggccaagatgggaggatcacttgagcccaggagttcaagatcagcctgggaaatatggtaagacctggtctctacaaaaaattttaaaaattaagcatggtgtcctgtgtgtgtagtcccagctactcaggaggctcaggtgggaggatcacttgagcyaga

SEQ ID NO: 8433 - DNA, 79 bp, Homo sapiens
ctctcgcccctactctttctggtgttagatcgagcaaccctctaaaagcagtttagagtggtaaaaaaaaaaaaaaaca

SEQ ID NO: 8434 - DNA, 427 bp, Homo sapiens
gtaagtttctgtgaaattcagtacatccttaagactatagcattttagtcagatagaagagattagattctttctctgggktgcctgakggtkgcatgggtgtrtgtggggcgagtgatgtggtattgctttctaatcaacttcttactgccttcaggcattatcagtgttctttcttcctggatgtcagagccacttctaataatgactgctttcagctaaacaacagtaggcattctcttcgaaggggtaaaaatgacttgggtcatttgtaggctgcagctcttcatagtcattcaaattcagcatattctgatggacaaggccattacacagtattaatagctttaccatctcaccatgatagtgattacagtagttctttaatatcgctgctgaaatgaaagagataaatctacacatgaga

SEQ ID NO: 8435 - DNA, 309 bp, Homo sapiens
  misc_feature 226: n=a, g, c or t
atggctgattccatggctggcacgggaaaagagcaatatcttgtacaagaacatcctgtgccagaaggtaagaaaatattaaaaggkkgatggaaacatgttaaaaagacacagaagccagcatgaaaatgcctggtgattaaggataatttgagcattgaagtaaatgatagaaatggatgccattccatagattaaataagaatctattddtccatactgatancagtaaatgaatgaatgaagaaataggaaagaaggaaaacctcttcttttaggtagaatgccagcaaataaagatagaaacar

SEQ ID NO: 8436 - DNA, 586 bp, Homo sapiens
atttttggcattcaccttgattataaaccttatctctctacactataatcatcttcccagtaacctggaaacacctacaagagaacagaaactgtttcttgctcctttttatatctctggtgcataatatgaggtctgtgtgttaggagcatgctcagtgaaagaccactgaagttgagccccacccagatgtgagcatatgaagatgaatgttggtgaaagcatgcgtcttgcatctggagaactgccttcctccgggagagccatcaacaaccacccattactgtgcagatgatgggactaacttcccttatccatgtgggcttctctgcccagctccccgccactgaggatgtgtttttgcaagacagtcaaagaagagacaagaagtaagccagcagaagccggtgagccaagtaaccctaactggtccacacaaagattgactgaatgactccaacatcatgaactgatcagttccaaagtctactcttcaagaacatgaacaatcatatcattttaaagataatttaatcctcacatggaccaaagtttttaaagaaacaactattcaatcatcggctaa

SEQ ID NO: 8437 - DNA, 423 bp, Homo sapiens
ctgggttattatgaagcatctactgtgaacactcttgtacttatcttttgggggcacctgggtacccatttctcatggtcacgtacctaggagtggcattgctgtgttaragggtacgttatagggtatgtgatttttgtaggttcttctttatcctatcacgattacatttttttacttttgttcaacctrrtgtagactcaccttggtcacaatgcactgtccttttwatatattgctagattcaatttgaagaatattttgttaggattttarsarctctggdtacaagrcgcygggctmtaaakttdawdtcywtataatgtttttgtcaggwtttcctgttaagatgatgctggacttagaaaagcagttggaaaatgcttttaaaatactctttggaagaatttatgtaatattcak

SEQ ID NO: 8438 - DNA, 465 bp, Homo sapiens
tctgatttggggacatatatatatatatwtgatgaaagggaatcacaaagggcaagatttcaaagtttccagactgagagaaaagagtgtgaaatagttcatgaagtgagaacacagacagttagaaagggactgtgggtggtcaggcctagatttagattcttcccaactccagtggctgactcgatgtttgccttagtcaagtaatgtcattattctgagccttgcttgagctcctcacccattaaaagggggtagacaatacattcaggatagttataaaggctaaataaaaaatgtaaaatatatgtaaaatgcatacccagtgtctagcatatggtgtcaataacttttggttgttcttgttgctttttaatcattataataatacctatttgatcagagtccaaggctggtcacctttgaactcctagggctcccatatcctagaagtgaaaatactag

SEQ ID NO: 8439 - DNA, 304 bp, Homo sapiens
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgaggcaggagaatggcttgaacctgggaggcggagattgcaagatcgcaccactgcaccccagcctgggcaacaaagtgagactccgtcgcaaaaaa

SEQ ID NO: 8440 - DNA, 68 bp, Homo sapiens
ctcatgggtrcagctgccgccacccagccctggctgcagrcccaggcatccctgcactcttggaggtc

SEQ ID NO: 8441 - DNA, 125 bp, Homo sapiens
ggagtgcaaaaaattggctgggtgtggtggcgggcgtgtgtcgtcccagctgcktgtgaggctgaagcgggaaaatggcatgaacckgggaggtggagcatgcagccagccargatcgggccgck

SEQ ID NO: 8442 - DNA, 355 bp, Homo sapiens
catttaaaaataaagttcctttatatttctgtcccatcaggaaaactgaaggatatggggaatcattggttatcttccattgtgtttttctttatggacaggagctaaatggraagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagag

SEQ ID NO: 8443 - DNA, 330 bp, Homo sapiens
caattttgttcttttcaaagaaccaacttttgggttgattgattttttttttctctactgtttttctgttctctatttctgctgkgttctttattkaawtttkdcctttkgtctgctttgagtttagtttgtctttttckaatttcttagaaaattaggttatggatttaagattttttttaatgkagtcatatatagctataaatdkccctgtaagcattgcgtttacttcatcccataagttttagtatgttgkgkttttggtttcaattttcccaatatactttctgatttgcaatgcaatttctttggcttackggttacatagaw

SEQ ID NO: 8444 - DNA, 403 bp, Homo sapiens
acaaggaagtgacatgacttagttttaaaagagcactatattgtgtggagaatgtgttgggaggtggaaagaatacaagtaggraaattawtttargagtctaggcaagacatgataggggcttggattatggtggtgacaaactaaaatcctgttttgtttgcaattaatagacaatgaaaaagtatttttgaatactgatttgaaaatcttacttattttgcctccaaagcatacatttttytttyctgtctttgctaaatcatttaaatccaagggttccaaacttttttttttyckgcacacagtatgcwartggkggttgctttwaawattccagagcyctgwagtcaaratcttgagtgtaggabttggttggggtggaaggactgtaataagttgr

SEQ ID NO: 8445 - DNA, 419 bp, Homo sapiens
tatgttttaggatccatataacagatagggaatcagtcatttaatttactctagaaatgtatttgtgatcaaggagatactgttgattagtagtatttttctccatctgttgaagaaaaatagctgcagaaactggatttgaattatgaggtcttttcccaccatgataaaaagtttttagccgggtgcagtggctcactcctgtaatcctagcactttgggaggctgaggcagaggaatcacttgagctcaggagtttgattgcagcctgggcaaacatggtgagaccttgtcattacaaataattctaaaaaattagctggacatggtggtgcgtgcacgtggtcctagctactcgcgarggctgaggcaggaagattgcttgagcccagcagtttgargctgcagtgagctctgat

SEQ ID NO: 8446 - DNA, 265 bp, Homo sapiens
tccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagtaagtaccaaataagtgtcaatgctgaaagtctctttattatgctagaccatgagtgtttaaatgctttcttctatatccatatccaacacttcatattatttttaa

SEQ ID NO: 8447 - DNA, 67 bp, Homo sapiens
gagattgctccactgtactccagcctaggcaaaggagctagactctgtctcaaaaaaaaaaaaaaaa

SEQ ID NO: 8448 - DNA, 238 bp, Homo sapiens
agcgacccgcggtgctaaggaacacagtgctttcaaaagaattggcgtccgctgttcgcctctcctcccgggagtcttctgcctactcccagaagaggagggaagcacagtatgaagactttggagactcaaccgttagctccggactgctgtccttcagaccaggacccagctccagcccatccttctccccacgcttccccgatgaataaaaatgcggactctgaactgatgccay

SEQ ID NO: 8449 - DNA, 449 bp, Homo sapiens
cacagtattatttatttctcaagaagagatttgttcatcatagtagtattagtaagtattccctgaaaaaaattcaaatattcaaattaagttattgctttcgtamccataatcattaggaaaactctcaaatgtgatgctcacttttatcctgtgtttatacaaatttacttgagaggatttttatattcaacaaaaatgcaaacaagattttaactcattgttcagcaaaagggtcgaataggaaaaaatcaagattagtaaaaatgttttaatttataaaatgagaaaaagtaaatgatgagaaatagaaaggaaataaaaggaaaaaatgagacaattatagtaatatacttaagatgaaattttatatcttgagaaaaaggtaaagagttaaatgtcaaaatagaatgtgtaagatagaaaagaaaggaatgcaagactgctaa

SEQ ID NO: 8450 - DNA, 73 bp, Homo sapiens; identical to SEQ ID NO: 7980

SEQ ID NO: 8451 - DNA, 349 bp, Homo sapiens
atacttattttcttttagaaataatgtattgtgtctgtgcagaaaaaaaaaaaccaaaaaggrttgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaa

SEQ ID NO: 8452 - DNA, 547 bp, Homo sapiens
tatatctaattattatataaactggaatcatccttttattctctctgctatcccttgcaaaattgcagacatcacttaagtcccactttgtacatgaagtcctctttgagtataatgcagtttatcggggggacaccctgggttagaaagaaacaatcagctttgagattcagataacctgaagtctgcaacttgctaactaggtgctgttgaaacacccagttaacttctctgagcttaaatatctttgtctaaactatagaaaatatgataaacattaacaccacagatgtttgtgaatagcaaatgtaataatgtaagggacagaactcagtgaacggtaaagcagtatataaaatttaatcatcagttactgacttcccacttgtctaatctccagtgttttattatagaagaaacatagaagaatgtagaattattattgtaatgattatcattgtaaattcataattcaactgaaaaacrtttacttagaaacttttatatgaaccatatagtcaaaatcatttgagtgctcactaggtgc

SEQ ID NO: 8453 - DNA, 75 bp, Homo sapiens
agttctggccgctgtcccggtgcgcacggacgtggctcgagtttcctctgctctccgctctcgccttgcagcacm

SEQ ID NO: 8454 - DNA, 368 bp, Homo sapiens
acttcctccccgccccaggmaacctgccatggcctcctggtgarcygtcctcatccactgctcgctgcctctccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacacatacagtgaatccatttaagatactctgacccatggatcccctgggtgcagccaagccacaatggccatggcgccgctgtctggccgcactgctatttcagctgctggtggctgtgtgt

SEQ ID NO: 8455 - DNA, 349 bp, Homo sapiens
ttgctgttagtatgtggattaaggcagatcattggactgtcattatgtgcatttacaaatacaacatcctttgtgaaaggaagagtaatttttagtaatctatgtagtttatgagctctgtatcattttgtcattgactttgatgcagattagattgactttttaaaagcatgcttttgaattattgattatcatataataaagacaaggttttacataaaagataagagaaaaatgcattttattctcaagaatattttaaatgaatcatacttacaaaatagtttttatcattagttcaccaatagctgtaactcctctgatttaactttagattatatcgcatact

SEQ ID NO: 8456 - DNA, 350 bp, Homo sapiens
attgcgccgcggcacggcctagcgagtggttcttctgcgctactgctgcgcgaatcggcgaccccagtgcctcgaccackatgcccgcgbkcttkcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctc

SEQ ID NO: 8457 - DNA, 73 bp, Homo sapiens
atgttagctgtggccactgtggatttttcgcaagaacattaataaactaraaacttcaaaaaaaaaaaaaaaa

SEQ ID NO: 8458 - DNA, 378 bp, Homo sapiens
astttctgagggttttgtgaaagagggcacatgaggagaaaagcttgtcccaatcagactcactttacatggatgamgataakcactggtstggtgaggtggaactggaagtcattggcaaggtaccaggtccagccattgcactgawaagagagcagcawaggtcactcttccttcatttaccagttctgctccacactctccacctgcctggactaggaggaagaatttagtaggtggaaagaacatgttcatttagaaccagggcttggctccagatgatgttttgtggagaaccccagagttcccatggatgattgacatggtcaaaatgagttccacagacagtccatgcttgtgccagatgagatggttacc

SEQ ID NO: 8459 - DNA, 69 bp, Homo sapiens
atgttagctgtggccactgtggatttttcgcaagaacattaataaactaaaaacttcaaaaaaaaaaar

SEQ ID NO: 8460 - DNA, 77 bp, Homo sapiens
catactaagctggtggaggatgggctcaacctccatgagagargagcagccaggatcagggggcattaacgttaatk

SEQ ID NO: 8461 - DNA, 494 bp, Homo sapiens
  misc_feature 400: n=a, g, c or t
cagatgtaaatcttgtacaagtcaaaatcaaaatatataaatcatgcatctcccagtgcattctaatgkgcctgcagkasargctggatcataaaaatatcagtcatagacctactcagaaaaaaggtttaacattggcaaaagattatagagtaaatactgggcttcaggttctagggaatttgcgaaaagccaataagacatagggaacaccaatagcctttcttgtgctaaatctctctcacagtccccctgttttgaatcaggccatgtcttcccctgggaaraaaagaaatgcaagttcacaaaaaatgttcttgtgaaaagttgtaagctgcatttacaactggggaagatttcagtctcagttgttttcttgctggtcatagatatatttgtnctttgcttgctatggagaaagattctgaactttcagaaaaaacttccaagtctagactccaaagaatatagtttatctttactatggcatttat

SEQ ID NO: 8462 - DNA, 421 bp, Homo sapiens
atgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaatkggattccccgttccagcctatactgtactgcagtgatact

SEQ ID NO: 8463 - DNA, 73 bp, Homo sapiens; identical to SEQ ID NO: 7980

SEQ ID NO: 8464 - DNA, 369 bp, Homo sapiens
gaaccgtggacagcaacatttcccacaggacacgaagtttgtcggcccttgccttggcagagctgaggcattttggagatcaaagatggggtaggaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatctt

SEQ ID NO: 8465 - DNA, 480 bp, Homo sapiens
tmaacatgattaaytytygasgaaccctcaaagamaaagamacatgamamamtgatgtcctgtytcgmagtgtctkatktgracyttcargamgamgcaagamaatggtgtgaccactttggamaacaatttggcagttcttcaaaatgttatacatagagttactgtatgacctagcaactctgcggctatgtgtatacacaagamgaacaaaaatatattcacccaaaaccttgcacatgaatgttcatagcagcaatgttcttattcagttgggttgaatgtccacccaaatgtccaccaatgatgaatggataaacattatgtggtatatccatacagtagaatatttaacagtaacaagtaatggaatactgatgcatgctacaacatagacgaaccttgaaaacattgtactaagtgaaagaagccagtcacagaaggccacatattgtatgactacttacatgacatgtcaga

SEQ ID NO: 8466 - DNA, 508 bp, Homo sapiens
cgtgggtttttaaaagatatttttgtgtkmdtaaaaaaggactttctcaaagctgctcatttcaattttcttttaaatttgctcaccaacaccgcttaatcacctctgtaacctactggaagtgttctctagatgggctttaaaaattaagccaagttgatttcttttttgttataaattggcttagcatcttgtttttatctggcttgaaatattgaagcagtaaaataaaaccacactctttaattgaaaggtgcttctgcagtattcaaaccacagttgtcagtcacacgtgttgttcaaattcttcagagctccgaaattacttaaaggtatcctcagtattctgagagagttatttttgccccactacaaaataaaaaagagccaatcagggctttctcaactctttggcagtatttttcctctaaagaatttcttgacactctctttagttcttgacttccagggttgttcctgacaaatctccagaaatgtatctcagtgc

SEQ ID NO: 8467 - DNA, 460 bp, Homo sapiens
  misc_feature 82..85,109: n=a, g, c or t
aaaaatgagtgatagtaacaaaagatggataggcccttttatctataaatccagggctttagagtacttttgttaacagcrnnnnarrrrraaaaaatctaacgtattntkgacacttttttcttcacaggctttgtttgagtatatctttcatcatgaaaatgatgttaagactcagcaaaatccttttcttcaagtgaaatcttatcgagaccctaatacgtaaaacagacaaaaggctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtcycattggatcaacctgtgactgctttaaatcttttcaaa

SEQ ID NO: 8468 - DNA, 466 bp, Homo sapiens
tctccctgtggtcgtcttccacgttgtggaaggtttgttgtttcgcttcttgcaataaatcttgctactgcttgccgtttgggttcaggctgcttttatgagctgtaacactcactgcaaaggtgtgcagcttcactgctgaagccgttgagaccacgaatccaccgggtggaacgaacaactccagacgtgccrscttaagagttgtaacactcacctcgaacgtctgcagcttcactcctgaagccagcaagaccacgaacccaccagaaggaagaaactccgaacatatcctaaagtcagaaggaacaaattccgtatacgctgcctttaagaactgttaacactcaccgtgagctccgcggcttcattcttgaagtcagtgggaccaagaacccgccaattccggacccaggattacagggtcttgctctgtctmcbakgctggagtacagtggtgcgtcac

SEQ ID NO: 8469 - DNA, 121 bp, Homo sapiens
  misc_feature 17,107: n=a, g, c or t
tttttctccgcgcagcncagtcgcagaggaagatggcgccgcggagggtcaggtcgtttctgcgcgggctcccggcgctgctactgctgctgctcttcctcgggccntggccgctgcgagc

SEQ ID NO: 8470 - DNA, 430 bp, Homo sapiens
aggtataagttgtggagtagcagtcaaaaataactgtgtgagttttaaattcggtggtacagattccaaatgttacatgtcaccaaaaaaaagatatcattttgatatccctttagaattgggaaggttgtaaagggaagataatgcatgaagatccagcaatagggataattattatatatgtgaaacagtgaatgtccttttttaagacagtgaatattctttctttcaacatagctgatattcttctgttaacagtagcagggaggggaatgtcttggaagaagttggagcctcacattaggtctctcactatgggttaaggcagatttcagaggaaaaaacttatttctgtttctgctcagtatctggggagtatggaagtggttagtaagtcaagcagtaattcttcgtgactccatatcttttt

SEQ ID NO: 8471 - DNA, 332 bp, Homo sapiens
gactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaasacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgat

SEQ ID NO: 8472 - DNA, 445 bp, Homo sapiens
gatgatatcatagggaatcaaagctgtcttcttgtgctgagtcacttcctgggtgggagccacaagatcagatgagccaatttatcgatctggggtgttgccagctgatccatcaagtgcagggtctgcaaaatatctcaagcagtgatattaggagcagtttagtggtggtcagaatcttgtagccttcagctgcatgactcctaaatgataatttctaatcttttggctaatttgttagtcctacaaaggcaatctagtctccaggcaagaagggggtttgtttgggaaatggcttttattgtctttgttttagactataaactataaactaagttctcccaaagttagttcagcctacacccaggaacgaacaatgacagcttaaaggttagaaccaagatggagtcggttagattagatctctttgactgtctcagtcata

SEQ ID NO: 8473 - DNA, 375 bp, Homo sapiens
catctgtgtgtttagcctttcagggtaaactctagagggttcagtttataattcccacctttcacatatagttcaacaacattaatccagagagaawtttwatgttttatgatatgggttatgttttattatatatdtdatgttttatgatatgggttagggattctccatggactccagaaaccctaaaatacaattttgaggttttccaataataccatagcagaaatgtccaaggggttgggggaagatattactttgagaaaacagaaatgtaaaggatttttgaccttatatatgtgtgtggttttgtttttgtttttgttcttgagagagtctcactctgtcacccaggctggagtgcagtggcgtgas

SEQ ID NO: 8474 - DNA, 256 bp, Homo sapiens
atttcctggtctggagccggctgagccacagcaggtgtcggggcctcaaccttgcggascgacagccatcgatcctcgggtggsctcgargtggtkgcagggccgccccctgcagtccggagacgaacgcacggaccgggcctccggargcaggttcggctggaaggaaccgctctcgcttcgtcctacacttgcgcaaatgtctccgagcttactcacatagcatattggtatatcaaaatgaaatgcaaggaac

SEQ ID NO: 8475 - DNA, 355 bp, Homo sapiens
caggtgaagaaactaaggaacagaggggttaagaagcttgcctggccacctgcagtggctcacatctgtaatcccagcaatttgggaggctgaggcgggaggatcgcttgagcccaggagcttgagaccagccagggcaacatagcaagaccctgtctctccaaaaaaaaacaaaacaaaaccccaaaaaactagctgggcatggtggcatgcatctgtagtgccagcactcggggggctgaggtgggaggatcgcttgagcccgtgaggttgaggctgcagtgagctttgattgcactactgcactctagtctggaccacagagcaagcctgtgtcccaaaaaaaaaaaaaaaa

SEQ ID NO: 8476 - DNA, 342 bp, Homo sapiens
  misc_feature 220..222,342: n=a, g, c or t
caggtgaagawactaaggaacagaggggttaagawgcttgcctggccacctgcagtggctcacatctgtwatcccagcaatttgggaggctgaggcgggargrtcggytkragcccaggagcttgagaccagccagggcaacatagcaagaccctgtctctccaaaawwwaacaaaacaaaaccccaaaaaactagctgggcatggtggcatgcatctrnnntgccagcactcggggggctgaggtgggaggatcgcttgagcccgtgaggttgaggctgcagtgagctttgattgcactactgcactctagtctggaccacagagcaagcctgtgtcccan

SEQ ID NO: 8477 - DNA, 369 bp, Homo sapiens
aagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggataaggactgtgtttctttccttttgtggaaaatkgtcattctgaatcttcaggvcaaacacatctggaaggtgatactgtacaaattatttgcaacacaggatacagacttcaaaacaatgagaacaacatttcatgtgtagaacggggctggtccactcctcccaaatgcargtccactatttctgcagaaaaatgttgg

SEQ ID NO: 8478 - DNA, 445 bp, Homo sapiens
taggtaaaatttaaaactgctctgatagtgttgtttgtgtaatgataaaccttcatttaaatattaatttaaatggtcaaatcttaatgataatgcgagttattgttgtgaagtaacagagaatatatttctgagcacttctgaccttaaaacaagtcacaagtcagtatggtgtggcgcttaagagcatgggcacaagatcccagacttatagttgtgtgtccttggagaaatgatttaatttctttgcatcaccatttttttcatatataaaataaggatataatgacagtacatcctaaatcatgacgatgttaacagagttaaatgagttvatacttgtaaagtgcttagatctacctggtgctcagtatttactcaataaatgtcagttgttgtwgttgttgttatatatttaatgcctctttagtgatagtgttctggc

SEQ ID NO: 8479 - DNA, 206 bp, Homo sapiens
caggtgaagaaactaaggaacagaggggttaagaagcttgcctggccacctgcagtggctcacatctgtaatcccagcaatttgggaggctgaggcgggaggatcgcttgagcccgtgaggttgaggctgcagtgagctttgattgcactactgcactctagtctggaccacagagcaagcctgtgtcccawaaaaaaaaaaaaaa

SEQ ID NO: 8480 - DNA, 138 bp, Homo sapiens
attacctgagaattccccagccgaaacggtrctggggcaagaaacttcttgttagaactttccacctccggcttccccctccacctcttttaccgtcccaaccttaggagacgctttttctcccccagaggagaattt

SEQ ID NO: 8481 - DNA, 67 bp, Homo sapiens; identical to SEQ ID NO: 8447

SEQ ID NO: 8482 - DNA, 269 bp, Homo sapiens
  misc_feature 95: n=a, g, c or t
agctgcgtgtccgggtgctaggctgcagacccgccgccatgacgctgcgcgcggccgtcttcgaccttgacggggtgctggcgctgccasgggtngttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagac

SEQ ID NO: 8483 - DNA, 270 bp, Homo sapiens
  misc_feature 206: n=a, g, c or t
tgttttatttttgtagagatggggtcttcctatgttgcccaggctaatctcaaactcctgggctcaagtgatcctctcacctcagcttcccaaarggatttaaagcatgggscatgatgctcagccacagttttcttttctkttcttttctttktgtttttttttgagaaggagtctcactctgtcgctcaggatggagtgcagtngcgcaatcttgtctcactgcaacctccgcctcctggattcggdsgattctcccgcctcagcttc

SEQ ID NO: 8484 - DNA, 317 bp, Homo sapiens
cacaacccagattaattagtttaacatgctgagtgcagtggcacacacctgtaatcccagcactttgggaggccaagatgggaggatcacttgagcccsargagtttcaagatcagcctgggaaatatggtaagacctggtctctacaaaaaattttaaaaattaagcatggtgtcctgtgtgtgtagtcccagctactcaggaggctcaggtgggaggatcacttgagctcagaaggcagaggctgcagtgagctgagatcatgccattgcactccagcctgggtgacagggtgagagtctgtctcaaaaaaaaaa

SEQ ID NO: 8485 - DNA, 312 bp, Homo sapiens
cacaacccagattaattagtttaacatgctgagtgcagtggcacacacctgtaatcccagcactttgggaggccaagatgggaggatcacttgagscccaggdrgtycaaagatcagcctggggaaatatggtaagacctggtctctacaaaaaattttaaaaattaagcatggtgtcctgtgtgtgtagtcccagctactcaggaggctcaggtgggaggatcacttgagctcagaaggcagaggctgcagtgagctgagatcatgccattgcactccagsctgggtgacaggggtgagagtctgtctcaa

SEQ ID NO: 8486 - DNA, 324 bp, Homo sapiens
tttatgtagtatgtgaaaatggagttgataaaccctaacctacgaggcagacttgttgtcagatatttgcgtgctgccctctaatagagtatacggtccctgtcatccagtcccctatgcagctgttttttattctgtgtagggtgtccaattgtcttctgcttgtgacagtggtatgatggtacatatttaacaaaccctttctgggaaaaataaccccaatttgtggtgtttgttgatttctgtggtataaatactcaccatgttccctggtagctacatgtgtgaccatggaattggaaagagatgcatgcagtggctctc

SEQ ID NO: 8487 - DNA, 203 bp, Homo sapiens
caacagtcttagcaaatgcagaccaggagctactatccagtgcctggctcggtggttcccacacccacagagccttgctcacagctagtgcagcagtcagagattgaactgcgaggcaacagcctggcagggggaggggcacctgccattgctgaggcttgagtaggtaaacaaagctgcctggaagctcaaactgggcggac

SEQ ID NO: 8488 - DNA, 355 bp, Homo sapiens; identical to SEQ ID NO: 8475

SEQ ID NO: 8489 - DNA, 328 bp, Homo sapiens
gcaaaacaagggcagcgggcccggcgcggtggctcacgcctgtaatctcagcactttgggaagccaaggcgggcgaatcacttgaggtcaggagttcgagaatagcctggcccacagggtgaaactctttctctactaaaaatacaaaaattagcggggcttggttgcgggcacctgtaatcccagttactcgggaggctgaggcaggagaatcgcttgaacccgggaagcggaggttgtagtgagccgagatcgcgccactgcactccagcctgggcgacagggcgagactcccgtttcgaaaaaacaaacaaaaaaaaaaaaaaaa

SEQ ID NO: 8490 - DNA, 58 bp, Homo sapiens
aactgcgrcgtcatcccggctataagcrcacggcctcggcgaccctctccgasccggs

SEQ ID NO: 8491 - DNA, 361 bp, Homo sapiens
cacttctgcttttggtgtcatatctaagaaaccattgcctaatccaaggtgacaaagatttacccctaagttctcctctaagagttttatagttttagctcyttacttttgggttctgtggtcagttttttagttaatttttgtgtatgttaatgagctgggtgttcaacatcattcttttacatgtggctttccagttatcccaccaccgtttgttgaaaagactattatttctccattgaattgtctcaacacctttgttgaaaatcagttgaccatagacacaggttatttatgaactcttaattctgtgccactgattcgtatgtctatcattttgccagtaccacactgtcttgat

SEQ ID NO: 8492 - DNA, 295 bp, Homo sapiens
ttgtggtttcctctattttgaattttttgatcaaaaaactgrttagcagaatatagtttggagtttggcttcatcttcctggggttcccctcamtsccttttttttgtcaaccccatctgtagcctcttcctctactcaggcagtcgacccgccacgatgagaagtgggaccagcagagggcgccaacttcaggagtccgctttcccamcaggcttcattcacccagtggacctgaactgtttggtagagscaaccggsccttccttcctcatcgttgtttggtatgcgcacagg

SEQ ID NO: 8493 - DNA, 333 bp, Homo sapiens
  misc_feature 112: n=a, g, c or t
gtaacggacggcggaggctacgtgaagagaggcgcggcgtgrstgagctacggttctggctgcgtcctagaggcatccggggcagtaaaaccgstgsygatsscggakgcgncggccaggccgagagsaggccgggcaggggtgtcggacgcagggcgctgggccgggtttcggcttcggccacagctttttttctcaaggtgcaatgaaagccttccacactttctgtgttgtccttctggtgtttgggagtgkckctgaagccaagtttgatgattttgaggatgaggaggacatagtagagtatgatgataatgacttcgctgaatttgr

SEQ ID NO: 8494 - DNA, 81 bp, Homo sapiens
aawactcatccacctctctgtcagagtgtctatgtggctgawtcgtttccagaaaakacctccagaaaatagcttcctgtt

SEQ ID NO: 8495 - DNA, 395 bp, Homo sapiens
ttagatttggtaatattttattttgcaattatttcatctaactacttaaaattaaaattaatccacagtgggttttctttgaatctagctctgttaggttttggtcyttggktcataaatgaattgtccaactcccttttggataatcaaaatgctcaacattttttcctttgcttgattttcagctaatagtgctggaccccccggtgagtatttgggtgccctctggcccatggctcaccccctggggtgcagctgccatggcgcagggataccagtgtcctccttggcctcttgtagagtctgtgtgcacttggacagcactgggcttccaagccccacctagcattgccagcagtcascttgtgtcctgctcaggcttaggctgtcagttc

SEQ ID NO: 8496 - DNA, 104 bp, Homo sapiens
  misc_feature 39: n=a, g, c or t
tggatgtcttgacaggggctttgcagggatttttagggntttttccacattgtccacattaatggttggcatgattgtgcttgcaggccaagaaatgatcatac

SEQ ID NO: 8497 - DNA, 403 bp, Homo sapiens
gaaaaaaaagctatatactcccctcacaaactggggacctcaagatctccaccctaaaatagttattttgaatttccccctggcaatgtaaaccgagagcttatctgsacaggtgtgggacagaaccaatccctctgcacacctgagacaaatgcctatctgattgcttcccctgccctattgtttacataaaaacgcagggtcactgaggcagtcgaaggcataagtgactattcctcctcccgctctcacatataaatbgtgtatttagtgaaaggttgatcaaagactcaaagaatgtgatcatttgttatctacctgtgacccggaagccccccaattccagttattccacctttccagactakaccaatgcatatcttacatgtattgattgatgtat

SEQ ID NO: 8498 - DNA, 91 bp, Homo sapiens
  misc_feature 38: n=a, g, c or t
ccttcccccatgaacttcagcctgtccacacaaaagcnacataaactcaagcaagaaatatgttcagccaaaacatgattatagtggcags

SEQ ID NO: 8499 - DNA, 416 bp, Homo sapiens
cagatgttaacagtctcagcccctaaatgtcaccttgtattacagcatgttatataagcacatacaggcacatacatgawatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaaaacaaaaaaattct

SEQ ID NO: 8500 - DNA, 432 bp, Homo sapiens
  misc_feature 386: n=a, g, c or t
cttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcantggtcaatgatgaattactaatgccttattttctaggcatataata

SEQ ID NO: 8501 - DNA, 462 bp, Homo sapiens
  misc_feature 119: n=a, g, c or t
aaaaagtcagcttaacagcattaaaagcaatttcaaaaaaaggaaacgaataccatatgatccagtaattccagtcctatgtatatctccaaaagaattgaaaacaggcccctggacanttatttgtacatcagtgttcatagtagtagcattgttcacagtagccaaaggtggacccaagatcccatcaacaaatgaatggatagataaaatgtggttcatccatacaacaaaatactattcagccataagawagaaagaaattctgatttatggtacaacatggatggatcttgaggacattatgctaagtgaagccagacacagaaggacaaatactggatgattccacttacatgagtacctagattaggcaacttaatattctacagaaattagaatagaggtttaccaggggctgttcagaggagggagtgggcattattgtttaatggctacagt

SEQ ID NO: 8502 - DNA, 451 bp, Homo sapiens
  misc_feature 94..95,146: n=a, g, c or t
tacacattaaaaatccaaagaaataaaagctcagtaaagggacagcatataagaagtgtttttaacaataaattgcattccttattgctaacanngggcvawttarggaaaaaatcdaattatactagaaacagaaccacataaanwtcttggaaattaccttaataaacacaaatgacctatgtgaagtahactgtaacacttgataaatttgaaaaacttacataaattttgaggataccatatttcaagccaacctaataattaagaatccaggctttgcattattgcagacctgggttcaaatcttgattctcgtaagtgttatgtgatcctggacacttaattaatctctcaagtatgtttacatctttccaatatatccaaatggatataacaatagtattggtgattgtaaggatttaagtataaaggagcttgaactaagtat

SEQ ID NO: 8503 - DNA, 365 bp, Homo sapiens
  misc_feature 123,125,127,212: n=a, g, c or t
attcccttcgtgccgctaccaagatggcggcgcccatcttgcggtccttttcctggggccggtggtctggtaccctaaatctctcagtattdargcccttgggggctgsgtaaggycbastcnandngctcaggggttactggcagcgsagaaggctcgaggtctgttcaaggavvwcttcccggagacggggacgaaaatagagctcccwnagctcttcgaccgtggcacggcgagttttccccaaaccatttactgtggcttcgaccccacggcagactcgcttcatgtgggtcatctacttgcgctgctgggcctgtttcatttgcagcgagcgggscacaacgtgatcgcgctggtgggar

SEQ ID NO: 8504 - DNA, 359 bp, Homo sapiens
aaagaataaaagaaactttggaaaatattttgacttggccaggtgtggtggcttacgcctgtaatctcagcactttgggaggccaaggtgggcagatcctgaggtcaggaattcaagaccattctggtgacatgataaagccctgcctctactacaaatgcaaaaattagctgagtgtggtggtgcccacctgtagtcccagctactctggaggctgaggcatgagaattgcttgagcctaggaggcggaggttgtggcgagctgggattgtgccattacactccaggctgggcaacagagcaagactccatctcaaaaaatttttttgtgaactacatactgtaaggctaaagataaa

SEQ ID NO: 8505 - DNA, 375 bp, Homo sapiens
  misc_feature 333,344,348: n=a, g, c or t
actgatggagatggtcaccagggagtgtccaggtcagaccgccacagaagagtgcagcctcctggccttcagacccaactgggacaaaccctgagaacagccttggcagacctccaggggcagctggactccctgaggctggatgttgcagcctctcccaggcatccactctgcagctgaggccaaagtttccaacgggaagggagggtgaggcttctatttgtttcccaagagccagctgacctttgaagctagtgataaccaccacaaacctcactggtgggagaacgaggcactgcagccagttctcatcaaccccacatccctgcaggndgccccaaggnbbrngrgtcaccatcctctgcaacgctgggc

SEQ ID NO: 8506 - DNA, 364 bp, Homo sapiens
tctaggcatatatcaataaatattttaaacagaaatggcctcattcagttctataacctaatttttaattttatttttattttatgactatttaaaacttatctgtattgatcttttgcttaacgcatgtatctatggagtcatttttgatggttgcatttttaaaagatatcatgttattaaccaacttctagttttgatcatttattttcagtttctggggtatttttcgggggtggttactgctgcaaaaaaatttcttaatgagtgactttgtcttatctgggggcagttatttccttaagattcattcctagaaatatttatttcaagtagtgtgtgcatttttaaggcctttggtagc

SEQ ID NO: 8507 - DNA, 401 bp, Homo sapiens
  misc_feature 294..296: n=a, g, c or t
cagcattcagcatgtgtcagattctgtaactatttctcctgtgatgtatcagtcagcttttgctgcaaaacagcatcagaaatctcagtggtctacaactagattcccattcttgggtagtctacaagttggcttctaggttatgctccaggctgggggtctgatcacgtctgctccacaacatgtcccgtattctgggtccctggttgamgcagcagcttaccttgggccrtgttctttctcatggcagaagcacaggaggccaagccctaccttgcaagcacaaatacaghnnntgctcactttctgttggccacaacacatggccatgcctsmsctctgtggggtgasgcagtgcatggccaaggmacaagcacagtccacacagggggctgtcactc

SEQ ID NO: 8508 - DNA, 421 bp, Homo sapiens
attcagccgccgctgtccccgctgcgcgccctcgcgcttctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaagggagacgtgttcgggcttcgagccacattcatggaggaaaatatgcaagtcttgcaaatgcagccaagaggaccactgcctaacatctgcacctagaagacgatcggaaaattggccgcttgctggatggactccaagtattccaccctcactgctcgggtgaaaggcggggacggcatccggatttacaagaggaaccggatgatcatgaccaacgcctattgctactggggaaagatcccac

SEQ ID NO: 8509 - DNA, 429 bp, Homo sapiens
caatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatgggctcarcawtcgkgcacagrggacatcaamccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatact

SEQ ID NO: 8510 - DNA, 406 bp, Homo sapiens
gaccaacagatacatgamaagtgctcaatatcactaatcagggamatgcaaattaaaaccacagtgagtggccagatgcagtggctcatgcctgtaaatcccagcactttgggakgccgaggcaggcagatcacttgaggtcaggagttcaagactggcctagccacatggcaaaacctcgtctctactaaaaaatacaaaaccacagtgaggtatcatctcacatctactagaatggatattatcaaaggcaaaaggtaacaagtgtgttgggaaaatgtgagataaagggaccctcttagactgttgatgagaatgttagtacaaccaatatggaaaatagtatgagtatggaagttctgcagaaaataaaaactgaacttccatatgatccagcaatcctact

SEQ ID NO: 8511 - DNA, 394 bp, Homo sapiens
tatataagtaaataaaagactaaggagtaattttaatgaaggatgtgaaatatttgtatactgaaaatttatagcattgttgaaagaaattgaaagtgacataagtagaaaaacatcccatatttatggatttgaaaaattaatatcgtcaaaatttcaatgctaccgaaagcaatctacggattaatgcaatcactgtcaaaatcccatgccattcttcacagaaatagaaaaattagtcctaaaatctgagtggaaccacaaaagactctgaaaaaccaaagcaatcttgagcaaaaagaacaaagccagaggcatcaggctacttgattttaaacaatattaaaaagttatagtacttaaaacagcatagcactagcataaaaacagacac

SEQ ID NO: 8512 - DNA, 427 bp, Homo sapiens
cattttatattggatgatttttttcatcttatatgcccctaccataccaaaagtacctattctagtacttaggccacaaacttggaatgtagtggagcatagtatcatggtaaaacccaggccgaatttgggccaggtgaacaagagcacaaaggattgagggtgtttatgaaaagttggatcatgaaacctagatcatgcatctaggctgatttaaggaaggaagtggcagaagagggcttttagtaagaaaatggatgagctaaaggaatggacaagattgaaatttaggataaggaagtggcagaggagggcttttagcaagaaaatggatgagctaaaggaatgaacgagattgaaatttaggatttaagaggtgataaaccacctggtttgtaacaaacttagatttagctatagaatagac

SEQ ID NO: 8513 - DNA, 73 bp, Homo sapiens; identical to SEQ ID NO: 7980

SEQ ID NO: 8514 - DNA, 465 bp, Homo sapiens
agtttgatctcagactgctgtgctagcaatcagcgagactccgtgggcgtaggaccctacgagccctgtgggatgtaatctcatgagctggtatacggtgcctctccagaatcaccttgttctttctggatctattcagaatctgaaactcctagaaaagaaaaatgcaagatgcatgagtgttgatgtctgaccaaactccagggtagtggaaagagtgtccttttgcctcatatcacctttgctgaacacaggtgctaaatggatggcaggttgagagttgagacaggatctcactatgttgccttgcatggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctag

SEQ ID NO: 8515 - DNA, 494 bp, Homo sapiens
  misc_feature 250: n=a, g, c or t
ctctttccatcacagaccttttttctagccctgacccttgtgtcaaccttgggtgagtttctagtatcagccccctcccagctgggtggctagggggtttgggctgggattcctgtctgggacccaggctctccttatgcaggtataaacaatgattactctcagctgtttcagccttgctgcactgctgtcactcatgattcttcctctaaaagtttttccactagctgcttctggcttttgattchrnrccgctcactataattcagtttctcttagctgataactctcatctcagtacatctgggtcgtcttttctgtttggctctctggttctttggaaaaactccttctttctatcttccctctccctgctccctgctccctgctcaaccccamtccagccaggaatggataaacaagtccaagtatgttaatgccagggagtaactaccaggrataaaactgagcataagcaaactcatcagtgtgac

SEQ ID NO: 8516 - DNA, 350 bp, Homo sapiens
cactgtcctggttgtgctcaatgcatactttttgctacctgtttgatattaccacattaccctcttgaggcctgacattcatttgatctatagccagatgaatcagattggtttcccaatttttatagtttttaaaacctttatgctgacaatttagagggaaagtgtctgtttcttaacatgaaagaaaaagaggatagtgtaggttcattgtttcttctccctccttcgtccaattgaaattgatgtgaaaatgaatttataaacttttaaaattagaatgtatcagaaatagacatgcatttatagtttgatgtcttacttgataggttacttacttttttcytttt

SEQ ID NO: 8517 - DNA, 388 bp, Homo sapiens
  misc_feature 329: n=a, g, c or t
caagcaaattatttttatttatttattttttgtttttcttagaatcaaggtcttgctctgtcacccaggctggagtgcagtggcatgatcatagctcactgcagccttcaactcctgggctcaaataggcgtgcaccaccatacctagctgattttatttttattttttgtggagatgaggtcttgctgagctgcccaggctggtcttagactcctggtctccagcggtcctccagccttggcctcccaaagtgctggtattacaggagtgagccaccgtgctcagcatttagcaaactattgaacctgaggagtggtcatgggaahcntgatgaatagctgggtggtgtgaagtacaggaggcccaaaacttgtggctggcatctga

SEQ ID NO: 8518 - DNA, 322 bp, Homo sapiens
cacaacccagattaattagtttaacatgctgagtgcagtggcacacacctgtaatcccagcactttgggaggccaagatgggaggatcacttgagcccaggagttcaagatcagccytgggaaatatggtaagacctggtctctacaaaaaattttaaaaattaagcatggtgtcctgtgtgtgtagtcccagctactcaggaggctcaggtgggaggatcacttgagctcagaaggcagaggctgcagtgagctgagatcatgccattgcactccagcctgggtgacagggtgagagtctgtctcaaaaaaaaaaaaaaaa

SEQ ID NO: 8519 - DNA, 286 bp, Homo sapiens
  misc_feature 193: n=a, g, c or t
ttgcccttggctgggtgtggtagctcgtggctgtaatcccagcactttaggaagccaaggcagtaggatcgtttgagcccaggagttcgaggctgcagtgagctatgagcatamccactgcactccagcctgtgtgaaagagccagaccctgtctcaaaaaaatgataaaacccaaaactttrcccttgtganccctcccttcccccctccmccccccaaaaaaaaacaacaaaacacaaaaaataaacatttgttccagggcaacctggaaaaaaaaaaaaaaaa

SEQ ID NO: 8520 - DNA, 411 bp, Homo sapiens
aaaaaaaggttacatcagcccataaagcacatagccaccgtaagtaattgcataatggaacagatataaaaggactgtatgaggcaaaagaagtcttctgggaatytccmaaaaccctgargacacagtgagttagcaccaccaccaggaattggcctttcagctctgtgcctgtctccagtcaggctggaataagtctcctcatatttgcaagctcggccctcccctggaatctaaagcctcctcagtcttctgagtcagcctgaaaggaacaggccgaactgctgtatgggctctactgccagtgtgacctcaccctctccagtcacccctcctcagttccagctatgagttcctgcaacttcamacatgccacctttgtgcttattggtatcccaggattagagaagc

SEQ ID NO: 8521 - DNA, 303 bp, Homo sapiens
ccatttttcagggtaactagattataaattgtagaataattattgctaatttgtatcagaaaattaagtctaggataacatgtggagtcttgctatgttcatttttaatcctttagctattaccccattgaattaaaaagagtaatgtgtggtagagtcatcaatgatgggcgagatttcagaatacggagagaaagaagagaggcatatattaagattggtaaaattcactcacaaatgaagtaataaagaactgcacttaaattgtgattcattagattgtttgttaaggcccaagagcac

SEQ ID NO: 8522 - DNA, 157 bp, Homo sapiens
caaaaaattagccgggcgcggtggcgggtgcctgtagtcccagctactcgggaggctgaggcaggagaatggcgtgaacctgggaggcggacttgcagtgagccaagattgtgccactgcaatccggcctgggctaaagagcgggactccgtccaaa

SEQ ID NO: 8523 - DNA, 354 bp, Homo sapiens
  misc_feature 38..39,54: n=a, g, c or t
cacacctacaaataccacaccacacctacacacaaagnnttcataaaaatatanagccgggchgggcgtggtggctcacacctgtaattccagcactttgggaggccgaggcgggcggatcacctgaggttggcagttcaagaccagcctgatcaacatggagaaaccccgtctctactaaaaatacaaaattggccaggcatggtggcgcatgctgtagtcccagctactcgggaggctgaggcaggagaatggcatggactcgggaggcggacttgcagtgagccgagattgtgccactgcactccagcctgggtgacagagcgagactccgtcccaaaaaaaaaaaaaaaa

SEQ ID NO: 8524 - DNA, 398 bp, Homo sapiens
  misc_feature 196: n=a, g, c or t
catcactctcctggtgagcttctgaagatcaccaatgtcacatatatgttacaattttttctaacaaaattgtatgatagcacagatgacatctgctatggtttgactctcccctccaaaacccatgtgaaaactcaatccccattgtggcagtactgtgagatggggcctttaggagatgattggatcatgaagnctcttcccacatgaatggattaacccactcatgcattaatggattaataggtgaatggattaatgggtatcatgvgagtggaaatagtggctttataagaaaaggaagagatacctgagctagaacatgagcacactcaattccctcaccatgtcacascctatgccgtctcgggactctctagagagtcccaccagcaaga

SEQ ID NO: 8525 - DNA, 83 bp, Homo sapiens; identical to SEQ ID NO: 7926

SEQ ID NO: 8526 - DNA, 326 bp, Homo sapiens
  misc_feature 286: n=a, g, c or t
aacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctcbaaacacgcttctacactgataacaagaaatatgccgtagatgatgttcccttctcaatccctgctgcctctgaaattgccgacctnagtaacatcatcaataaactactaaaggacaaaaatgagt

SEQ ID NO: 8527 - DNA, 315 bp, Homo sapiens
  misc_feature 236: n=a, g, c or t
catcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgaggcaggagaatggcttgaacctggganrbaggagattgcaagatcgcaccactgcaccccagcctgggcaacaaagtgagactccgtcgcaaaaaaaaaaaaaaaa

SEQ ID NO: 8528 - DNA, 374 bp, Homo sapiens
cttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgcaccctctccgcttgcctggtcccctctcctctccgccctcccgctcgccagtccatttgatcagcggagactcggcggccgggccggggcttscccgcagcccctgcgcgctcctagagctcgggccgtggctcgtcggggtctgtgtcttttggctccgagggcagtcgctgggct

SEQ ID NO: 8529 - DNA, 460 bp, Homo sapiens
aagactggagttagctaccggactgtcccgcgagcggtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactggaatttcttgatggaaaagaaattaaaaatatagaaagacaattcctaatg

SEQ ID NO: 8530 - DNA, 434 bp, Homo sapiens
aaagagaaggactatgggggaactgatggcgttcctgttacctctcatcattgtgttaatggtgaagcacagcgattcccgtgagtatcccacgtcctcttctctcctaactccaaagtcgaggcagcctagaaggcacagcttttcttcctaaaacttgtggtgaaaaatatagaagccaggggcagaaacgtgtatgtattacactcaggactccaggagcaatggattgcctgaacagtttcccagttcatatttgtaggattttgatgtcaccaccttctgagggagggggagccgttctagaaagactctggaacttcctcactttccctctgagcatggcctcctttcttttctgctcatattttttcttttacttttgtttctcctcttttctaacttccagagtctcatgaggatgtagtcagagt

SEQ ID NO: 8531 - DNA, 114 bp, Homo sapiens
cgggtgttcgccgctggagcccgggtcgagaggacgaggtgccgctgcctggagaatcctccgctgscgtcggstcccggagcccagccctttcctaacccaacccaacctags

SEQ ID NO: 8532 - DNA, 508 bp, Homo sapiens
thattattcctctcagccaaggaaataaaagtagggagagatgattagaaattaacagaggtatgtctcgaaggagagtgctgtttcccattgctcaataggtagtgctcatttgccctatatgctgcaaattattgtcagcaggaaaggaagtatatatgttagctaagctaaatgtctgaataatataacaacaaaaataattataacaaatataataatahrtvccacatatcaaatgcatccggtgtgctcggtattatactgatggctttacatatattacacatttaattttcatgatgctcctggatgagaaataatgcttttgtgttttacacgaaaggaaattgaggaaaggaaagggaaattgaggcatgcagaatgttaagttaaatcattttcccaaggtcamccagcaggaccttgacaaagcaggagtttgaamccaggtctaaccmaactgaaaacccagaccttttctgatatatcacacatcttctacaca

SEQ ID NO: 8533 - DNA, 72 bp, Homo sapiens
attaattggatattgatgaaatcattggcctggcaaaataaaacatgttgaattccccaaaaaaaaaaaaam

SEQ ID NO: 8534 - DNA, 369 bp, Homo sapiens
gcaggctcctcagagaacacagraacagctgaaaccagggtccgarctcaggaaacctggactacagcgcasakggtaaacctgacaaataaacgcgacggggaactccgtcccaagctgctgatctatggaatgaagcaacacctcatcaagagaagcaacctgggcaaaccaggcctggtttaactgcactttctcacgtttgakcattttctcaakrgatacgtgcgtggtcctctgcaattcagaatgaaatctgaacttctggaaaaactctcctagagggggtttgaggacaagaggtaagacccaggtcagtcagatggcaaggtgccgctccctacagcaaagtcagcatgtaggccccck

SEQ ID NO: 8535 - DNA, 154 bp, Homo sapiens
ctawaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtc

SEQ ID NO: 8536 - DNA, 433 bp, Homo sapiens
  misc_feature 5,17..18,23..24,31: n=a, g, c or t
cagtnccacaccctgtnngcctnncccactncacccacagtgaggaccccctggtgttggggacactccgggtctgtgggatttctccagaagcagactcagacagggattggcacccacactgaaaagttaacatagtctaaatatgtgtgtccctcccaagttcacatgtgatggtggtattagggggtagggcctttgggaggtgattaggtcatgggagcacagccctcaggaatggcaatagtacctttataaaaatggcccaagagagatccctcatccctcccaccatgtgaggacacagtgagaagccccatctatggaccaggaagcbccctccccagacactgctggggscttgatcttggactccacagcctccagaacaatgrgaataaatttctgktgtttgtaagttgtgcagtctgtg

SEQ ID NO: 8537 - DNA, 391 bp, Homo sapiens
gacatttatgaattatgaatgkttctattatgaagggcaattattaccttaagtagtagctggtaatgaacactgaatgcctactatgtgctttacatacaccacctcakttcaagtccccaataaagccataaagttgatattrcaatctataaagtataaggtcagtacttcatatgtgaagaaacagaggcttakagagrttatacacaacctgctaaggccacacagctagtatgtacagctgggcatagagccaggcccttgttctttttcccaggatgcaatctgcactgcctgtgggtgtcaacacagaaagttggtggaatctggtttattcckakacaatgttagatgtggaacttaaacatatatgtggaagttatgctcy

SEQ ID NO: 8538 - DNA, 459 bp, Homo sapiens
aaactggagttagctaccggactgtcccgcgagcggtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactgggtacatatttatattaatataatttttaagagaatgacacctagttaact

SEQ ID NO: 8539 - DNA, 351 bp, Homo sapiens
taaatcagggcgattcagcaaaattccatttgaattgaatctgggccaggggcaggagtgccatggagcgtctgtgtagaagctgacattttaatgatttgattagtttaggaagaatatttttatggattgtgtcctcgattatattaagtactgagtgaacttgttacattatgatgaacttccattacctacactggttgtgtacaagtgcaatgatttcagcccaagaccctaagggtaatctcgtgcaatcctcttaaagaaatgctgtttaatgactaaagctgttaatcatattaaatacatacagccactctgggaaaatatgccaaacaagcataaatctaa

SEQ ID NO: 8540 - DNA, 423 bp, Homo sapiens
catgctcctgtatctagattaaaatcctatgacagatgggcctgcttatatctaracttattcagagagtcttatgataggcaacaggttaccctttaccggggtaaaacatggtttattctacagtttggtcccgttgtaaggccaggagatagagtctcactagtttgccccggctgaactcgaactgctggactcaagggatccttccgactcagcctcccaattagctgggactgttggtgtcaggcacacaccaccttgcctagcttgaagatctttcttctaaatgagcgggctttaaagtgatcagtgggacctgggcaggttggctcttgcctataatccaagtgctttgagagaccgagacaggracatcacttgagsccaggagttcgaggctaaagtgagctgtgagcacac

SEQ ID NO: 8541 - DNA, 394 bp, Homo sapiens
ttcccgggttcaagcgatcctcctgcctcagcacccctagtagttgcgattacaggcacatgccaccatgcccagctaattttgcatttttagtagagatggggtttcaccatgttggccaggctggtcttgaactcctgacctcaggagatccaccacctgggcctcccaaagtgctgggattacaggcatgagccactgtgcccagccttcctcagctaacttttatcatcatccccttcccccattttatagtaaatattgttaagtgcacagttaagacacaaatctttttttatttttatktatttatttatttactkatttatttgagctggagtctcgctctgtcatcaggctagaggtgcagtggtgcgatctcggctcactgcaa

SEQ ID NO: 8542 - DNA, 434 bp, Homo sapiens
ctgagttctgtatttttgaaagtctttttttatgtttgaatatattctaatttactgtaatttgccatcgttttatttgatccaaatcatatatattttagattataagaacatctgtattgtataatatttgcaagtaattaaaaaatattttttaaatcctaggtttaggcttcgtagatctgaatgcggttttttcattaatcttaaataaaatttaagactgaatttacagttgttaaacattcataacatgatcaatttttagtgggttttttggtggggtgtactattttccaccctttttgtatctagttgcaaggagccaagaacaggcaaattattaactcctttattatttcctcctgtctgaaatgttttcaagcagcgtatttgtctgttaaatcatgaaaaactgaaaaaaaaagtctatg

SEQ ID NO: 8543 - DNA, 480 bp, Homo sapiens
aaaatctagatattcttctaaatctgtactttcttggtctatatcaaccaaccctatacctatgccagtgacttctgaatcttatttctcaagctgtggcttttctcaagctccttagctatagttccagctgcctgctaggtcttccccaaaagatttttttctctgtttcctgtctgttgaaacatcagaatcatcttttattcatcccctgctgttatccctttcccaacacatgtaaaccaaagtggtaaccaagttatgtgagttttgtctctgaaatttcctttaaatcaattccctcttttttatctcatcactactgcccatttaggctcttgctatcgcttgcctgacaataactatcttgtggattctttttttctcctcattttttttattttaattttttgtagagaaacgttcttgctatgttacccaggcttgtctcaaactcctgggctcaagcaatcctcatgc

SEQ ID NO: 8544 - DNA, 408 bp, Homo sapiens
cgaaatagttcttcaggatttgttaaggcaaatagcagtccttccttctctccttcctattttatctttcttagaagcagtgtctttcaattcttttagctgtttattttgttttttactgctacatctgtaataatatgtttgtatttgatacctcttgatttttgcttttaggtattttttattgagttcccagtatgaaagatgagaaattagttctctgtcttttttctccctgtcctaaacacatccatacatgtccttcctatcctctcattctcctagtatggttataatttagattagatcaatatatagttgttatgattatgtaagcactactgagaactcaaccatgcagtatatgattattttttacttccttgtaaaacttgttttttttttttk

SEQ ID NO: 8545 - DNA, 302 bp, Homo sapiens
taccttgccgggcgcggtggctcacacctgtaatcccagcactttgtgaggctgaggcgggcagatcacgaggtcaggagatcgagactatcctggccaacacggtgaagccccctctctactaaaaatataaaaaattagccgtgcatggttgcgggcgcctgtggtcccagctactcaggaggctgaggcgggagaatgatgtgaacccgggaggcggaccttgccgtgagccaggatcacgtcactgcactccagcctgggtgacagagcaagactctgtctcaaaaaaaaaaaaaaaa

SEQ ID NO: 8546 - DNA, 348 bp, Homo sapiens
caggtgaagaaactaaggaacagaggggttaagaagcttgcctggccacctgcagtggctcacatctgtaatcccagcaatttgggaggctgaggcgggaggatcgcttgagcccaggagcttgagaccagccagggcaacatagcaagaccctgtctctccaaaaaaaaacaaracaaaacccchaaaaactargytgggswwgggkggcatgcatctgtagtgccagcactcggggggctgaggtgggaggatcgcttgagcccgtgaggttgaggctgcagtgagctttgattgcactactgcactctagtctggaccacagagcaagcctgtgtcccaaaaaaw

SEQ ID NO: 8547 - DNA, 84 bp, Homo sapiens
ccggagggcggacttccagtgagccgagatctgcgctccaacctggggacagagcgagactccctctcaaaaaaaaaaaaaaaa

SEQ ID NO: 8548 - DNA, 88 bp, Homo sapiens
  misc_feature 35: n=a, g, c or t
atatcctagmtgcmttgtbaacatcttcgagcatnggmagctccggaggchggggtaactgscaggtaagtasgctttggagtggtat

SEQ ID NO: 8549 - DNA, 183 bp, Homo sapiens
atttctaaagtcacagcctggaaggattcctggtctctcccaccttctaccattctgctgccagtgacggcaaggattggtgtagcttctgcgcagtgctttgtgcctggaataccgagaaggaagammmagaagacaagcacccwggtccttttctaagaaattacaggcgcccttgaagaa

SEQ ID NO: 8550 - DNA, 146 bp, Homo sapiens
ccaaaatggaaaggaaatgttctatgttgttcaggctaggagtatattggttcgaaatcccaaaaaaaaaaaaaaaaaaaaaaaaaaaaaaaaaaaaaaaaaaaaaaaaaaaaaaaaaaaaaaaaaaaaaaaaaaaaaaaaaaaaw

SEQ ID NO: 8551 - DNA, 147 bp, Homo sapiens
ccaaaatggaaaggaaatgttctatgttgttcaggctaggagtatattggttcgaaatcccaaaaaaaaaaaaaaaaaaaaaaaaaaaaaaaaaaaaaaaaaaaaaaaaaaaaaaaaaaaaaaaaaaaaaaaaaaaaaaaaaaaaah

SEQ ID NO: 8552 - DNA, 149 bp, Homo sapiens
caaaamattagccgggcgcrgtggcgggtgcctgtagtcccagctactcgggaggctgargcaggagaatggcgtgaacctgggaggcggacttgcagtgagccaagattgtgccactgcaatccggcctgggctaaagagcgggactc

SEQ ID NO: 8553 - DNA, 167 bp, Homo sapiens
agatgttctcagtgtgaggtggttatgctggcttcctccaattcctcctcttcgtcggctgtgactgaccgagacagcggcttgggcttcggcagagacttgagactgcgggcacccgctgccattaggattgttgaatgakctgtgagaagggagtgggggatatr

SEQ ID NO: 8554 - DNA, 474 bp, Homo sapiens
  misc_feature 214: n=a, g, c or t
tccatcggctactcgtgtacattttggttcattgattcaactggcctttgttaagtaatagataaaaataaaggtttttctagtgaatgcttgtttgttagtatgataataaattgtgaaatagcttagttctaatacatatctttttaaactactcacaactccagctctaacttgagctttgcattcytttgkgaraaagkttggaaaaccnttttttccagagagcttatatycttgacctttctatggaaaactcattttagatcatccatataccttcagttttaaattgtatgactgttggctcagttgcctgattatatgatactaaaacttagaatwtttcccccagagagggggtctaggttctgcacaatcttatttcccacaaaaaagaagttaattgccgtagagtttctttatgtacctaaataattgtcaagatgtctgctaacttgtcagtaatcacaa

SEQ ID NO: 8555 - DNA, 426 bp, Homo sapiens
atgggccagctcgcgcaggtggccccggtgccgctgttcatcgggccgcgcggggaaggcggcggccaagatgcgctccgtcacgtaggatgagcaatacccacagcactccgttcaaggtcatctcctgggggccctctctggagccaccagacctctggacaccatggccaggttccttgccctbcccaacccattsccarrggggaattmacmaattccacgggaggcaaggcctgacaggctgaagtcacctggaaggggaccgatgcctggtactggataggaacttcatggaatggagctaatgggccgtaggcaggtttgagtcgtgccaccctggagcagaaggtggagggtagggataagggggtggagcacctgattccaatcttgccacagggaagaagagtctgtgaagaacat

SEQ ID NO: 8556 - DNA, 404 bp, Homo sapiens
cttaggcatttcgccttagaaaaagcgctccctacgaaagccactataatawaaacacgccatcctccccttgtcttgtaagttctctctcttcaaatccttctcttgccagttcgtgaattccactcttcccacactggaagcttctctaggacaagcagttcgtctttaatagctaatatagaaacytggaawggtaaargggkcccytggagaatacatattgaaaggataaattttcctatgtgatggctgcagctatggaggtaggctactacctttaaaatacacatataaggatatatcttgatgaggaaacaaaagttaccatccacataccaccaagctcttccaaaagcaaggagaagaacgacatgctttctaaccttggaaaagcacaaaaa

SEQ ID NO: 8557 - DNA, 318 bp, Homo sapiens
tttacaaaaagtttctgccgaagatggcagggtgtgatggctcacgcctgtaatcccagcactttgggaggccgaggcaggtggatcatgtgaggtccacgagtttgagaccagcctgaccaacatggcaaaaccccatccctactaaaaatacaaaagttagccaggtgtgtggcgcacgctgtatctcaagtactcgggggactaagcaggrgatcgcttgaagctgggaggcagaggttgcaktgggccaagatgccccgcagcactacagcctgggcaacagagcgagactccatctcaaaaaaaaaaaaaaaa

SEQ ID NO: 8558 - DNA, 171 bp, Homo sapiens
tcgctgtgacggcctgggctccgggaggaggcgcagggatcctcggaaaggcctgtggtgcggtttggtggatttggggcgcaccacctscgccctaaccccaaccccaacgtgtccccaggccggatcacctcaacagtcacgtcagacaagtgcactcaacagaacggc

SEQ ID NO: 8559 - DNA, 312 bp, Homo sapiens
  misc_feature 281: n=a, g, c or t
gacagcgcastcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgktcatcggagctactggcmacgadttttscggtgaagattatggaagtgacagctgagcggctragtcctgagcagctggaggaggtgcgggngdmcacacggcgagagacacacatccttcgc

SEQ ID NO: 8560 - DNA, 442 bp, Homo sapiens
cagttgcccgcctgccccggagagccaggcgctaaccagccgctctggccccgcgcctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaagaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaa

SEQ ID NO: 8561 - DNA, 318 bp, Homo sapiens
  misc_feature 107: n=a, g, c or t
gcaaaacaagggcagcgggcccggcgcggtggctcacgcctgtaatctcagcactttgggaagccaaggcgggcgaatcacttgaggtcaggagttcgagaacagcntggcccacagggtgaaactctttctctactaaaaatacaaaaattagcggggcttggttgcgggcacctgtaatscccarttamtccggaaagsctdarggcaggaraatcgcttgaacccgggaagcgraggttgtagtgagccgagatcgcgccactgcactccagcctgggcgacagggcgagactcccgtttcgaaaaaacaaacaa

SEQ ID NO: 8562 - DNA, 317 bp, Homo sapiens
caggtgaagaaactaaggaacagaggggttaagaagcttgcctggccacctgcagtggctcacatctgtaatcccagcaatttgggaggctgaggcgggaggatcgcttgagcccaggagcttgagaccagccagggcaacatagcaagaccctgtctctccaaaaaaaaacaaaacmaaascccmaaaaactarcygggcatggktgcwkgattctgtagtscsavcactcgggggsctraggtgggraggatcgcttgagcccgtraggttraggctgcagtgagctttgattgcactactgcactctagtctgg

SEQ ID NO: 8563 - DNA, 184 bp, Homo sapiens
taaatagtttaatatgaaatggcaaatacattccattaggataagaaaggtattgttgccagggagttgtttcactggaaatgtttaaatccagcagctgggaaaagggaagggtgactcgggtacaaaggacaccgattaaatgcagtaacttattaattttctttgccaatagtgtgagtgk

SEQ ID NO: 8564 - DNA, 136 bp, Homo sapiens
caaaaaattagccgggckcggtggcgggtgcctgtagtcccagctactcgggakgctgaggcaggakaatggcgtgaacctgggakgcggacttdcwmtgagccaagattggtgccactgcaatccggcctgggck

SEQ ID NO: 8565 - DNA, 422 bp, Homo sapiens
  misc_feature 22..24,31..33: n=a, g, c or t
agatttgtcggcttgcrgsacnnnttcagvnnncgctgtctctgaacttccagcctcagagaccgccgcccttgtccccgagggccatgggcgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagtgagctcttgggacggggtggccagaacgaagaggtggtgggagtggaggggtcttagaataagtccaaaggcctgggccagtccacttcctctctgcaggctggtggccgcgctctctgtcaccctgggcctctttgcagtggagctggccggtttcctctcaggagtctccatgttcaa

SEQ ID NO: 8566 - DNA, 207 bp, Homo sapiens
  misc_feature 189: n=a, g, c or t
actaaatcctacagttgctaggtacccttttcaagcgaacacttttgcacccactcccactcvaagcacaactcgcttaacaatgaccaccaaggcbgtcggtatcgatctcggcacgacgtactcgtgcgtcggtgtctggcagaacgaccgtgtcgagattatcgccaacgaccaaggcaaccgcancacgccctcctacgtcgc

SEQ ID NO: 8567 - DNA, 136 bp, Homo sapiens
  misc_feature 29: n=a, g, c or t
aagaccatgtcgaagggccccgggccggncggctccgcagcttcctcggcgcccccggccgctaccgctcaggtgctgcaggcacagcccgagaaaccgcagcactacacggcagaggagagagaccagtgaaggt

SEQ ID NO: 8568 - DNA, 395 bp, Homo sapiens
  misc_feature 87: n=a, g, c or t
tcccagacaaacaaaagctgaaggattttgtcaataccagagcagttctacaagaaatgctaaaggaagttcttcaatctgaaacanaagagaacattaatgaacaacaggaaatcatctgaaggtgaaaaactcactggtaatagtaatgacacagaaaaacaaagaatattataatattgttattgtggtgtgtaaactcctcatatcttgagtagaaagactaaatgattaacctatcaaaaataataactacaacaacttttcaaggtaaagacagtataataaaatgtaaatagaagcaatagaaagttaaaaagcagggggatgaagttaatgtatagagtttttattagttttctctttgctggtttgttcgttgtttatacaatcaa

SEQ ID NO: 8569 - DNA, 152 bp, Homo sapiens
tcccttcttctcaggtcaccagcaccctcggaacccagaggcccgcgctctgaaggtgacccccctgggaggaaggcgatggcccctgcgaggacgatggcccgcgcccgcctcgccccggccggcatccctgccgtcgccttgcagcacaw

SEQ ID NO: 8570 - DNA, 184 bp, Homo sapiens
  misc_feature 57: n=a, g, c or t
acagccggatccacggtgactaatctccgggaaggcgtccagcgtgascgtgaggcntgcacctgcgccggacttcaccactcaccaggagtctctgcccgccgcccccagcgcggttctcttccctgctagacgtaaagtcctggggacaagcacagcccagggcactttctggagagaagat

SEQ ID NO: 8571 - DNA, 67 bp, Homo sapiens; identical to SEQ ID NO: 8447

SEQ ID NO: 8572 - DNA, 387 bp, Homo sapiens
ccttccgtcctccgagccttccgtcggtcggtccttgcttcctgcttcgcctccgcgcctcgcgctatgggacagagcccccgatccgccagcaccacctgaggatccagaaaccgccccagcgatgtaagaggatcaggagctggagaggaaagcaatagaagaactgcttaaggaggcaaaacgtgggaaaactagagctgraaccaatggggacccatgggttggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacaga

SEQ ID NO: 8573 - DNA, 191 bp, Homo sapiens
  misc_feature 2: n=a, g, c or t
tnctcctcccgcctgaggcgagtctgggctcagcctagagctctccggcggcggcgcasttcagggcagcgcgggctgcagcggcggcggcggttagggctgtgtagggcgaggcctcccccttcctcctcgccatcctactcctccctcctcrtcatcctcccccttcgtcctcctcgccttcctcctcm

SEQ ID NO: 8574 - DNA, 416 bp, Homo sapiens
ctttcccccccaacccccatcttccactaattccccaaaatcaccaacacaaacccaaacaccacacccaccccatatatcttctctaccccttttacaaaacatccacttcttcctttccccacatatatcccaatctataacaaacctcatattctacacatcaacccaatccctactcttcaaaaaccaatcccccacaastcgtagcatcccaaaactccagcactctacaatcttagccaccatcctswtcscattcttctaaacaaacaacttaacccgaacattcttcccaacacaattaatctccctattcaccacattaagcactctaacaccccacataccttcctcaaacctctcaaccaaaatcatcacaaaaacaaacaagccaaacacaaacctagctccct

SEQ ID NO: 8575 - DNA, 331 bp, Homo sapiens
  misc_feature 102: n=a, g, c or t
gcaaaacaagggcagcgggcccggcgcggtggctcacgcctgtaatctcagcactttgggaagccaaggcgggcgaatcacttgaggtcaggagttcgagancagcctggcccacagggtgaaactctttctctactaaaaatacaaaaattagcggggcttggttgcgggcasctgtaatcccagttactcsggaagctkaagsaagarrawtcgcttgaaccsggraagcggargkttgtagtgagccgagatcgcgccactgcactccagcctgggcgacaggggcgagactcccgtttcgaaaaaacaaacaaraaaaaaaaaaaaa

SEQ ID NO: 8576 - DNA, 68 bp, Homo sapiens
tcaagatcgcaccactgcactccaacctgtgcaacagaatgaaaccctgcctcaaaaaaaaaaaaaar

SEQ ID NO: 8577 - DNA, 483 bp, Homo sapiens
  misc_feature 150,152: n=a, g, c or t
taaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtktnbnytaaagacttattgaaatggttactggcgtaaatacttggscaackcaacytttawtgscccyggaacttttccmatttkggtttsccacctwamcctatagcagctcctccaaatgaggaatgctgtaagtaagactcatcaaacagattttaaccattttattatcckgtgtgtccttacattgcttctgtgagaygtttttktctkatctgagatgaactttcaggagcctatttgaactccagactggtgttctggggcaaagagctattagccaaactgattctatgcaggtgaaggatgcactaaagttctcactttagtgagaa

SEQ ID NO: 8578 - DNA, 386 bp, Homo sapiens
tgaaataacagaaatttcttttctcacaattttggaggctagaagtctgagatcaaggtgttgacaggttttgtttcttctaaggcctctctccctggcttacagatggccatcttctccccatgtcttcacatggtcttccttttatgtatctgtgtcctcatcacagatgagtaattttttacagtaaaaaawtayggaawtttttaaaattamcwttaccmcwtacatttacccckcaacaattttcaggtatacattacctgaaacaacatgcattgtttaactaaatgcatgttatacagcaaatctctagaagttttttgtcttgcgtgactgaaactatacctatggaacagcaactctgcttctccctctcttccgcc

SEQ ID NO: 8579 - DNA, 363 bp, Homo sapiens
  misc_feature 199: n=a, g, c or t
cacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaacngtgaactcvagcaggcattttttttttcttaccgaaaggctgctattgtgcaagggcacataatgggtctgttgcycttattggcttccaaatgtgcatggcaaagagagagatgtgggcctagagcagatatattcagcaaggtgacagcttcccataacaat

SEQ ID NO: 8580 - DNA, 385 bp, Homo sapiens
cattgggctttggaactagaaggtactgggtactagcttttaaaatgttttataaccttggccgtatacttaacctcattacacttctatggtatgtgactttaggcagatttcttaactgttctgaatctcagtttcctaatcctaaaaattatgataaatatacatattaaggatgaaataggaattcagacattttatttaaataatatctgtaaatgacttgctgtgtccaacacacaagtttggaacaatgaaggattcatccaccccatttattcagcagttatttatttagttcttctactactactactgacaacaacaacagtaacctctctcctatttctagcacctaaagtaggatttcacacactttactgtc

SEQ ID NO: 8581 - DNA, 202 bp, Homo sapiens
tggatcaaagacctaaatgcaagatctaaaccttgcattagaaaccttcccataagaatatggaggaaggccgggcacagtggctcacacctgtaatgccagcactttgggaggccgaggcgggcggatcacctgaggttaggaattcaagaccagccctgaccaatatggtgaaaccccgtctctactacaaaaaaaaaaw

SEQ ID NO: 8582 - DNA, 134 bp, Homo sapiens
agagagtctcagattgtcttgataatttattctttcgttctctttcttttgcttctctatttttgtttttcagtgttttgcttgttttgttctgttttaggattttattctctctctctctctctctctctctc

SEQ ID NO: 8583 - DNA, 130 bp, Homo sapiens
attgccgggcctgcctggccaccctgcgcagggccttgcgtcctctccgggggcggasgggtcggcgggcctgacagggaacctccctgaccgagcccacgtctccccacggccagagaaatctccggcc

SEQ ID NO: 8584 - DNA, 144 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataw

SEQ ID NO: 8585 - DNA, 361 bp, Homo sapiens
  misc_feature 286,288: n=a, g, c or t
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatawtawtcmatcataaaadggawttavgtggcsgggcacagtggctcatgcctgtaatcccagctacgtgggaggctgaggcaggagaatcacttgaacctgggaggtggarnvngcagtgaactgagattgcgccactccactccagcctgggcaacagagactcggtgtcaaaaaaaaaaaaaaaa

SEQ ID NO: 8586 - DNA, 439 bp, Homo sapiens
  misc_feature 321,376: n=a, g, c or t
gaagtgacctctagagcggtggtgaaactggcagttgacggctcctgggactagatcccgcgagtagcccccgaactatttctctacgttttctcttgatcctcccgaaatcttccagatccgcgtagtgaggaatcgtctccaccgtcatggggggcggagactgaatctgaagaagagctggcacccgcagaccctcaggaatgtggagaaagtgtggaaggccgagcagaagcatgaggctgagcggaagaagattgaggagcttcagcgtgagctkcgagaagagagagcccgggaagagatgcagcgctatgcggnaggatgttggggccgtcaagawaaaagaagawaagttggactggatgtaccaggntcctggtgggatggtraaccgtvacgagtacctgctggggcgccccattgacaaatatgtttt

SEQ ID NO: 8587 - DNA, 166 bp, Homo sapiens
caaacagaattaccagataagccawaaatactgcttctaggtatacgccctaaagaactaaaaacaggtgttcaaataaaaactcgtatacaaatgtttatagcaacatkattkataatagctaaaaagtgggamaaaaacaattgaccatcartggatagatggr

SEQ ID NO: 8588 - DNA, 103 bp, Homo sapiens; identical to SEQ ID NO: 8028

SEQ ID NO: 8589 - DNA, 151 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaa

SEQ ID NO: 8590 - DNA, 96 bp, Homo sapiens; identical to SEQ ID NO: 8079

SEQ ID NO: 8591 - DNA, 362 bp, Homo sapiens
  misc_feature 286: n=a, g, c or t
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattaktcaatcmkraaamdggattwaagtggccggscacagtggctcakgcctgtaatcccagctacgtgggaggctgaggcaggagaatcacttgaacctgggaggtggvnsttgcagtgaactgagattgcgccactccactccagcctgggcaacagagactcggtgtcaaaaaaaaaaaaaaaa

SEQ ID NO: 8592 - DNA, 85 bp, Homo sapiens
acagttaactttaggaccatagccaaaagatasaaacagcataaacgccaaaataaaaagaagccaataaagataaacacaaaaa

SEQ ID NO: 8593 - DNA, 80 bp, Homo sapiens
gaggttgagacaagagaatcacttgaacctgagaggcagaggttgcagtgcagcctgggkgacagagggagactccggcm

SEQ ID NO: 8594 - DNA, 84 bp, Homo sapiens
aataatagctactaaaaagtaacaaggttgagaccagcctgggcaacataaggagaccccttcttcacaaaaaaaaaaaaaaaa

SEQ ID NO: 8595 - DNA, 96 bp, Homo sapiens; identical to SEQ ID NO: 8079

SEQ ID NO: 8596 - DNA, 96 bp, Homo sapiens; identical to SEQ ID NO: 8079

SEQ ID NO: 8597 - DNA, 144 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataatar

SEQ ID NO: 8598 - DNA, 348 bp, Homo sapiens
  misc_feature 208,210..213,215: n=a, g, c or t
caaacagaattaccagataagccaaaaatactgcttctaggtatacgccctaaagaactaaaaacaggtgttcaaataaaaactcgtatacaaatgtttatagcaacattatttataatagctamaaagtgggaaaaaaacaattgaccatcaatggatagatggvtmaatgrtattmytcmatcattaammagrattavgtggccgngnnnngntggctcatgcctgtaatcccagctacgtgggardctgaggcaggagaatcacttgaacctgggaggtggaggttgcagtgaactgagattgcgccactccactccagcctgggcaacagagactcggtgtcaa

SEQ ID NO: 8599 - DNA, 363 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcatwaaaaaagratttaagtgsccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8600 - DNA, 126 bp, Homo sapiens
tttctttttacattgtgcctttatcagtttatggtatcagggtgatactagcttcatagtatgagttaggcaggagcccatcctcctccattttttgaaatagtttcaatagawaaaaaaaaaaaw

SEQ ID NO: 8601 - DNA, 96 bp, Homo sapiens; identical to SEQ ID NO: 8079

SEQ ID NO: 8602 - DNA, 85 bp, Homo sapiens
  misc_feature 85: n=a, g, c or t
acagttaactttaggaccatagccaaaagatagaaacagcataaacgccaaaataaaaagaagccaataaagataaacacaaaan

SEQ ID NO: 8603 - DNA, 132 bp, Homo sapiens
cattggtagcttgatggggatggcattgaatctgtaaattaccttgggcagtatggccattttcacgatattgattcttcctacccgccgcaaaaaaaaamwraaaaaaaaaaaaaaaaaaaaaaaaaaaam

SEQ ID NO: 8604 - DNA, 96 bp, Homo sapiens; identical to SEQ ID NO: 8079

SEQ ID NO: 8605 - DNA, 114 bp, Homo sapiens
tttctttttacattgtgcctttatcagtttatggtatcagggtgatactagcttcatagtatgagttaggcaggagcccatcctcctccattttttgaaatagtttcaatagaw

SEQ ID NO: 8606 - DNA, 84 bp, Homo sapiens; identical to SEQ ID NO: 8594

SEQ ID NO: 8607 - DNA, 96 bp, Homo sapiens
acagttaactttaggaccatagccaaaagatagaaacagcataaacgccamaataaaaagaagccaataaagataaacacaaaaaaaaaaaaaaaa

SEQ ID NO: 8608 - DNA, 85 bp, Homo sapiens
acagttaactttaggaccatagccaaaagatagaaacagcataaacgccaaaataaaaagaagccaataaagataaacacaaaaa

SEQ ID NO: 8609 - DNA, 73 bp, Homo sapiens
aataatagctactaaaaagtaacaaggttgagaccagcctgggcaacataaggagaccccttcttcacaaaaa

SEQ ID NO: 8610 - DNA, 85 bp, Homo sapiens; identical to SEQ ID NO: 8608

SEQ ID NO: 8611 - DNA, 103 bp, Homo sapiens; identical to SEQ ID NO: 8028

SEQ ID NO: 8612 - DNA, 85 bp, Homo sapiens; identical to SEQ ID NO: 8608

SEQ ID NO: 8613 - DNA, 89 bp, Homo sapiens
gaggttgagacaagagaatcacttgaacctgagaggcagaggttgcagtgcagcctgggtgacagagggagactccggccccctcccaw

SEQ ID NO: 8614 - DNA, 361 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8615 - DNA, 96 bp, Homo sapiens; identical to SEQ ID NO: 8079

SEQ ID NO: 8616 - DNA, 361 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccarmtacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8617 - DNA, 164 bp, Homo sapiens; identical to SEQ ID NO: 8086

SEQ ID NO: 8618 - DNA, 96 bp, Homo sapiens; identical to SEQ ID NO: 8079

SEQ ID NO: 8619 - DNA, 96 bp, Homo sapiens; identical to SEQ ID NO: 8079

SEQ ID NO: 8620 - DNA, 345 bp, Homo sapiens
caaacagaattaccagataagccaaaaatactgcttctaggtatacgccctaaagaactawaaacaggtgttcaaataaaaactcgtatacaaatgtttatagcaacattatttataatagctaaaaagtgggaaaaaaacaattgaccatcaatggatagatggataaatgatattattcaatcataaaaaagawttaagtggccgggcacagtggctcatgcctgtaatcccagctacgtgggaggctgakkyaggagaatcacttgaacctgggaggtggaggttgcagtgaactgagattgcgccactccactccagcctgggcaacagagactcggtgtc

SEQ ID NO: 8621 - DNA, 361 bp, Homo sapiens
  misc_feature 199: n=a, g, c or t
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcatadaaaagaatmnagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8622 - DNA, 58 bp, Homo sapiens; identical to SEQ ID NO: 8023

SEQ ID NO: 8623 - DNA, 159 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaaaaaaaaaaaa

SEQ ID NO: 8624 - DNA, 96 bp, Homo sapiens; identical to SEQ ID NO: 8079

SEQ ID NO: 8625 - DNA, 97 bp, Homo sapiens
cagatcggakcraccgcctgcacaaacatcgtcaccaccakcacaggcgttcccgggacttactaaaagctaaacakaccgaaaaaaaaaaaaaaaa

SEQ ID NO: 8626 - DNA, 103 bp, Homo sapiens; identical to SEQ ID NO: 8028

SEQ ID NO: 8627 - DNA, 506 bp, Homo sapiens
  misc_feature 502: n=a, g, c or t
caaactccctgactctttgaagtttttactcaccccatttcaattatcctgatcccttctcatcccctgcttggcttctctgcatgtggtcatctgstgtggcttggtgtttaatggrttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgmcttctctgccaaacgactgggaaaccanaatg

SEQ ID NO: 8628 - DNA, 58 bp, Homo sapiens; identical to SEQ ID NO: 8023

SEQ ID NO: 8629 - DNA, 96 bp, Homo sapiens; identical to SEQ ID NO: 8079

SEQ ID NO: 8630 - DNA, 164 bp, Homo sapiens; identical to SEQ ID NO: 8086

SEQ ID NO: 8631 - DNA, 96 bp, Homo sapiens; identical to SEQ ID NO: 8079

SEQ ID NO: 8632 - DNA, 139 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaaaaaaaaaaaa

SEQ ID NO: 8633 - DNA, 103 bp, Homo sapiens; identical to SEQ ID NO: 8028

SEQ ID NO: 8634 - DNA, 96 bp, Homo sapiens; identical to SEQ ID NO: 8079

SEQ ID NO: 8635 - DNA, 103 bp, Homo sapiens; identical to SEQ ID NO: 8028

SEQ ID NO: 8636 - DNA, 164 bp, Homo sapiens; identical to SEQ ID NO: 8086

SEQ ID NO: 8637 - DNA, 103 bp, Homo sapiens; identical to SEQ ID NO: 8028

SEQ ID NO: 8638 - DNA, 361 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgthatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8639 - DNA, 75 bp, Homo sapiens
aataatagctactaaaaagtaacaaggttgasaccagcctgggcaacataaggagaccccttcttcacaaaaaam

SEQ ID NO: 8640 - DNA, 91 bp, Homo sapiens
acagtyaactytaggaccatagccaaaagatagaaacagcataaacgccaaaataaaaagaagccaataaagataaacacaaaaaaaaaaa

SEQ ID NO: 8641 - DNA, 58 bp, Homo sapiens
gakgyygagacaagagaatcacttgaacctgagaggcagaggttgcagtgcagcctgg

SEQ ID NO: 8642 - DNA, 96 bp, Homo sapiens; identical to SEQ ID NO: 8079

SEQ ID NO: 8643 - DNA, 361 bp, Homo sapiens
  misc_feature 233..234,237: n=a, g, c or t
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcnndcnaacgtgggaggctgagdcaggagaatcacttgaacctgggaggtggaggttgcagtgaactgagattgcgccactccactccagcctgggcaacagagactcggtgtcaaaaaaaaaaaaaaaa

SEQ ID NO: 8644 - DNA, 148 bp, Homo sapiens
tttctttttacattgtgcctttatcagtttatggtatcagggtgatactagcttcatagtatgagttaggcaggagcccatcctcctccattttttgaaatagtttcaatagwwaaaaaaaaaaaaaaaaaaaaaaaaaaaaaaaaaa

SEQ ID NO: 8645 - DNA, 58 bp, Homo sapiens; identical to SEQ ID NO: 8023

SEQ ID NO: 8646 - DNA, 58 bp, Homo sapiens; identical to SEQ ID NO: 8023

SEQ ID NO: 8647 - DNA, 361 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtvkgaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8648 - DNA, 96 bp, Homo sapiens; identical to SEQ ID NO: 8079

SEQ ID NO: 8649 - DNA, 103 bp, Homo sapiens; identical to SEQ ID NO: 8028

SEQ ID NO: 8650 - DNA, 85 bp, Homo sapiens; identical to SEQ ID NO: 8608

SEQ ID NO: 8651 - DNA, 166 bp, Homo sapiens
tttctttttacattgtgcctttatcagtttatggtatcagggtgatactagcttcatagtatgagttaggcaggagcccatcctcctccattttttgaaatagtttcaatagaaaaaaaaaaaaaaaaaaaaaaaaaaaaaaaaaaaaaaaaaaaaaaaaaaaaaw

SEQ ID NO: 8652 - DNA, 77 bp, Homo sapiens
ccataaaadgctaaatktakasttcacttataaagtraacakktakatctaatcaktctagtaagtccaaaaaaaaa

SEQ ID NO: 8653 - DNA, 51 bp, Homo sapiens
tttctttttacattstscctttatcaktttatggtatcaggstgatactag

SEQ ID NO: 8654 - DNA, 363 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagrattaagtggsccgggvmamagtggcycakgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8655 - DNA, 159 bp, Homo sapiens
tttctttttacattgtgcctttatcagtttatggtatcakggtgatactagcttcatagtatgagttaggcaggagcccatcctcctccattttttgaaatagtttcaatagaaaaaaaaaaaaaaaaaaaaaaaaaaaaaaaaaaaaaaaaaaaaaaa

SEQ ID NO: 8656 - DNA, 150 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaaaaaaaaaaaaaaaaaaaaaaa

SEQ ID NO: 8657 - DNA, 359 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagrattaagtggscsggcacagtgctcatgctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8658 - DNA, 167 bp, Homo sapiens
aagatggattttggagayagttgcctgggctggtcttgaactcctgggctcaagtgatccacccacctcagtctcccaaagcgctggaattataggcatgagccactgcgcccggcctaatttgactatttttgcgtgatgagtatgcagtggaatgtggcaaattt

SEQ ID NO: 8659 - DNA, 103 bp, Homo sapiens; identical to SEQ ID NO: 8028

SEQ ID NO: 8660 - DNA, 96 bp, Homo sapiens
acakttaactttagraccatagccaaaagatagaaacagcataaacgccaaaataaaaagaagccaataaagataaacacaaaaaaaaaaaaaaaa

SEQ ID NO: 8661 - DNA, 103 bp, Homo sapiens
gaggttgagacaagasaatcacttgaacctgagargcagasgttgcagtgcagcctgggtgacagagggagactccggccccctcccaaaaaaaaaaaaaaaa

SEQ ID NO: 8662 - DNA, 96 bp, Homo sapiens; identical to SEQ ID NO: 8079

SEQ ID NO: 8663 - DNA, 84 bp, Homo sapiens
  misc_feature 32: n=a, g, c or t
aataatagctactaaaaagtaacaaggttganaccagcctgggcaacataaggagaccccttcttcacaaaaaaaaaaaaaaaa

SEQ ID NO: 8664 - DNA, 96 bp, Homo sapiens
acasttaactttaggaccatagccaaaagatagaaacagcataaacgccaaaataaaaagaagccaataaagataaacacaaaaaaaaaaaaaaaa

SEQ ID NO: 8665 - DNA, 152 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaa

SEQ ID NO: 8666 - DNA, 84 bp, Homo sapiens
aataatagctactaaaaagtaacaaggttgabaccagcctgggcaacataaggagaccccttcttcacaaaaaaaaaaaaaaaa

SEQ ID NO: 8667 - DNA, 468 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagagaggggaccgtccccgagcctcgccgagcctgcgttgtagacacctctggkbtagtggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaaggagcaaggaggaacagcgggattacgtcttctacctggccgtggggaa

SEQ ID NO: 8668 - DNA, 58 bp, Homo sapiens; identical to SEQ ID NO: 8023

SEQ ID NO: 8669 - DNA, 96 bp, Homo sapiens; identical to SEQ ID NO: 8079

SEQ ID NO: 8670 - DNA, 87 bp, Homo sapiens
acagttaactttaggaccatagccaaaagatagaaacagcataaacgccaaaataaaaagaagccaataaagataaacacaaaaaam

SEQ ID NO: 8671 - DNA, 116 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaa

SEQ ID NO: 8672 - DNA, 97 bp, Homo sapiens
cagatcggagcgaccgcctgcacaaacatcgtcaccaccagcacaggcgttcccgggacttactaaaagctaaacagaccgaaaaaaaaaaaaaaaa

SEQ ID NO: 8673 - DNA, 82 bp, Homo sapiens
cagatcggagcgaccgcctgcacaaacatcgtcaccaccagcacaggcgttcccgggacttactaraagctaaacagaccgr

SEQ ID NO: 8674 - DNA, 96 bp, Homo sapiens
acavttaactttaggaccatagccaaaagatagaaacagcataaacgccaaaataaaaagaagccaataaagataaacacaaaaaaaaaaaaaaaa

SEQ ID NO: 8675 - DNA, 222 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcak

SEQ ID NO: 8676 - DNA, 85 bp, Homo sapiens; identical to SEQ ID NO: 8608

SEQ ID NO: 8677 - DNA, 164 bp, Homo sapiens; identical to SEQ ID NO: 8086

SEQ ID NO: 8678 - DNA, 449 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgsgtgggtgcctggagatgaagctggaaagagctgctgcccaaagggagcaaggaggaacagcgggattac

SEQ ID NO: 8679 - DNA, 56 bp, Homo sapiens
  misc_feature 45: n=a, g, c or t
ctttttcgcaacggrtttgccgccagvacacaggtgtcgtgaaanctacccctaam

SEQ ID NO: 8680 - DNA, 73 bp, Homo sapiens
aataatagctactaaaaagtaacaaggttgagaccagcctgggcaacataaggagaccccttcttcacaaaam

SEQ ID NO: 8681 - DNA, 73 bp, Homo sapiens; identical to SEQ ID NO: 8609

SEQ ID NO: 8682 - DNA, 186 bp, Homo sapiens
tgattatgtgtcktggggttgctctkcttgaggggtatcttagtggtgttccctgtactttctgaatttgaacttgggcctgtcttgctaggttggggaagttcttctggatgatatcctaaagtgtgttktccaatttggtccattctccctgtcactttcaggtatgccagtcattcatgggtt

SEQ ID NO: 8683 - DNA, 96 bp, Homo sapiens; identical to SEQ ID NO: 8079

SEQ ID NO: 8684 - DNA, 164 bp, Homo sapiens; identical to SEQ ID NO: 8086

SEQ ID NO: 8685 - DNA, 103 bp, Homo sapiens; identical to SEQ ID NO: 8028

SEQ ID NO: 8686 - DNA, 96 bp, Homo sapiens; identical to SEQ ID NO: 8079

SEQ ID NO: 8687 - DNA, 83 bp, Homo sapiens
aataatagctactaaaaagtaacaaggttgagaccagctgggcaacataaggagaccccttcttcacaaaaaaaaaaaaaaaa

SEQ ID NO: 8688 - DNA, 96 bp, Homo sapiens; identical to SEQ ID NO: 8079

SEQ ID NO: 8689 - DNA, 366 bp, Homo sapiens
atctgcggagggttaggaggggaaaggttttttctacccgccggctcggsaccaggctgaaactcatgtttgaatttagtgagccgtttgttcgttagtccggaacactagcgcggtaggccaagctgcgaggaggcggcgaaatcagcgaatagcaaattataaaagaaacaaggctttatctcctaggccctctaaagcatccccaggagatccgtatccccgttttggagagaacgctgaagctcagaaaaactcagtggaaagcggcagacccaagcctcctcgccaagtctgagtgaccgtgaagccctggtttttccttctttttctttctttttgtacttttttttttttttttgggaa

SEQ ID NO: 8690 - DNA, 116 bp, Homo sapiens
acccggaagcctagtcgcccggagttctgagcgttctgttcggacctcctaccgttactctttcattcactcaagaaatgatttcttgagttcssggsctttgtcagagagatgaa

SEQ ID NO: 8691 - DNA, 79 bp, Homo sapiens
cattggtagcttgatggggatgrcmytgartctgtaaattaccttgggcagtatggccatgtttcacgatattgattct

SEQ ID NO: 8692 - DNA, 82 bp, Homo sapiens
aataatagctactaaaaagtaacaaggttgagaccagcctgggcaacataaggagaccccttcttcacaaaaaaaaaaaaam

SEQ ID NO: 8693 - DNA, 84 bp, Homo sapiens; identical to SEQ ID NO: 8594

SEQ ID NO: 8694 - DNA, 90 bp, Homo sapiens
gwggttgagacargagaatcacttgaacctgagaggcagaggttgcagtgcagcctgggtgacakagggagactccggccccctcccaar

SEQ ID NO: 8695 - DNA, 96 bp, Homo sapiens; identical to SEQ ID NO: 8079

SEQ ID NO: 8696 - DNA, 513 bp, Homo sapiens
caaagactcatgagaataaatttaggaaaaacataattgaggtgtagtcaaacttagtccttgtcgattttattgttactacttactatcttttaggagaagtgggtaaattctcagtatggcaggttatgtcctgttggtatggttttctgaatgacacatgtcagagccataagaagaggtgttagtcaacacatatttattgatctcttaccatgttctgggccttggatatagagtgtgcttttccattttctgacaaaggccacatggcacatgatatgaaatgtaagrargagwttggmcataggagaggmcataaatgtcatcagatctaggaaaggaaaagatgagcgttgatcacatagcctgtgtcagggttgcagggaacttctagactaggatttatagaacccatggggcagacacaaaagtagtagtggcagacagaatcatttattctgtatctttattgagtgccagctatgtgctctgtactgttgtatgcactgr

SEQ ID NO: 8697 - DNA, 500 bp, Homo sapiens
catggaatcggattgacagcaaaatcccagaggaaactggaacccaagataacagaggtaagctcaggttttcccagggaaaccttggaatggctccaaacttggagtcaacaaacaccaatcagtagtagtgggcagttgggtaatacttaagaattttcttaagacttcttttccacagtgctaggtcagttgggcttccctcctaccctttctccagcctaaacaactatgatgcccactcttaggcctgaagtttcagaatcawtcycytwaagaaadtwggtcagccagtttagtatgggcatctacttaggtgttagaacctgagagagaagtggaggcactgtgctaccccaggagaaaaacagttttgtctgttcccagccaacttgacttcctatccaggtacctttttggggtactgcgtatacgcgtgccctacctgcttaaattgtactgttcttccatttaaaggagaagccacttaggaaaacaaa

SEQ ID NO: 8698 - DNA, 455 bp, Homo sapiens
aaactgctctgcactggccccacattagggggttcctatctacggtttctaaatgtgagccccttgacacctgctgtggcagacacaaccatccccatggaggcgctgagaacaatgaagcacagacaggccagggtcacccaaagccgtgatgacagcccgcttttctctggtggttctactcaaccgctccactgaggtgatgggagaggtgaggggcccaggaggaaggtggagctcaaaggcactgtcttcatagtccacaggtctcmaaattccrgvwttycmagattgaaaggwttcacaagtgctcacaagaggcttggctgccaggggaagctccgacctgaagatttgaactaatgagggactataaaggccaagaccttgttcttgccattttagagattcagaatataatctacaaagttagagacaaaaaaaaaaaaaaaaav

SEQ ID NO: 8699 - DNA, 238 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgt

SEQ ID NO: 8700 - DNA, 565 bp, Homo sapiens
cagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagsccaattccaaaattycgctaaargctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcaca

SEQ ID NO: 8701 - DNA, 530 bp, Homo sapiens
ttaattcttagtaggtaaaacactgatgcactctgcttaccatgtaagcctcttaacgtaagatgtacagttttacatcacataacctggttgttcctgtcttgaagagtaagccacaccagaatattcagaaagaccaagatgaaaaactacaggctgtgagaaagggaccttaagatgcaatacggaacttgcttctggctattaccttcaattaacacaagaaaatggcccagtacataactagcggcacatatctttggtgtaaamcaccatwcacccmaggsttycrgctttaaaaatagggacatttgcagaagttcaagaccagcctggtcaacatggtgaaacctcatctctgctgaatatacaaaaattggctgggcgtggtggcaggcgcctgtagtcccagctgctcgggaggcggaggcggaagaatcgcttgaacctgggaggcggargttgcagtgagccgagatcgcgccattgcactccagcctggacaacaagggtgaaactgtctcaaaaaa

SEQ ID NO: 8702 - DNA, 451 bp, Homo sapiens
  misc_feature 212: n=a, g, c or t
gctgcgctgtgctttgtgascgtcaatgtgatctggatatagtatagtttgaggtcaggcatcatgctacctgacctcaaactatactataatgctactgtaaccaaaacagcatggtactggtaccaaaaaagatatatagaccaatggaatagaacaggggcctcagaaataacaccacacatctagaactacctgatctttgacaaacnkgacaaaaaccagcaatggggaaaggattccctatttaataaatggtgttkggraaaactgggdtagscawwtgssrgaaacctgaaacttgacccctcccttacagcttatacaaaaattaactcaagatagattaaagatttaaacaaagacctaaaaccataaaaaccctagaagaaaacctaggcattaccattcaggacataggcatgggcaaagacttcatgacttaaaacac

SEQ ID NO: 8703 - DNA, 271 bp, Homo sapiens
ctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatc

SEQ ID NO: 8704 - DNA, 447 bp, Homo sapiens
agcgccccttggaagccaagaatatgaggaagtcttcttccttcgcgccttcttcttccttacgctccagggcagcctgacagagccgctcgaaggctctgctggccgcggctagccggtttacccattccactggacccagccaccacccactcctgctgtctgggtgcagcagaagtctcaggtagctgagaagttcatggaatctbcdkatttgctacacctttcactactgcttgtgatatagtgcagggttgggatgtgcagacatttctcaagtgcactgtgtacctacacagcatgctgcaatttggctactgaagtcaagagaaactggtttgaacaactactgagtgtaacataggaagcgcatttcatttgataacaggaacacagcttttgtgctaataaaatgctttgaaaattaacaaaaaaaaaaaaaaaaar

SEQ ID NO: 8705 - DNA, 141 bp, Homo sapiens
ttcaatagtgtgctgtcaaagtgtgcttagctcacctggatatacctacattgttaaatgtctaaacagtaatcattaaaacatttttgattaaaaaaaaaaaaaaaaaaaaaaaaaaaaaaaaaaaaaaaaaaaaaaaaa

SEQ ID NO: 8706 - DNA, 500 bp, Homo sapiens
catatgtacagtttatttcaagtctaataaaatccaaacacagtatttgcaaatgctgcggctgtcaccacacatgatactaagattatggaggaagacgaaagggcaccaagagaaactgatatgtctgtcagtgacctgcgtgtgaggtcttatttgtgtcctcttatttaaagcaaacacacccattttcgctcgtcccaagaccccgtgatcagagttgtagaaactcactggaccaagcgtttgcattcgtaatcaaaacagtatttagcccacctggtggttaagatttctccctgagttaaaatctctaaacaaactatatcatgtgttagttacatccaggacccgtatgacacaggctagcatgtcacggtgccttcactacctttgcacgtaggcatcttcacattacatgttgtcccatggaatccatggtttgaaaagtgtcctatttgaaatgtaaccaattcaattcaaagggctgacagtgcctt

SEQ ID NO: 8707 - DNA, 485 bp, Homo sapiens
tcattctacaagataactgagaagtactcttcaagtatgtcaatatcatgaaagacaaaaatttaggaattactcagattaaagatgccacaaataagtgcgttcagtgttcgtggcttttcttttcctgtgaaggacattattgggacaattggtaaaatctcaataaggcctgtatattaaatggtagtattgttttggtgttaagttttaagtttcctgattttgaaaattsyatyttcgattttaagaaaatattctttttaggaaacacactgaaatatatagagtaataaagtatcatgtctgaaacttcctctcagatggttcagaaaacatatgcaggtagacaggaaaacagagaggaaaaaatggttatagcaaatgtgattctttgaaaaagaacaggataaagtaattgtggtaaaatgttaccacatgtgggatttaggtgaagactctatggggattctttgtgctagtct

SEQ ID NO: 8708 - DNA, 483 bp, Homo sapiens
  misc_feature 275: n=a, g, c or t
tgtcaaagtggccaggattggcggagcccatgctaatggctctgccagcccttctccccaccagagagggcagggggattcaggccctctagaggtagcattgtgaccgtgtctgcagtagtcaatccttgtgtgccacagtccctgackktgttgataagggcatcagcctacatccctctggtactcagtgataagcatctaaaatcttcttaaagaaaaaatttaaaaagckktcaaaatatacgacttaacatatgaggctgsataaakanctttttagcagtkgtccaactggkgcttckggttctgcctccccagaaagtggatgaccgggccaccctccaccactgccctgtaagaccatgggacacacaggccaccagttcttttcatgtggtcatcccctgttagatgggagaaaatacacctgcctcatttttgtaccttctgtgtgaacattccacggcagagcttcactaa

SEQ ID NO: 8709 - DNA, 433 bp, Homo sapiens
  misc_feature 289: n=a, g, c or t
accttggcgcgcggagtggcaccttggcgctgttggtggcggcggagacagctgtgaagtgtgaggttctttgtctgctggcagctaggggcgacgaggcgggacgtcatggaagtgaaggatgccaattctgcgcttctcagtaactacgagacgttaaaatacatatcaaaaacaccatgcaggcaccagagtcctgaaattgtcagagaatttctcacagcattgaaaagccacaagttgaccaaagctgagaagctccagctgctgaamcamcsgscttktaatnsctgtggaratccasctgatggtggaagagaktgaagagcggctcacggaggagcagattgaagctcttctccacaccgtcaccagcattctgcctgcagagccagaggctgagcagaagaagaatacaaacagcaatgtggca

SEQ ID NO: 8710 - DNA, 260 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgc

SEQ ID NO: 8711 - DNA, 251 bp, Homo sapiens
aaatacaataactgaaaaaaagaacctcactgaatgatctcagtaatagaatggagatgacagggaaacagccagtgaacttcaggatagacaaaaagaaattatacaatcagaacaacagagagaaaaataaactgaagaaaaaaaaacagtgtcagggatatgttcaaagctgaaaagtctagtatttgtgttacctaaattacacaacgagaagagaaagcatgtagtgcaaaaaaaaaaaaaaaaar

SEQ ID NO: 8712 - DNA, 115 bp, Homo sapiens
cattcargaaaaacagrtatacacagacatgggccgraagctycaatgtgttttyctactgcaggaaggttaaagtggaacttcatgtcatagatttaaaaaaaaaaaaaaaaaa

SEQ ID NO: 8713 - DNA, 447 bp, Homo sapiens
cacccaaacaaatattttaatacatagcaggtattatcaaacccactttacagataaggaaactgagggccactaaagtcaaatgatttttaagagtttacatatttactttgaggcagattgcagaatttgaacccatactctgagtggttaaatctgaagctcttcactcttcttgcctctttcacttttctttcacaaattacaacaaattctgaatggtggggagcagggaagagattcagatgaatgatgatgtcttgtaagtttttgggagaatctatccatactaaataaccatctttggcaatgagaataatttaccatacatgtgtataaattgctgtaagaagcctgatgttcttagggaaaatgcttcctaggcatctttcccatcccagcacaattcttaaaaaactttcacaaatatgtcagaggcaaataatt

SEQ ID NO: 8714 - DNA, 431 bp, Homo sapiens
gaaatcataacagtctctcagaccacagtgcaaacaaattagaactcaggattaagaaactcgctcrraaccacacaactacatggaaaccgarcaacttgctcctgaatgactactgggtaaataatgaaattaaggcagaagtaaataagtwctttgaaaccaatgagaacaaagacacaatgtatcagaatctctgggacacagctaaagcagtgtttagaaggmaatttatagcactaaatgcccacaggagaaagcaggraagatctaaatcgrsacctkaacakcacaattaaaagaactagagaagcaagacgaracaagttcaaaagctagcagaagacaagaaataactaagatcagagcagaactgaaggagatacagacacggaaaacccctcaaaaaatcagtgaacccaggagctggt

SEQ ID NO: 8715 - DNA, 454 bp, Homo sapiens
aaggaaggagtgcaggacacaaacagcacgcgaggtgaagaagcgggtgctcgtacagcaagtgccaacatgcattaggcagccggagggcacacaggaccactgtggggaggaatttcacctcgatttttaaaaagggtcaacgtcatgaaagacaaaggaagactgaggaactgtcacaaactggaggagactaaggagacatcgcaaatgatgcagtgtgggatcctggaacagaaaaggggtgtaatgggacactggagaatgtgatwaaggtttccagttctactgcaaatcaccactgtgcccaggctgagctcagtcagagagaaggggaatgaagccaagagcccacaggatgattatttgccattcatgtggcatgctcccagataggcactcttggattatactcaacctcctcaccaacctcataaagtattccagacagagc

SEQ ID NO: 8716 - DNA, 222 bp, Homo sapiens
agcccctctamctccggaagagacgagtgcggtaacaccgttcacagakctagccggacgtcctccgactcaagatatttgtcaaatattttcagaagatggctgatccttggcaggaatgcatggattatgcagtaactctagcaagacaagctggagagtktgtgaagctataaaaratgaaatgaatgtkatgctgaaaagttctccagttgatttggt

SEQ ID NO: 8717 - DNA, 309 bp, Homo sapiens
agctccgggtgccggtkgaggttgckggtggacctgctctggtggtcttggatgadgccccatgagcgcggcgcccctggtgggctacagcagcagcgrctccgaggatgagtccgaggacgggatgcggaccaggccgggggatgggagcbaccgtcgtggccagagcccccttcccaggcagagatttccagtacctgacagtgtgctgaacatgttcccgggcaccgaggaggggcctgaagabgacagcacaaaacacgggggacgggtgcgcaccttcccccacgagcgaggcaactgggccac

SEQ ID NO: 8718 - DNA, 384 bp, Homo sapiens
attattgttctttttttgcgatgggtctctgttacctaagctggtctgagctcctgagctcaagcgatcctcctgcctcggccacccaaagtgttgggattacaggagtgagccaccacgtctggcctctcgtcgtttttattttttaatttttgagtgggggctcgctccgtcgcccaggctgtgatgcagccgcgcgatcacgacctactgcatcctggacctcctgggctcaagcgaatctccggcttcagctcccaagtagctggaactacactcccgcgccaccacgtcccgctaaattaaaaaaaaaattgttgtagagatgggggtctcgttgtgttgccctgacaggtctcgaactcttgggctcaagcgatcctc

SEQ ID NO: 8719 - DNA, 375 bp, Homo sapiens
  misc_feature 307,314,318: n=a, g, c or t
aaatgaccgcggcctccaggagtctcatggaagggacggtacccgcttctgccacctcctggaccttcctgacaaggactattgcttccctaatgtcctgaggaacgactatctcaaccgccacctgggcatggtggcccaagatcctcagggctgcctgcagctctgcctgagcgaggtggccaacgggctgaggaaccccgtctccatggtccatgctggggacggcacccatcgcttctttgttgccgagcaggtaggagtggtgtgggtctacctccctgatgggagtcgcctggagcaamcnttcctgnwvvntcaagaacatcgtgttgaccaccccatggatcggggatgagagaggcttcttggggt

SEQ ID NO: 8720 - DNA, 315 bp, Homo sapiens
ttttgaaagactagaagctcaactgaaggcatgtcattgcaggatcatattttctaaagcaaagccttctgtgttgggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaatttcagaagttgaaatggattgtttctgggcgtactgcacggcaattgaagcatagctactacaga

SEQ ID NO: 8721 - DNA, 236 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagagaggggaccg

SEQ ID NO: 8722 - DNA, 329 bp, Homo sapiens
tataaaaacatttaattttttataaaatcctattcctacaggataaaagggaaattgaagcatcgctgactcttgggatttgaccatgaggggaatacagatttttcaggttggtaaatgagaattgtgtcaaatgctgtcagccatgtcttctgtttacagcatgcctctgtggtcctgccacaggttcagtagttcatttttggccactggctggtcatcatttcccatttgtctagcacagatgtggatgatgtaggatggatgaagtgactcagcctgattgttgacagtaataagarataacagaaaacaataagtaataagam

SEQ ID NO: 8723 - DNA, 159 bp, Homo sapiens
  misc_feature 94: n=a, g, c or t
caaaaaattagccgggcgcggtggcgggtgcctgtagtcccagctactcgggaggctgaggcaggagaatggcgtgaacctgggaggcggastngcagtgagccaagattgtgccactgcaatccggcctgggctaaagagcgggactccgtcccaaaa

SEQ ID NO: 8724 - DNA, 342 bp, Homo sapiens
  misc_feature 284: n=a, g, c or t
aagaaaaggactctctggaacatggcaacattaatctgaccacaagctgactggcaggtgctttaaccacaagctctgactccaggccctgtcccctgagctctgccctcggatgtccgaccgcccagagcctgcatgcgccgtggggcgcccaggaccaggagctggtgggtccggggccccctgggcgggggtcccggggmrcccctcctcccttgggacccgttgtcccggtcctggtctttcccccggatctagtattcagggcggaccagcggasgganccccgacagctgctgaccctctataaccccacaggaactgcgcttcgcttccgagtcc

SEQ ID NO: 8725 - DNA, 192 bp, Homo sapiens
agtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatg

SEQ ID NO: 8726 - DNA, 199 bp, Homo sapiens
aaaaagaaagtgctggaggaaatgaaagaacaaagcgggctgtctgtgtgcccacgccggggccggtcactamcttttctgsctgacaagtgtacataaaacaattcccgaacagcacggagcatcagacacaactagaggggctggtctcaccctccgccagccacgggsccaggcggtgccagggtactgtgccatg

SEQ ID NO: 8727 - DNA, 390 bp, Homo sapiens
actgtaatgaaactacattgtatttctaagtgtgaaaacgacaggctgccccgtttttactaattgcatttgcattttwaaggtactactgaaggtcagatcaaagttgaaatgcaaaaatactaattagagaataatgtgaataaaatgggaatcttcttggtattttatgtgtattgtaagtagcagttaaattatttttttaaaagcaatttcagttttaatcactgaacaaaagaaacaggcaacattcacttctgtagtatggtttccacctatctctaacaccactattaaggtacaccagtgttaaggtacattaataactacacaaaattttatttaaagagaacacttagcagcctatgatagttttcaataaaatgttgc

SEQ ID NO: 8728 - DNA, 322 bp, Homo sapiens
gcggctgttgctgcggascaggaggggaagcgatggctgggcccgcgtggatctccaaggtctctcggctgctggggggcatttccacaacccaraacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaa

SEQ ID NO: 8729 - DNA, 73 bp, Homo sapiens; identical to SEQ ID NO: 7980

SEQ ID NO: 8730 - DNA, 280 bp, Homo sapiens
atgggcccccttcgtctcagctgtgcgggaacggccgagggtaacatcccgggctcgcgggaggctgtcggggtaatggscacacgctgacagaaccagccgagtggaaaaggggagcgaascgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggt

SEQ ID NO: 8731 - DNA, 178 bp, Homo sapiens
ggagtgcaaaaaattggctgggtgtrgtggcgggcgtgtgtcgtcccagctgcttgtgaggctgaagcgggaaaatggcatgaaacctggraggtgsagcatgcagccagccaagatcgggccgctgcactccagcctgggggacagagcgagactctgcctcaaaaaaaaaaaaaaa

SEQ ID NO: 8732 - DNA, 465 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagagaggggaccgtccccgagcctcgccgagcctgcggtgtagacacctctggkkctaagttggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaaggagcaaggaggaacagcgggattacgtcttctacctggccgt

SEQ ID NO: 8733 - DNA, 172 bp, Homo sapiens
  misc_feature 160: n=a, g, c or t
caaaaaattagccgggcgcggtggcgggtgcctgtagtcccagctactcgggaggctgaggcaggagaatggcgtgaacctkggraggcggacttgmagtgagccaagattgtgccactgcaatccggcctgggctaaagagcgggactccgtcccaaanaaaaaaaaaaaa

SEQ ID NO: 8734 - DNA, 384 bp, Homo sapiens
  misc_feature 61: n=a, g, c or t
gacttgtccacagggcagcaagaagatgcgccccttggtgtgtcccgagtgtctcctgtangcagctgagctttcgcagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatc

SEQ ID NO: 8735 - DNA, 78 bp, Homo sapiens
taataacagtgtgaccttaaacaagtcgcttaactactctaagtttcagtttctttcacggtctaaatggagattmav

SEQ ID NO: 8736 - DNA, 52 bp, Homo sapiens
ttaagacattcatcctcccggaggcccgcgccgccctcgccttgcagcacah

SEQ ID NO: 8737 - DNA, 72 bp, Homo sapiens; identical to SEQ ID NO: 7981

SEQ ID NO: 8738 - DNA, 294 bp, Homo sapiens
cctgcgcgcggcaacatggcggggtccaggtggaggtcttgaggctatcagatcggtatggcattggcgtccgggcccgcaaagcggggsctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggac

SEQ ID NO: 8739 - DNA, 398 bp, Homo sapiens
  misc_feature 226: n=a, g, c or t
aaaaagtcagcttaacagcattaaaagcaatttcaaaaaaaggaaacgaataccatatgatccagtaattccagkcctatggtataatctccaaaagawttgaaaacaggcccctggacagttatttgtacatcagtgttcatagtagtagcattgttcacagtagccaaaggtggacccaagatcccatcaacaaatgaatggatagataaaatgtggttcatmnatacaacaaaatactattcagccataagaaagaaagaaattctgatttatggtacaacatggatggatcttgaggacattatgctaagtgaagccagacacagaaggacaaatactggatgattccacttacatgagtacctagattaggcaacttaatattctacagaaat

SEQ ID NO: 8740 - DNA, 337 bp, Homo sapiens
  misc_feature 251: n=a, g, c or t
cctgatgaaatattcaaacacataaagggatggccctggaggtctatcctgcatacctggagagcttctctggtcctggccsacytggaaagttgcagactttgttgtaacatctatgtgatgagcttccctgtgaagccccatttgacagttgggccagcagtgttttatcagcactctgatggcccacatttcccaggaaaacttcttgaaacttaccgttgtgggcagtggtcagagcgtgtagttcntatgactgtcttgkttcatctgtggagcacgtgtggagcacgttggtrcagmagtttctgtggggtttggcatgggtgattttggk

SEQ ID NO: 8741 - DNA, 239 bp, Homo sapiens
ctttaccgctttctcattccgactgccactctttgttctttcvtctccgcgtccccccgaccctgtgtgtcgtggktcgtkgcsggtccmagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaattw

SEQ ID NO: 8742 - DNA, 455 bp, Homo sapiens
  misc_feature 225: n=a, g, c or t
actagtcgcccggaggttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggagggnaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaagggagcaaggaggaacagcgggattacgtcttctacctggc

SEQ ID NO: 8743 - DNA, 377 bp, Homo sapiens
atcagaaagagacttagaactagacaatcctgattgaaaatgacactttaggactgatttgaccatggtgatargtgagctaaaaagcaacttataaaaaaaaatgccagaagcctttttttattaggataataagagcacactaatatttttwttgtattgagttcaaaggatgcatgaatattctgttgttcatgagtgacttctagactatttaaaattattcatgaccattgataataaaaatagtaccacggccaacctctcccctcagcaaacaacatgaggtttgtaaccctttgtttaaattttggcagtgtactaatgttgttaagatgacaatctatttcttctcaaagctgtattaaagtggcaca

SEQ ID NO: 8744 - DNA, 287 bp, Homo sapiens
  misc_feature 92: n=a, g, c or t
taccttgycgggcgcggtggstcacacctgtaatcccagcactttgtkaggctgaskcgggcagatcackaggtcaggagatcgagactatnctggccawcacggtgaakccccctmtytactwmaratataaaaaattagccgtgcatggttgcgggcgcctgtggtcccagctactcaggaggctgaggcgggagaatgatgtgaacccgggaggcggaccttgccgtgagccaggatcacgtcacgacactccagcctgggtgacagagcaagactctgtctcm

SEQ ID NO: 8745 - DNA, 284 bp, Homo sapiens
  misc_feature 192: n=a, g, c or t
ttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactthrcccttgtganccctcccttcccccctccmcccccaaaaaaaaacaacaaaacacaaaaaataaacatttgttccagggcaacctggaaaaaaaaaaaaaaaa

SEQ ID NO: 8746 - DNA, 319 bp, Homo sapiens
attcctgtgtgaagagtgccagtgtgaagacagttttgtaagaactgcaagtgctcaggctgtatgggaaacagaaacttcagcagatgawctgaccttatgccatttcctgatgtttggcagtgacactgaaagaggaccgcatgtcccctctttatgtggatttatcttttatgaaaagtttgcttttgtccgggacagtttgttgtcgtgagatacatcagacartataatcatgggacaagctgatgtctccagaccggtaaatccagatgcagttgaggaagcagaccagcccactacagagccaggcatggts

SEQ ID NO: 8747 - DNA, 327 bp, Homo sapiens
agtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaagttaaccagaatcaggccaagagatgcacagtgatcgggggctctggattcctggggcagcacatggtggagcagttgctggcaagaggatatgctgtcaatgtat

SEQ ID NO: 8748 - DNA, 322 bp, Homo sapiens
gcaggctctccggcccatctccacacgggcaccttctggctgactcggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagcthcatgcccaccatcctctggctgatggactggtcagacatgaactccaacctggacttgctggctcttctcggactgggcatctcatctttcgtactgatcacgggct

SEQ ID NO: 8749 - DNA, 81 bp, Homo sapiens
taagcatatttcagtcctcactgaaaagtttggctttacatttcaattagaacaatcatgagattgtttttctgacaataa

SEQ ID NO: 8750 - DNA, 409 bp, Homo sapiens
cacttaatttytatatttatacatgtacatttgtatatacatagagaaagtgcaggcaaaaccattatacagttastctartagccatttgctactgccagcagtctcaggactgatccctgtctaagctggcaagtttacattctccttgtatcactacaggatttgctctggacaggagctgtaactcctcaacaaatcctgctttcagtctactactgcacagcttgaattgttcagtaggcccagctttttgtgaaagaaaaggccttgccatggtataaagagtttttttccctctataaaagatgtaaaatttttggctgggtgcagtggctcacgcctgtaatcccagcactttgggargccgakgcgggcagcatcatgakgtcaggagatcaagaccatc

SEQ ID NO: 8751 - DNA, 476 bp, Homo sapiens
  misc_feature 403: n=a, g, c or t
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgcgtgggtgcctggagatgaagctngaaagagctgctgcccaaagggagcaaggaggaacagcgggattacgtcttctacctggccgtggggaactac

SEQ ID NO: 8752 - DNA, 354 bp, Homo sapiens
atagcagagagctgaacactgactgagggagaagctaaactacagattgccaatgctaaatctgagaaccaaagataggtttctgttgctgttgaacacattctagtgcttacatagcatttgcgttgtattagatgttaaaagtaatctaaagatgatttcaagtgtatgcttaggttatatgcaaatactatgcaattttatataaaagagtacctgcagcttttggtatccactggggtctagaaccaatctcctgtggatactgagggaagactgtaatgtcaggtgttgctttttcytttttcagatcawttatcattttgataagagggtcacacaatttagttggct

SEQ ID NO: 8753 - DNA, 327 bp, Homo sapiens
  misc_feature 287: n=a, g, c or t
catgactagggggatgattattagtcacatagagcttgggagtaccactcgaaacgtatgggtaggagtttargtggcttctgtttttcaaaagatgatcttatcctagtatctgtaatgctcacttggcacacctgamttgtgggctgwgtgtaargtggctagctaagtgaaaaaagcctgctaggtgtgagtcaacttaagaatatgtaaataggtttgagaaaaagtagggcttgggtgcaagtaaagattgagcaggaaataaaggaaaatcaagtataatncvtgagabkygtagactaaaggcaatgatgtgggactact

SEQ ID NO: 8754 - DNA, 422 bp, Homo sapiens
  misc_feature 229..230: n=a, g, c or t
gsctaaaatkkgtttctctcttgaagaggattctttgaaaaggtctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctrnnwrggtccaccaagggctcctgcttttcagacaccccatcatcctcgcgtcctcamcctgtctctaccagggaggtgcctagcttggtgaggttactcctgctcctccaacctttttttgccaaggtttgtacacgactcccatctaggctgaaaacctagaagtggaccttgtgtgtgtgcatggtgtcagc

SEQ ID NO: 8755 - DNA, 150 bp, Homo sapiens
ttstttgagacagggtctcactctgtccccaggctggagtgcggcgttgcgatcttggtctgggctcactgcaagctctgcctcccaggttcacgccattctcctgcctgggcgacagagcaagacactgtctcaaaaaaaaaaaaaaaa

SEQ ID NO: 8756 - DNA, 94 bp, Homo sapiens
gymwaacaagggcagcgggcccggcgcggtggctcacgcctgtaatctcagcactttgggaagccaargcgggcgaatcacttgaggtcaggag

SEQ ID NO: 8757 - DNA, 148 bp, Homo sapiens
cacttagaattagggtctctttttaccctaattccatctcagcttgcaggcaatagagtaaaaaatttgaggccargcgcagtggactcacgcctgtaatcccagcactttkgggaggccaaggcaggcagatcacttgacgtcagag

SEQ ID NO: 8758 - DNA, 402 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgcgtgtagacacctctggtgtctagtggttgaggatctgttgaccgggcatggtgggtagaaggaacgctccgagcagaaggaaagtggctgtcgtgaagacatctgcgtgtgcggggtgcgtgggtgcctggaagatgaagct

SEQ ID NO: 8759 - DNA, 289 bp, Homo sapiens
ctatattactggcccacagagaagagcagagagctaatctggggattgttttcagttgcctgttttatattatgcattcaggaactggggaagtaactattacacaataaggatttacagacccatagaactctctgagacagctttgggctgaaactttattaatcgcttgaccatcctacgtgccctctttcttggaccacagtgatgttttaggtcagttcagtgccatgtttttgtaatgcctgaaagatcttttcccccatgcacagtcactgtagtgaatgcc

SEQ ID NO: 8760 - DNA, 314 bp, Homo sapiens; identical to SEQ ID NO: 7928

SEQ ID NO: 8761 - DNA, 154 bp, Homo sapiens
catttgatcaaatgctgtaagcacagccaaggcccaaattcatctagataccaaaaatgtgatttcagtgaaatctcttttcattgccgctttcttttgttgttgtttgttttttgagccagagtcttgctgctctgtcacccaggctggagts

SEQ ID NO: 8762 - DNA, 203 bp, Homo sapiens
aaattgatggtgttttacaatctctcttggtcattgtcattgttaaacagtttttttaaatcattctgagtttggaatgtgtgctgtatatctttttttttttggaratggagtctcactctgtcgcccaggctggaatgcagtggcatgatcttgggtcactgmaacctccgcctcctgggttcaagcgattctccagcctc

SEQ ID NO: 8763 - DNA, 374 bp, Homo sapiens
gaaaatccgcaatctaagacctgaaactactgccacagccatgcataaaatgaaatgctgctgctttcctctctgttaaagagaatgttcaaggccgaggacacataaaaaagagcagcattgctggctctgttatttagctgtgtgttcttgaaaaagtcacttctccagacatatctcagcatttatdacctaagactgaatcactgcattttacccttaatgaggtacgcttacactaatctttttgaaacagtacttaaattgtagcaggacaagccgcagacaaaacccctcagccagcgagtttaagaaagaagggctttattcggccgggatcttcggcaagactcacgtctccaacaaccaagctc

SEQ ID NO: 8764 - DNA, 360 bp, Homo sapiens
  misc_feature 304: n=a, g, c or t
cttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaarrkttttwtggaagaaaattggtgttgctgatagagaagangtggaacaacaagcrgrtaawtwttwbhagggatgctgatatcagtgatgttgcat

SEQ ID NO: 8765 - DNA, 384 bp, Homo sapiens
  misc_feature 129,211: n=a, g, c or t
agtcggggttgcgagcggcccggggccggggctgccagggccgctgcaggacgagaccctgggtgtggcgtccgtgccctcggcaktgdagggccgtccagggcatccgcggggagacgaaaagttgcnagacggcmagcattgccactgccagtgcatccgcccaggccaggaatcatgtggacgcccaggtgcagacggaggcccccangcctgtcagcgtgcagcccccgtcccagtacgacatacccaggctcgcagcctttcttcggagagtggaggccatggtcatccgagagctgaacaagaattggcagagcacgcgtttgatggcttcgaggtgaactggaccgagcagcagcagatggtgtcttgtctgtatas

SEQ ID NO: 8766 - DNA, 73 bp, Homo sapiens; identical to SEQ ID NO: 8430

SEQ ID NO: 8767 - DNA, 375 bp, Homo sapiens
attattgttctttttttgcgatgggtctctgttacctaagctggtctgagctcctgagctcaagcgatcctcctgcctcggccacccaaagtgttgggattacaggagtgagccaccacgtctggcctctcgtcgtttttattttttaatttttgagtgggggctcgctccgtcgcccaggctgtgatgcagccgcgcgatcacgacctactgcatcctggacctcctgggctcaagcgaatctccggcttcagcctcccaagtagctggaactacactcccgcgccaccacgtcccgctaaattaaaaaaaaaattgttgtagagatgggggkctcgttgtgttgccctgamaggtctcgaactcttgggctca

SEQ ID NO: 8768 - DNA, 448 bp, Homo sapiens
actagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgcggtgtagacacctctggkctaagtggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaaggagcaaggaggaacagcgggattacgtcttctacc

SEQ ID NO: 8769 - DNA, 341 bp, Homo sapiens
tatgttagtaaatagaaatttaaaagttttcactataccaatttgaatatctttctaaattttatctgctacaaagtgctakttttatattaggcccattgrtttgcagaattataaagctaatactgaatatggtaaattactgcacttggcctttaatgagatttttgaaacgaatacctrdaccataactaatgtaatccaaaatgccatctcattttattcagcttgctcctgttggctcctggtaaaactgagttgattctaaattctcaaartatattcaaaactaagggwmwwtttgtagaaggggctaaagaagcagtatctgttggacttca

SEQ ID NO: 8770 - DNA, 414 bp, Homo sapiens
aaatggggaaaatgtcaccagggcatgtaggaggtcttcgaggcagcccctttcatcacaggcccagaggcataggaggaaaaaatggtttcacgggctaggcccatggtccctgtattgtgtgcagtctagggacttggtgccctgtgttccaaccactttagccatggctaacaggggccaaggtaaagcttgggatgtggcttcagagggtgcaagcccccaagccttggcagcttctacatgatgttgagcctgcgagtgcacagaagtcaagaattggggtttgggaacctctgcctagatttcagaggatggatggaaatgcctggatgtccaagcagaagtttgctgcaggggtggggctctcatggagaatctctgctagggcagtgcagaagggaaatgaggggt

SEQ ID NO: 8771 - DNA, 236 bp, Homo sapiens
tcaataataggaattttaagagctcaaaagctgcttcttagtcaggtgcggtggctcatgtctataatcccagcactttgggaggcccgaggtgggtggatcacttgagtgcaggagtttgagaccagcctggacaacgtggtgaaaccccatctctacaaaaaaatcgttaaaaattagctgggcatggtggtgtgcgcctgtagtcccagctacttgggaggctgagatgggar

SEQ ID NO: 8772 - DNA, 386 bp, Homo sapiens
tctgcgcaggcgccgagcggccgaggcgccgcggtcggctctgggactcgtctggcgtccctcagaggcagaagaggsctkggaccttggcgcacacagacccaggaacagatgagcggggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcag

SEQ ID NO: 8773 - DNA, 383 bp, Homo sapiens
tgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggct

SEQ ID NO: 8774 - DNA, 191 bp, Homo sapiens
accttgtctcgctcgggagcggaaacagcggcascagagaactgttttaatcatggacaaacaaaactcacagrwkgaatgcttctcacccggaaacaaacttgccagttgggtatcctcctcagtatccaccgacagcattccaaggacctccaggatatagtggctaccctgggccccaggtcagctam

SEQ ID NO: 8775 - DNA, 336 bp, Homo sapiens
ttgtgactctgatgatggtttcatgggattataagaaaattcaagccaggagcagtggctcacgcctgcagkcccmaacactttgagaggccaaggcgggcagatcacgaggtcaggagattgagaacttcctggctagcagggtgaaaccccatctctactaaaaatacaaaaaaggtaggagtggtggtggttgcctgtagtcccagctattagggaggctgaggcaggagaatggcatgaacccgggaggcagggcttgcagtgagccgagattgtgccactgtactccagcctgggtgacagagcgaggstgtcccaaaaaaaaaaaaaaaa

SEQ ID NO: 8776 - DNA, 273 bp, Homo sapiens
aaagttagttattattaataaatatgtaactagatatttgtgcttttagctgagacttttatgattttatgkatgygggktttccacgtacttkatgtttacatatcaaatgatttttggcatcaggattcagagtatgctttgaaaaatttctccatgaatcttgatagatgcttaaatataagggaatagagtgtgttttattttataaaatgtattttataatgtttgtaaagaagttgttccattttcccacttaactcttatacgcas

SEQ ID NO: 8777 - DNA, 226 bp, Homo sapiens
acccggaagcctagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtaga

SEQ ID NO: 8778 - DNA, 226 bp, Homo sapiens
  misc_feature 68,76..78: n=a, g, c or t
tttttgggcttcgcttccaccgcaccagccggcctacccagtccttccggtatcgcgttgctcagggncttttcannnckctgtcagtcggaaaaccatcgccgaggccgtggggggactcvwatccatggtgttgaagcgtcgagccgactagggaacctccttccccgccaggatggaagtcgcatcagtcgccgcctattgcgcgggctgttcttccctgtgk

SEQ ID NO: 8779 - DNA, 380 bp, Homo sapiens
tgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatkagtwagrggkgtgtacacahatcctcttgtgtgctaggtagtgggcgtgcatctggatctgagaggcagtaaagcagtgatgaagacagtgcagcagaacattgaagtcctgattgcagcagtgactctgcaaccttggataaattatttcaatctttat

SEQ ID NO: 8780 - DNA, 215 bp, Homo sapiens
tbatacgtatatatcatcgcacggtgtgtcccggaaggcttgatatgctagtcccgcgggacaaggcgagccgaggagtttgtgtggaagtttgcatctgagagtgcgagastggacggagtgttacagagccgcgatgccttctcgttttgttttgttttgtttttgatacagtgtctcgctcttccgcccagtctcgagtgcagtggtgagaa

SEQ ID NO: 8781 - DNA, 410 bp, Homo sapiens
tccagaaakkgatgtccccagatctttagatgaacatttaagcgaagagtattaaatacttctcactgtaaattttcatctattatgaaagatactaaaaataatctcgttttttaagtttggaattgggagaatgtcattgaagtttttcagtgcttgttttttgagatacacatactttgccttaaatctggggtttttttcccttaagccatgtgaccctttctacaaactcagtgtatgtttttaatatttcctgggtactctgctatcgtcctaatacataatattagggtaaggctgccctaatacgagaacattttgagtatactattgagtatacatttgagtatacatattgagtatactatttatgccaacgtgaaggatgtgattagttttagccttca

SEQ ID NO: 8782 - DNA, 136 bp, Homo sapiens
ttaaaatgttcatackacccaaagctagctctagacacaatgcaatccctatcaaaataccaatgacattcttcaaagaaatagaaraaacaatactaaaatttgtatggaaccacaaaagaccccaaataaccar

SEQ ID NO: 8783 - DNA, 73 bp, Homo sapiens; identical to SEQ ID NO: 8430

SEQ ID NO: 8784 - DNA, 139 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaag

SEQ ID NO: 8785 - DNA, 396 bp, Homo sapiens
  misc_feature 195: n=a, g, c or t
tacccattaacaatcactcctcactctccatttcccttagcccctggcaaccaccagtctatttttttgtatctattgatttgcctattctggacatttcatataaatagaataatatctgtaatcctagcactttgggaggccaaggtggccggatcgctttgagcccaggagttccagaccagcctgggcaangtggcaaaactctgtctctacagaaaatacaaaaattaaccaggtgtggtggtgtgcatttgtagtcccagctacttgggaggctgaggtgggaggatcacttgagtccgggagggcggaggttgcagtgagctgagatcacaccagtgcacttcagcctgggtgtcagagctaggccctgtcccaaaaaaaaaaaaaaaa

SEQ ID NO: 8786 - DNA, 251 bp, Homo sapiens
actagtcgcccggagttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaaggacgggaggccgcgtagaggaggggaccgtccccgagcctcgccgagcctgc

SEQ ID NO: 8787 - DNA, 399 bp, Homo sapiens
  misc_feature 360: n=a, g, c or t
attattgttctttttttgcgatgggtctctgttacctaagctggtctgagctcctgagctcaagcgatcctcctgcctcggccacccaaagtgttgggattacaggagtgagccaccacgtctggcctctcgtcgtttttattttttaatttttgagtggggggctcgctccgtcgcccaggctgtgatgcagchgcgcgatcacgacctactgcatcctggacctcctgggctcaagcgaatctccggcttcagcctcccaagtagctggaactacactcccgcgccaccacgtcccgctaaattaaaaaaaaaattgttgtagagatgggggtctcgttgtgttgccctgacaggttncgaactcttgggctcaagcgatcctcccgtctcggtgtc

SEQ ID NO: 8788 - DNA, 509 bp, Homo sapiens
atgtaacacatgaggtaaaagtaatctcaaagttgacatgctgatggggactcctggcaaggggagttccctgccctcaacaaaaggtcatccacagctactggaacatttttgttgtctgagaagtataaagtgccttagaaatacctgaatccattaatgcctccagttggtgaaatcagaatttgcaggtgactgavattgacagtagtgccttgttcttactcactgttcaaatgacaacccacatgttttatgadttssgtatacagatgtatgctctaacagcagtatctccctccagagccactgtgtaccaagcaccaggtcctccagggatagttggctctattcagtctttgattcattcaacddgagcttactaagctcctttttggtaccagatactgtttgttgctgaaaataaataaaaggscagcaagattaagtagactgtgagatctggaccagtaatttgacaacacaaagtactgtcgtaaagatacagt

SEQ ID NO: 8789 - DNA, 446 bp, Homo sapiens
  misc_feature 259: n=a, g, c or t
ctattgctatgttttcaagttcagttatcttttcttctgtaatgtctcatcttccattaatcctatataataggtttttcaacttagacattgtagttttcatttctagaagttcagtttgggtctttttatattttccacatctgttacctttttgagccctatagaatacagttataactgttttaatgtcctaatctgctaatgtctttgtcatttttggatcagcttggatcaatggatttttttccctcatbrntcatgttttcctgtctgtttgcatgcttcatatctttgattggatgtcagacctaattttaccttattaggtactgggtatttttatttttattatttatttatttattttgagacggagytcactcttttgcccaggccggagcgcagtggcgtgatcttggctcactgcaacctctgcctcccag

SEQ ID NO: 8790 - DNA, 464 bp, Homo sapiens
aatgagtcttcttaatttaaactgactactggatggcttcctgttatgttaagaggtagcaacttaaacatagagcattttaaaattgagctttaacgtacatcagagcctaagatttgactctgattttgataccctgagtaaacttaagcaccttttctccttcattcactttggtaaatgagctgtgcagccatgctcttctcgtaaacttttacctgctgtgctaggctgtgagccacgaakkcctgcactgccctgtgccagtgtctggaacattctccaagtaattggccagtgcctgcgcagatagaatgcaggtagaatgccagttctccccaacccttgccattgatctgcatcttgggaggctgtgcaaggagttggaggatctggggttttcccagtgtctggtcactgaaagaaattttttctttttagtgactccaggttagtgtctgaga

SEQ ID NO: 8791 - DNA, 461 bp, Homo sapiens
taaaaaatgttctcagaggctttctggagagatcttatttgtcaattaacatggcaaccaaatggagctgttgatccaaggtaatacactgaagacattcattcatttagttgtagatcataattctattagggaacatgtggtaacctaagatctgttagactctaccttcattacaggagctataatgaaaaagtactgattgaagagggaacttgcaaagaaatatgagatgctgttaaatgtggtccctcctgcttcagataattaccactttaactttaatctctgatgctcgttgtcttcattcaggccacgtatatatagtgaaggatttcatacctggcaggtaataatagagcaaaaattctaggcccaaacaaaacttcacttaaaccacttttcctgaacatctgctctgaagtcagactcgaccacttactgtgtgactttgtagggca

SEQ ID NO: 8792 - DNA, 235 bp, Homo sapiens
tttttggtcagcactgatgtccttggatgagacacaatgtttctctactgtgataggccggagaaagacctagttcctaggggtctgttttatgttttaaagtctatgatcacccaacctattttcacactggtgagctgcccacaatggaagaatgmaaaatttatagmattgggcatttctaccctggcatctgtcagtggacaacataactctcatcaatccaattcatgat

SEQ ID NO: 8793 - DNA, 408 bp, Homo sapiens
ttatttatagctgagtatgagtttactatgcagagaacctgagtcatgggctgactagtgaatgtatcaaaaagcggaatgtgggaatgtaaaagggtgcaacaactttggaaaacagtttggcaatttcttaaaaagttaagcatcaacttaccatatgacctagcaatcccacttgtaggtatctacccattagaaatgaaaacatatctacaaaaatacttgtatatgaatgttcataggattaatcataatagcacaaaactggaagcaatctaaatgtccattaactggtgagtgggtaaaccaaatgtggtatatacatacaactgaatactattcattaataaaaaggracaaaatgcatgctgtaacacagatgaacctcgaaaacattatgctgagtgr

SEQ ID NO: 8794 - DNA, 421 bp, Homo sapiens
tacatttacaactaacagaatgtactcatatatatagtcactatatttaatattgcctaggtatttcttttttattcctgtgtatgtgctgaatcataataactgatttatttgttgatattaattttagctcacagtagcattatttacattgtaagcattttttttctaggtacatgtcatgaatataacgtgctttttaaaactcagattccaaacttggcatacgtctaaactccttagaatggagttgaattttgcaagagttgattaaatcagtatgatgatttgagggtcactggctcactttggtctgtttcttggtcaaagaccattttcctcatcttttggctaggctttcttcaagtacatgttgttggcaatgagaagggtactgtgtgaatgagaataaaatcaagac

SEQ ID NO: 8795 - DNA, 390 bp, Homo sapiens
agatgtcccttcctgctcccaaatgcctcactgccccaggggtagtcactctcctgacttctttggccatcaccataacaaagaaaagctttgcctcactggatagttaccacccttgcacgtatccttgaacactgcagtttcgttttacctgtttttggactttctgtgaatggaactgtacagcgtgtactctcttgtctcacttggcaccccattgtgctgactgtggccaagtgctgggatccctctcctcaggcctatttcactctcccccgaaatcagcccatccagccaattgaccctgctgcctgggtgtcccattccgcggctctgactggcaccttcccagcctatccaggttcctcctccatgagcaccattacatck

SEQ ID NO: 8796 - DNA, 159 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtcccaaak

SEQ ID NO: 8797 - DNA, 71 bp, Homo sapiens
acctctcccgacgatccgggtcctcccgcccttcgcggggrttctgtcgcsaaccctctcacggcagctat

SEQ ID NO: 8798 - DNA, 354 bp, Homo sapiens
cacacctacaaataccacaccacacctacacacaaagccttcataaaaataagagccgggccgggcgtggtggctcacacctgtaattccagcactttgggaggccgaggcgggcggatcacctgaggttggcagttcaagaccagcctgatcaacatggagaaaccccgtctctactaaaaatacaaaattggccaggcatggtggcgcatgcctgtagtcccagctactcgggaggctgaggcaggagaatggcatggactcgggaggcggasttgcagtgagccgagattgkgcmaykgmaytcaascctgggtvacagagcgagactccgtcccaaaaaaaaaaaaaaaa

SEQ ID NO: 8799 - DNA, 408 bp, Homo sapiens
agaatcatttcctttaggaatggctaaataagatgtattggactggtttaatgagatattgtgatgagttagtgattttgacaaaaatggctgagtagttcagcatttagatggttggatattaaagatgatataacaacttacaaagaatgggatataactaacccttaccaagtgcttctatttaggaactgagaaggattatattaatcccagctgataggggaaagagtcaaacttcccataaatgcagtctgatacaaagccaggaagaatgttgagatctaatgaattaagatacagtagtgctttctgccatcaaggaaaaaaagcaaccatgattctttctgttaaaagtgacaggaaggccggatgtagtggcctataatcccagcaatttgggaggtg

SEQ ID NO: 8800 - DNA, 295 bp, Homo sapiens
tttttttttctcttaggacagactaattctgaaaataccgaagaaaagtagctctatgttctcaccccggttttcctgcgtgtgtgcccttgggtgcgatgcctcccccagcgctctgtggtcgccggtgccagggccccctctggtttggsaggggcctggctgcctttgctccctgcagtgagtcttttggtgttttcatgcacggcttgtgcttctggatctgaggcctctcgtgttcacgcggacacttccttccttaagaagacgcctaaaagaggaagttggaattttt

SEQ ID NO: 8801 - DNA, 457 bp, Homo sapiens
cagactagcagatatatttcctgggatgtgaagataaattaatgaagaatttgttaattagttcttaatcatttatgcttctaatttataaaggtatttgtggaaactggatgaacagatgcagctcatagagctatgtatttgtggaaactggatgaatagatgcagctcatagagcttgtgactgtaaatggtattgttgatatttcaaaatattgtgaatatataatttttgatgatgtctactttgaaaacttttaaaaccatgttttacattctgttcagatacaccaatagrrttaattagacttttttcgtttcttacagtgtttaacacaaactttgagcacatttcatgtactaattttcagaatagtgtgtcaaggtttctatttaaactatatagataaggaacaggaaacctttggctttggtgtatagtgaattttagaactgr

SEQ ID NO: 8802 - DNA, 83 bp, Homo sapiens
ccggaggcggmsttccagtgagccgagatctgcgctccaacctggggacagagcgagactccctctcaaaaaaaaaaaaaaaa

SEQ ID NO: 8803 - DNA, 158 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtccaaat

SEQ ID NO: 8804 - DNA, 530 bp, Homo sapiens
aaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatgaatgctgaagatgtgttcccatgagttcctgcctccttgtaccccactgagtggaatgttaaaaatacggagaaagaatttaagacctgccagattggatcatgccagtgtttcctatagcctaagattctaccttcaactgtggcagtaagataaattttgtgcaatttctacagatgcagtcccacctctggccatggcaaaattagctggataattctttgaatctggctaatgtggaatcttgcaaggacaaagaggatttgctcacgaactggagctaacttcctcttatagtctatcctctgtggatttgtgagtcacacatttttac

SEQ ID NO: 8805 - DNA, 361 bp, Homo sapiens
atattttctaggagcctacctttacttagcctcacaacatgggccttagctttasacttaatctgcacaaatacctggcttaagtgttatgactgactggctattcaaccaaaccatacaaatgaccaattcggtaagaaagcatgaacttcagtgttgaaccaaatcaaccaacctcctcaatccaaatggagaggataacaaaggaagctgggaagtctgttctggaggcaccatgacaaagcaccagacagaaagcagtcacgtgtggggagatgagcagagacaccacttctcaagcacctgattattctttctcagtatttagaagcaaaaattatccttaagaaaaacaaccgca

SEQ ID NO: 8806 - DNA, 158 bp, Homo sapiens
caaaaaattagccgggcgcggtggcgggtgcctgtagtcccagctactcgggaggctgaggcaggagaatggcgtgaacctgggaggcggasttgcagtgagccaagattgtgccactgcaatccggcctgggctaaagagcgggactccgtccaaas

SEQ ID NO: 8807 - DNA, 314 bp, Homo sapiens; identical to SEQ ID NO: 7928

SEQ ID NO: 8808 - DNA, 448 bp, Homo sapiens
agcatttgccatttcactgcaggcatttgagaacataatagaatttctccatatgaatgtgaaacacttcagacaaaagatgaggaaaccgatgtgtccggaattrctgggttcttggtctcactgacttcaagaatgaagccgccgaccctctcggtgacagacatccgcctgcgacaggacatccgcctgcgactcaaaacattcgagagtttttcctggtgaattcagtctcacttcctgccaaagtaaacgagttcctgtgctggccgtcccgcccctccgaatcctcgggagaagcgggactaaaggatcaagctgaagtgaatgtgtagccctgtgacctcagcgcgcgggggcggggcgatcgcggacacccccgccctccccgcctccagcgcgagtgacaacccggtctctggctctggagctgcggcgcggaacaagc

SEQ ID NO: 8809 - DNA, 251 bp, Homo sapiens
  misc_feature 209: n=a, g, c or t
tgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggnttgtattaatttgtattgccccatggctgacaaaagccttty

SEQ ID NO: 8810 - DNA, 181 bp, Homo sapiens
ctggttgggggaattggaggcttctaggaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgt

SEQ ID NO: 8811 - DNA, 207 bp, Homo sapiens
tggatcaaagacctaaatgcaagatctaaaccttgcattagaaaccttcccataagaatatggaggaaggccgggcacagtggctcacacctgtaatgccagcactttgggaggccgaggcgggcggatcacctgaggttaggaattcaagaccagccctgaccaatatggtgaaaccccgtctctactacaaaaaaaaaaaaaaaa

SEQ ID NO: 8812 - DNA, 408 bp, Homo sapiens
tttatgagaaaattttgagcattcagaagaaatctgctagagaagagattgaagatactgaataaaaagagggaatgatttatagaacaatagctaaagatataggaacaaaggagttctagggtaaaaggcagaggcatbaaacaggargraactctgccactgacactagagtgcttgcaaggcttggggtttggggcggggggaaacactagatatattaagattagtttgaatttaatatatgaacttgaattttagtattacaagggattagttttaatttgggaaattgtatccaattttcagaaattctacatttgcattaaagcagcaccaaatttgttttttaaattaaaagcaggctataatgttcatagaaatgtgctatggccgggcacagtggct

SEQ ID NO: 8813 - DNA, 372 bp, Homo sapiens
atattttctaggagcctacctttacttagcctcacaacatgggccttagctttasacttaatctgcacaaatacctggcttaagtgttatgactgactggctattcaaccaaaccatacaaatgaccaattcggtaagaaagcatgaacttcagtgttgaaccaaatcaaccaacctcctcaatccaaatgaacaagtcttctgggcatcagagaaactcaaaaccactgtgtgagcaggtgattgctaagctcaagtgactcttctttttatcagttgctaagtgaaaagtccttaaagagaaatcgatgattctgaacaagcctacggggtacattcactctctttcctgctgatgctatggtctgatga

SEQ ID NO: 8814 - DNA, 495 bp, Homo sapiens
  misc_feature 270..271: n=a, g, c or t
taattagaatgtaatatgataaatgttccaatagaagggtgtcatggtggcatggaaatgcagaagacttaactatttcagaaggttggggaaaagttcacaaaaaagatgacgtttgagctgggcattaaagcaactacaagaagtataaaaaagcctggtaaatccactgtctgaaacattcagtattacaggaatgtaggtgacaggaggtagagcaggaaatgaagctagcagagggcagagccctaagaagtattaaataattwnnaatgtaaagtgctgtgaagggaattacctggatccctgagaagacaaaatgaaagtctaacctcatttgaagctctttggggaagctcctgagcatttcagctaacactgaataggaattaaaaatcactctggaatgagtgagttgagagataggaaataaagttgacaggacatggtgtgatcagaagtgagggattagaagaaaatatcagggatgacttc

SEQ ID NO: 8815 - DNA, 433 bp, Homo sapiens
tttttgttttaaaaaaawwmcctcgtaacggtaaatcagggaatgtttgcgtgcttcagtgactcaaagtatatttcactgaaaatcacgtttttgcctgactgatcacaacatgcgtccatgctttccttatatgttgacaagcactcgtgtaatttctaaatgttctctggtgtcatttcctaagttttaggtaaaagtattacaaaatatgtttgtagttctaaggtcctatggttggagattataaaattctaaatgtagaatctgtagagtagaagttagtggtaattgctccctctggaggctaaaactaaatgggatgtttgactacagtctcttaagtgatttatattcgctgatttgggactattttgaacatatcttggtctaatcattacagaagagaatttgagtttaaaatagcatgata

SEQ ID NO: 8816 - DNA, 471 bp, Homo sapiens
tttttcatatttcactgttgctgaacattgatttagtcttccaaaatggacatcactagtaagtgcactgaatactgaaatacgctgattggcaagcatatatctgtagctagaatttttttaaccgtaattccagaatttaaaaaggtaagagatctgctttttgatagaggccttttaaaaagactatataacatttctatttggctgtttatgtgaatgctcagggaatttggacatgtgttttatacagaagtggctttttatatttcttcaagtgataaattagcattaggacatatcagatagaacaggccagtttcctgatgagattggtagagatgttacggtaggttcatccttcctttttccatgttatatgtggagaagtgttaaacttgctcaagcaaatgggagtaggagataggctgaaaatagagattgctacaccattctattttgttttcatgc

SEQ ID NO: 8817 - DNA, 84 bp, Homo sapiens; identical to SEQ ID NO: 8547

SEQ ID NO: 8818 - DNA, 444 bp, Homo sapiens
  misc_feature 49: n=a, g, c or t
cctgggaaggctgcagagctagagcagcgccgcccgaggggsmaagggnctgaccatagagagcgcgggggcctccagccgagaggaagggagggcagctcgggccgtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggaactattaaccacaagaaatacatcaagttttctaaaacaatagagaaggaaatttcac

SEQ ID NO: 8819 - DNA, 472 bp, Homo sapiens
  misc_feature 147,149,313,329,333,359,407..410: n=a, g, c or t
cacaaaagaaagcagtaaaggaggaacaactacaaaaaaaagtgacatagaaaaataccaaaatggccttttaaaatcccaactgtatcaattatgtatatatataatgtgtgtgtatatatatatacacatatatatataaatatnyntbtgagacagagtctcaaaaaaatttattttattttatttattattattattatttcttgagacggagtcttgctctgtcaccagactggagtgcagtggcgcgatcttggctctttgcaacctctgacttcctggttcaagcgattctcctgcctcagcctcncbaagtagctgagatnacankcacgtaccaccacactggctaatknhtgtattttagtagagatggggtttcaccatattggccaggatggkcnnnnattttgtgacctcgtgatccgccctcctcggcctcccaaagtgctgggattacaggcgtgac

SEQ ID NO: 8820 - DNA, 384 bp, Homo sapiens
  misc_feature 169,307: n=a, g, c or t
tttctgtgtcccagtctatttctccatgaaatgggaattaaaatattatttaattcactgagttgctatgaggattgcatgaacaaatctatgtaaagcacttagaaaaacgcttggctcatactaaatgcttaataaatgttaacaaacaagattttattttcaagtncttgttctgttactcaggctggagtgtagtggtgcgatcatagcttacagcagcctcaaactcctgggctcaagtgatcctcccgcctcagcttcccatgtaggcgggactacaggcatgtaccaccaagcccagctnatttttataatcctattgtagagatggggggggggggtctccctakgttgcccaggctggtcttgaactcttgggcy

SEQ ID NO: 8821 - DNA, 410 bp, Homo sapiens
cacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggasccaggcttctagtgcctgtggatgkggacamaaacacgccctgctatgcctcttagaagttacctacaagggcactcagtggtatgaacaaaccaaagaagaattgatggctcctacccttcttccagaactccatcttttaaagcagattaaagtaaaaggcccaagatactgggaactgctcatagatt

SEQ ID NO: 8822 - DNA, 419 bp, Homo sapiens
cgcacgagaccatcctttattctgtactttcggacatccaagttgttttcagatttttacttttttaatatgatgcttcagagaacattcctggaagtaatgttgccagtgcagaggtgcaagcatgtttgagacagctgatagttacctctgtccagaactggctcactcccaacagcagcaggaggcacccagggtctctcactttcctttcaattttcctttctccacatcctacccccagatttgtctgacttttccagaggctattgagagaagctttttgagtgaggcaccacacagatgtttaagactaagtttgtggtctttgagaaccgaggtagcctgacccattggaagcctgcagataattgaaaaaatcttattttagatcctgtgtcattcttctgctatcaaac

SEQ ID NO: 8823 - DNA, 477 bp, Homo sapiens
ccaaaatctgtgttctttctgctgcctattttcctctctgaagtggaattttcccctacttaacctcaatgtgaaagcactgggtatccacctccaataccatactctaacttggagtaaattatttgtttatatctctactaaccctccatscctgtgaactcttccagatatatgttggtcatccttgcctcctcaagatccagcaaggaccctggtactttttagatattagtaattataaatataaggttgaagccagtccccaggataaaaaggcagatgctccttaacttggactgatgaagtgggctcctccgtaaccctaaagacctgaccaaaactccttcctcacatctagcgtaagaccacacaaaacaaatttctttcctaggccacagcatcctctaaagctgtgattgatcaagctaactaaatggrhgtggttggccaagataacaaagcataaatcagggt

SEQ ID NO: 8824 - DNA, 95 bp, Homo sapiens
atgggtttgtagtatagattgaagtcaggtaatgtaatgcctccagatttgttctttctgcttagtcttgctttggctatgtgggctcgtttttw

SEQ ID NO: 8825 - DNA, 54 bp, Homo sapiens
carmwwattagccgggcgcggtggcgggtgcctgtagtcccakctactcgggck

SEQ ID NO: 8826 - DNA, 485 bp, Homo sapiens
taaggacatttcataatgctaaaggctaaaattatccagaaaaaaaaatgtagctaaaagccacaataaagataagagtttgaaatatcaaacttttgtatcagctaacccaaaatatctgtgtaccaagtaacacagcaaccaccatcatwaaaaaagaaactatgggattacatttccaagtaataatttcttatctttggccaactctgtgagtagctaagggaattttaaaaagtgttactcagggatgatccaaagaagatacatttggaagcaagataggtggattaagtctgtgctgaataataatttgtcatacctcattataagagatgtggccatggccaggcgtggtggctcacacctttaatcccaacactttgggaggccgaggagggcagatctcttgaagtcaggagtttgaaaccagcctggccaacatggtgaaaacccaattctaataaaaatacaaaaaaattagc

SEQ ID NO: 8827 - DNA, 434 bp, Homo sapiens
  misc_feature 70,227..228: n=a, g, c or t
ctgtacctgagggaggagccaagatggccgaataggaacagctccggtctacagctcccagcgtgasgancgcagaagacgggtgatttctgcatttcaatctgaggtaccgggttcatctcactaggaagtgccagacagtgggcgcaggtcagtggggtgcgcgcaccgtgcgcgagccgaagcagggcgaggcattgcctcacttgggaagcgcaaggggtcanngagttccctttcctagtcaaagaaaggggtgacggacgcacctggaaaatcgggtcactcccacgcgaatactgcgcttttccaaccagcttaaaaaacggcgcaccacgagattatatcgcacctggcttggagggtcctacgcccacggagtctcgctgattgctagcacagcagtctgagatcaaactgcaaggcggcacgar

SEQ ID NO: 8828 - DNA, 487 bp, Homo sapiens
  misc_feature 360: n=a, g, c or t
cagaaaaaaattatatgtatattgcaataactaggattatccagagaaaaagagccaacaagctatatatagagaaaaatttattttaaggaattggctcacacgatggaggcttggagagttgaaagtctgatggggtaggscccatgttkggagactgcactttgagtcttcatcttgagggaagagctgcagtttgagtcttgaggcagtcttgtggtagaatttcttcttactcaagggaggtcagtctttttttctattaagaccttcagctgattggatgagttccacctacattatgaagagtaatctgctttactaaaagtccaccaatctaaatgttgatttcatctaatnracaccttcacaaaaagatccagaatatttgagaaaatatctgggcatcgtggsccagccaagctgacacataaaatttactaccatatatgcatatgtatatacagtatacatgtatatatacatg

SEQ ID NO: 8829 - DNA, 342 bp, Homo sapiens
acaacaatgcacgctgccggcgctacagcccctaagcaaccggccggaagtcggccccacctcctcctgatgtcacggaaatgaagggcttcgcagaggatgtcccgcccgctcccttcagacgggcgtastggcaccttcctgagatatgcctgcttgcccccgatttttttctccttgcagtgagaacctcctcmtgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgttty

SEQ ID NO: 8830 - DNA, 544 bp, Homo sapiens
actgggtttcggcgtctggcaagcggttcagctgtctgctccctagcagccggccttcgggtcgggcgtctccgccggctactgccgcttcagttctcccggtgtggccacgagtcggcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatct

SEQ ID NO: 8831 - DNA, 74 bp, Homo sapiens
aaaaaaaactttaaacarattraaataaaacagaaaaktaaatktttttaaaaacttccttaaataacttatts

SEQ ID NO: 8832 - DNA, 96 bp, Homo sapiens
  misc_feature 62: n=a, g, c or t
acagttaactttaggaccatagccaaaagatagaaacagcataaacgccaaaataaaaagdngccaataaagataaacacaaaaaaaaaaaaaaaa

SEQ ID NO: 8833 - DNA, 103 bp, Homo sapiens; identical to SEQ ID NO: 8028

SEQ ID NO: 8834 - DNA, 103 bp, Homo sapiens; identical to SEQ ID NO: 8028

SEQ ID NO: 8835 - DNA, 57 bp, Homo sapiens
acagttaactttaggaccatagccaaaagatagaaacagcataaacgccaaaataaa

SEQ ID NO: 8836 - DNA, 103 bp, Homo sapiens; identical to SEQ ID NO: 8028

SEQ ID NO: 8837 - DNA, 58 bp, Homo sapiens; identical to SEQ ID NO: 8023

SEQ ID NO: 8838 - DNA, 361 bp, Homo sapiens
  misc_feature 106: n=a, g, c or t
caaacagaattaccagataagccaaaaatactgcttctaggtatacgccctaaagaactaaaaacaggtgttcaaataaaaactcgtatacaaatgtttatagcancattatttataatagctaaaaagtgggaaaaaaacaattgaccatcaatggatagatggataatgatattattcaatcataaaaaagaatttaagtggccgggcacagtggctcatgcctgtaatcccagctacgtgggaggctgaggcaggagaatcacttgaacctgggaggtggaggttgcagtgaactgagattgcgccactccactccagcctgggsaacagagactcggtgtcaaaaaaaaaaaaaaaa

SEQ ID NO: 8839 - DNA, 76 bp, Homo sapiens; identical to SEQ ID NO: 8121

SEQ ID NO: 8840 - DNA, 71 bp, Homo sapiens
aataatagctactaaaaagtaacaaggttgagaccagcctgggcaacataaaggagacccttcttcacaaa

SEQ ID NO: 8841 - DNA, 475 bp, Homo sapiens
gagcacggtggagcggtggagggcgtcactgggtttcggcgtctggcaagcggttcagctgtctgctccctagcagccggccttcgggtcgggcgtctccgcggctactgccgcttcagttctcccggtgtggccacgagtcgggttcttgctctgtcacctaagctggagtgcagtagggtgatcgtaactcacggaagcctcaaactcaagtgatcctcccacctcagcctcctgagtagctaggacgacagtacatagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggag

SEQ ID NO: 8842 - DNA, 76 bp, Homo sapiens; identical to SEQ ID NO: 8121

SEQ ID NO: 8843 - DNA, 130 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaar

SEQ ID NO: 8844 - DNA, 103 bp, Homo sapiens; identical to SEQ ID NO: 8028

SEQ ID NO: 8845 - DNA, 133 bp, Homo sapiens
cattggtagcttgatggggatggcattgaatctgtaaattaccttgggcagtatggccattttcacgatattgattcttcctacccgccgcaaaaaaaaaaaaaaaaaaaaaaaaaaaaaaaaaaaaaaaaar

SEQ ID NO: 8846 - DNA, 103 bp, Homo sapiens; identical to SEQ ID NO: 8028

SEQ ID NO: 8847 - DNA, 362 bp, Homo sapiens
  misc_feature 106: n=a, g, c or t
caaacagaattaccagataagccaaaaatactgcttctaggtatacgccctaaagaactaaaaacaggtgttcaaataaaaactcgtatacaaatgtttatagcancattatttataatagctaaaaagtgggaaaaaaacaattgaccatcaawtggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8848 - DNA, 103 bp, Homo sapiens; identical to SEQ ID NO: 8028

SEQ ID NO: 8849 - DNA, 73 bp, Homo sapiens
aaaaaaaactttaaacagattgaaataaaacagaaaagtaaatgtttttaaaaacttccttaaataacttatt

SEQ ID NO: 8850 - DNA, 103 bp, Homo sapiens; identical to SEQ ID NO: 8028

SEQ ID NO: 8851 - DNA, 83 bp, Homo sapiens
  misc_feature 61..62: n=a, g, c or t
acagttaactttaggaccatagccaaaagatagaaacagcataaacgccaaaataaaaagnngccaataaagataaacacaar

SEQ ID NO: 8852 - DNA, 103 bp, Homo sapiens; identical to SEQ ID NO: 8028

SEQ ID NO: 8853 - DNA, 96 bp, Homo sapiens
acagttaactttaggaccatagccaaaagatagaaacagcataaacgccaaaataaaaagwhgccaataaagataaacacaaaaaaaaaaaaaaaa

SEQ ID NO: 8854 - DNA, 85 bp, Homo sapiens
  misc_feature 62: n=a, g, c or t
acagttaactttaggaccatagccaaaagatagaaacagcataaacgccaaaataaaaagdngccaataaagataaacacaaaaa

SEQ ID NO: 8855 - DNA, 103 bp, Homo sapiens; identical to SEQ ID NO: 8028

SEQ ID NO: 8856 - DNA, 103 bp, Homo sapiens; identical to SEQ ID NO: 8028

SEQ ID NO: 8857 - DNA, 103 bp, Homo sapiens; identical to SEQ ID NO: 8028

SEQ ID NO: 8858 - DNA, 84 bp, Homo sapiens; identical to SEQ ID NO: 8594

SEQ ID NO: 8859 - DNA, 95 bp, Homo sapiens
gaggttgasacaagagaatcacttgaacctgagaggcagaggttgcagtgcagcctgggtgacagagggagactccggccccctcccaaaaaaam

SEQ ID NO: 8860 - DNA, 58 bp, Homo sapiens; identical to SEQ ID NO: 8023

SEQ ID NO: 8861 - DNA, 96 bp, Homo sapiens
acagttaactttaggaccatagccaaaagatagaaacagcataaacgccaaaataaaaagargccaataaagataaacacaaaaaaaaaaaaaaaa

SEQ ID NO: 8862 - DNA, 379 bp, Homo sapiens
actgggtttcggcgtctggcaagcggttcagctgtctgctccctagcagccggccttcgggtcgggcgtctccgccggctactgcgcttcagttctcccggtgtggccacgagtcggcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatccttttgaatg

SEQ ID NO: 8863 - DNA, 149 bp, Homo sapiens
tttctttttacattgtgcctttatcastttatggtatcagggtgatactagcttcatagtatgagttaggcaggagcccatcctcctccattttttgaaatagtttcaatagaaaaaaaaaaaaaaaaaaaaaaaaaaaaaaaaaaaaa

SEQ ID NO: 8864 - DNA, 103 bp, Homo sapiens; identical to SEQ ID NO: 8028

SEQ ID NO: 8865 - DNA, 103 bp, Homo sapiens; identical to SEQ ID NO: 8028

SEQ ID NO: 8866 - DNA, 58 bp, Homo sapiens; identical to SEQ ID NO: 8023

SEQ ID NO: 8867 - DNA, 71 bp, Homo sapiens
aataatagctactaaaaagtaacaaggttgagaccagcctgggcaacataaggagaccccttcttcacaaa

SEQ ID NO: 8868 - DNA, 103 bp, Homo sapiens; identical to SEQ ID NO: 8028

SEQ ID NO: 8869 - DNA, 164 bp, Homo sapiens; identical to SEQ ID NO: 8086

SEQ ID NO: 8870 - DNA, 103 bp, Homo sapiens; identical to SEQ ID NO: 8028

SEQ ID NO: 8871 - DNA, 89 bp, Homo sapiens
gaggttgagacaagagaatcacttgaacctgagaggcagaggttgcagtgcagcctgggtgacagagggagactccggccccctcccar

SEQ ID NO: 8872 - DNA, 381 bp, Homo sapiens
tgtctgatttctttcactggtattttgtagttctcctcatagagatagttcacaaccttggttagacatactcctagtcattttttggggggtgtggctatttttaataggattgcattcttgatgatgtgtttctcagcttgaacattattggcgtttaagagtactgctgactgggccgggcacggtggctcacgcctgtaatcccagcgctttgggaggccaaggcgggcggatcacctgaggtcgggagttcgggagcagcctgaccaacatggagaaacccagtctctattaaaaatgcaaaattagccgggcgtggtggtgcgtgcctgtagtcccggctacttaggagggctggggcgggagaattgcttgagc

SEQ ID NO: 8873 - DNA, 482 bp, Homo sapiens
actgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttagcacactgaagaatgcaacgtcttgattaacttgcttaaggaatgtcacaaaaatgttcttgctctgtcacctaagctggagtgcagtagggtgatcgtaactcacggaagcctcaaactcaagtgatcctcccacctcagcctcctgagtagctgggacgacagtacatagaaaacaggaccaagagcagggagcatggcattgcaatgcgaaagaaactttttaatcctccagaggaatccgaaaaataaattgtattttcactcgatgccttggctgagagaagacctaaagactctgg

SEQ ID NO: 8874 - DNA, 103 bp, Homo sapiens; identical to SEQ ID NO: 8028

SEQ ID NO: 8875 - DNA, 103 bp, Homo sapiens; identical to SEQ ID NO: 8028

SEQ ID NO: 8876 - DNA, 95 bp, Homo sapiens
gaggttgagacaagagaatcacttgaacctgagargcagaggttgcagtgcagcctgggtgacaragggagactccggccccctcccaaaaaaaa

SEQ ID NO: 8877 - DNA, 95 bp, Homo sapiens
gaggttgagacaagagaatcacttgaacctgagaggcagaggttgcagtgcagcctgggtgacagagggagactccggccccctcccaaaaaaaa

SEQ ID NO: 8878 - DNA, 103 bp, Homo sapiens; identical to SEQ ID NO: 8028

SEQ ID NO: 8879 - DNA, 94 bp, Homo sapiens
gaggttgagacaagagaatcacttgaacctgagaggcagaggttgcagtgcagcctgggtgacagagggagactccggccccctcccaaaaaar

SEQ ID NO: 8880 - DNA, 96 bp, Homo sapiens
  misc_feature 62: n=a, g, c or t
acagttaactttaggaccatagccaaaagatagaaacagcataaacgccaaaataaaaagmngccaataaagataaacacaaaaaaaaaaaaaaaa

SEQ ID NO: 8881 - DNA, 149 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaac

SEQ ID NO: 8882 - DNA, 96 bp, Homo sapiens; identical to SEQ ID NO: 8880
  misc_feature 62: n=a, g, c or t

SEQ ID NO: 8883 - DNA, 95 bp, Homo sapiens; identical to SEQ ID NO: 8877

SEQ ID NO: 8884 - DNA, 208 bp, Homo sapiens
cctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgaaaaaaaaaaaaaaaaaag

SEQ ID NO: 8885 - DNA, 442 bp, Homo sapiens
ctcccgagtagctggaactacaggcgcccgccatgatgcccggctgattttctgtgttttcagtagagacggggtttcactgtgttagccaggaaagtcttgatctcctgacctcgtgatcctgacctcggcctcccaaagtgctgggattacaggcgcgasaccgcgcccgacagcagttatgaagttctaaaagcaagtcttaatcaggaagtgtccttgatcaccaacggctcgcccaggcatgctggctctcttccacttccaccttccaccatgggatgacgcataagaaggccatcagtagatgccagtccctcaaccttgaactttccagacgcagaactggtttcatcccaggagcacttcttttcagcacactaagatttggaatccagcagaagattgtcctacattgattatcttctctacatccttgagg

SEQ ID NO: 8886 - DNA, 148 bp, Homo sapiens
cctgtaatcccagctacccaggaggctgaggcaggagaatcgctggaacccgggaggtagaggctgcagtgagccgagatcgcgccactgcactccagcctgggcgacagagcgagagtttgtctgaaaaaaaaaaaaaaaaaaaaav

SEQ ID NO: 8887 - DNA, 103 bp, Homo sapiens; identical to SEQ ID NO: 8028

SEQ ID NO: 8888 - DNA, 58 bp, Homo sapiens; identical to SEQ ID NO: 8023

SEQ ID NO: 8889 - DNA, 103 bp, Homo sapiens; identical to SEQ ID NO: 8028

SEQ ID NO: 8890 - DNA, 361 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcvatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8891 - DNA, 77 bp, Homo sapiens
mtttttycscaacgggtttgccgccagaacacaggtgtcgtgaaaactacccctaaaagccaaaaaaaaaaaaaaaa

SEQ ID NO: 8892 - DNA, 103 bp, Homo sapiens; identical to SEQ ID NO: 8028

SEQ ID NO: 8893 - DNA, 188 bp, Homo sapiens
ttaagcatgttaacaaaaatagcaaaatatgaaaataagctgggcatggtggcacacgcctgtaatcccaactactcgggaggctgaggcatgagaatcacttgaacccaggaagcagaggttgcagtgagccgagatcatgccgccgcactccagcctgggcaacagggcgagactctgtctcaaaa

SEQ ID NO: 8894 - DNA, 103 bp, Homo sapiens; identical to SEQ ID NO: 8028

SEQ ID NO: 8895 - DNA, 96 bp, Homo sapiens
  misc_feature 62: n=a, g, c or t
acagttaactttaggaccatagccaaaagatagaaacagcataaacgccaaaataaaaagwngccaataaagataaacacaaaaaaaaaaaaaaaa

SEQ ID NO: 8896 - DNA, 58 bp, Homo sapiens; identical to SEQ ID NO: 8023

SEQ ID NO: 8897 - DNA, 58 bp, Homo sapiens; identical to SEQ ID NO: 8023

SEQ ID NO: 8898 - DNA, 103 bp, Homo sapiens; identical to SEQ ID NO: 8028

SEQ ID NO: 8899 - DNA, 150 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaaca

SEQ ID NO: 8900 - DNA, 128 bp, Homo sapiens
cttctccccggcrgttartsctgagartscgrartgtrtrctccgsrctcgraacacacatttattattaaaaaatccaaaaaaaatctaaaaaaatcttttaaaaaaccccaaaaaaaaaaaaaaaa

SEQ ID NO: 8901 - DNA, 103 bp, Homo sapiens
gaggttgagacaagagaatcacttgaacctgagaggcagaggttgcagtgcagcctgggymmcagagggagactccggccccctcccaaaaaaaaaaaaaaaa

SEQ ID NO: 8902 - DNA, 84 bp, Homo sapiens; identical to SEQ ID NO: 8594

SEQ ID NO: 8903 - DNA, 89 bp, Homo sapiens
gaggttgagacaagagaatcacttgaacctgagaggcagaggttgcagtgcagcctgggtgacagagggagactccggccccctcccaa

SEQ ID NO: 8904 - DNA, 89 bp, Homo sapiens; identical to SEQ ID NO: 8903

SEQ ID NO: 8905 - DNA, 212 bp, Homo sapiens
aaatgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgctcaaaaaaaaaaaaaaaaa

SEQ ID NO: 8906 - DNA, 96 bp, Homo sapiens; identical to SEQ ID NO: 8880
  misc_feature 62: n=a, g, c or t

SEQ ID NO: 8907 - DNA, 95 bp, Homo sapiens; identical to SEQ ID NO: 8877

SEQ ID NO: 8908 - DNA, 413 bp, Homo sapiens
  misc_feature 262..263: n=a, g, c or t
aacctaatcaagcctgggcaatggcgggcgcccctcccgcagcctcgctgccgccttgcaggttgatctcagactgctgtgctagcaatcagtgagactccgtgggcgtaggactctccaagccagtgagatgaactcggtasctcagatggaaatgcagaaatcaccgtcttctccatcgctcacgctgggagctgtagaccggagctgttcctattcggccatctttgctcctccctgcaactaactccattcttavwsnnwtctcactctgtcacctaggctggagtgcagtggcgtgatggcgtgatctcggctcattgcaacctctgcctcccaggctcaagcagtcctcccacctcagcctcccaggtagctgggactacacgtgcgtgccacacgtggtgtctcac

SEQ ID NO: 8909 - DNA, 58 bp, Homo sapiens; identical to SEQ ID NO: 8023

SEQ ID NO: 8910 - DNA, 58 bp, Homo sapiens; identical to SEQ ID NO: 8023

SEQ ID NO: 8911 - DNA, 103 bp, Homo sapiens; identical to SEQ ID NO: 8028

SEQ ID NO: 8912 - DNA, 103 bp, Homo sapiens; identical to SEQ ID NO: 8028

SEQ ID NO: 8913 - DNA, 103 bp, Homo sapiens; identical to SEQ ID NO: 8028

SEQ ID NO: 8914 - DNA, 104 bp, Homo sapiens
cattggtagcttgatggggatggcattgaatctgtaaattaccttgggcagtatggccattttcacgatattgattcttcctacccgccgcaaaaaaaaaaaaa

SEQ ID NO: 8915 - DNA, 58 bp, Homo sapiens; identical to SEQ ID NO: 8023

SEQ ID NO: 8916 - DNA, 103 bp, Homo sapiens; identical to SEQ ID NO: 8028

SEQ ID NO: 8917 - DNA, 103 bp, Homo sapiens; identical to SEQ ID NO: 8028

SEQ ID NO: 8918 - DNA, 103 bp, Homo sapiens
gaggttgagacaagakaatcacttgaacctgakakgcagaggttgmagtgyagcctgggtgacaragggagactccggccccctcccaaaaaaaaaaaaaaaa

SEQ ID NO: 8919 - DNA, 95 bp, Homo sapiens; identical to SEQ ID NO: 8877

SEQ ID NO: 8920 - DNA, 96 bp, Homo sapiens
acagttaactttaggaccatagccaaaagatagaaacagcataaacgccaaaataaaaakwhgccaataaagataaacacaaaaaaaaaaaaaaaa

SEQ ID NO: 8921 - DNA, 58 bp, Homo sapiens; identical to SEQ ID NO: 8023

SEQ ID NO: 8922 - DNA, 73 bp, Homo sapiens; identical to SEQ ID NO: 8609

SEQ ID NO: 8923 - DNA, 96 bp, Homo sapiens
acagttaactttaggaccatagccaaaagatagaaacagcataaacgccaaaataaaaagwmgccaataaagataaacacaaaaaaaaaaaaaaaa

SEQ ID NO: 8924 - DNA, 96 bp, Homo sapiens; identical to SEQ ID NO: 8923

SEQ ID NO: 8925 - DNA, 84 bp, Homo sapiens; identical to SEQ ID NO: 8594

SEQ ID NO: 8926 - DNA, 103 bp, Homo sapiens; identical to SEQ ID NO: 8028

SEQ ID NO: 8927 - DNA, 353 bp, Homo sapiens
cacacctacaaataccacaccacacctacacacaaagccttcataaaaataagagccgggccgggcgtggtggctcacacctgtaattccagcactttgggaggccgaggcgggcggatcacctgaggttggcagttcaagaccagcctgatcaacatggagaaaccccgtctctactaaaaatacaaaattggccaggcatggtggcgcatgctgtagtcccagctactcgggaggctgaggcaggagaatggcatggactcgggaggcggacttgcagtgagccgagattgtgccactgcactccagcctgggtgacagagcgagactccgtcccaaaaaaaaaaaaaaaa

SEQ ID NO: 8928 - DNA, 164 bp, Homo sapiens
ctggacaaatgacttgaatagacagttctccagagaagatatgcaaatggctcaacattattaatcattagggaacattgttaataattagtggtatctccacagtgagatatcacttcttacccattaggatggmtrtaataaaaaacaaaaaaaaaaaaaaa

SEQ ID NO: 8929 - DNA, 76 bp, Homo sapiens
cttytycgcaacgggtwtgccgccagaacacaggtgtcgtgammactacccctaaaagccaaaaaaaaaaaaaaaa

SEQ ID NO: 8930 - DNA, 361 bp, Homo sapiens
  misc_feature 106,230: n=a, g, c or t
caaacagaattaccagataagccaaaaatactgcttctaggtatacgccctaaagaactaaaaacaggtgttcaaataaaaactcgtatacaaatgtttatagcancattatttataatagctaaaaagtgggaaaaaaacaattgaccatcaatggatagatggataaatgatattattcaatcataaaaaagaattaagtggccgggmacagtggctcatgcctgtantvccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 8931 - DNA, 103 bp, Homo sapiens; identical to SEQ ID NO: 8028

SEQ ID NO: 8932 - DNA, 104 bp, Homo sapiens
agaggttgagacaagagaatcacttgaacctgagaggcagaggttgcagtgcagcctgggtgacagagggagactccggccccctcccaaaaaaaaaaaaaaaa

SEQ ID NO: 8933 - DNA, 83 bp, Homo sapiens
  misc_feature 62: n=a, g, c or t
acagttaactttaggaccatagccaaaagatagaracagcataaacgccaaaataaaaagdngccaataaagataaacacaar

SEQ ID NO: 8934 - DNA, 239 bp, Homo sapiens
attgaaaaaaatcaaagatcatctaaataagttgaaagacaatgttcatggatcagaatacttaatattgttaagatggcaatactctcaaactgctctacagattcaatatgatttccatcaaaatctcagctagctttttagtagaaattgacagcagatcttacaatgtatatagaaatgcaagggatagccaaaaacctaaaatagccaaaaacaatctcaaaaaaaaaaaaaaa

SEQ ID NO: 8935 - DNA, 132 bp, Homo sapiens
maaggccaggmtggtctcgaactccttacctcaggtgatcsrcccatatwggcctcccaaagtgctgarattacaggtgtgagccaccatgcctggcctcaatcwtttcttttaaacaattattcctatatt

SEQ ID NO: 8936 - DNA, 103 bp, Homo sapiens; identical to SEQ ID NO: 8028

SEQ ID NO: 8937 - DNA, 362 bp, Homo sapiens
  misc_feature 106,233: n=a, g, c or t
caaacagaattaccagataagccaaaaatactgcttctaggtatacgccctaaagaactaaaaacaggtgttcaaataaaaactcgtatacaaatgtttatagcancattatttataatagctaaaaagtgggaaaaaaacaattgacccatcaatggatagatggataaatgatattattcaatcataaaaaagaattaagtggccgggcacagtggctcatgcctgtaatnmcagctacgtgggaggctgaggcaggagaatcacttgaacctgggaggtggaggttgcagtgaactgagattgcgccactscactccagcctgggcaacagagactcggtgtcaaaaaaaaaaaaaaaa

SEQ ID NO: 8938 - DNA, 103 bp, Homo sapiens; identical to SEQ ID NO: 8028

SEQ ID NO: 8939 - DNA, 103 bp, Homo sapiens; identical to SEQ ID NO: 8028

SEQ ID NO: 8940 - DNA, 96 bp, Homo sapiens
acagttaactttaggaccatagcmaaaagatagaaacagcataaacgccaaaataaaaagawgccaataaagataaacacaaaaaaaaaaaaaaaa

SEQ ID NO: 8941 - DNA, 76 bp, Homo sapiens
cytwttcgcaacgggtttgccgccagaacacaggwgtcgtgaaaactacccctaaaagccaaaaaaaaaaaaaaaa

SEQ ID NO: 8942 - DNA, 149 bp, Homo sapiens
tttctttttacattgtscctttatcagtttatggtatcarggtgatactagcttcatagtatgagttaggcaggagcccatcctcctccattttttgaaatagtttcaatagaaaaaaaaaaaaaaaaaaaaaaaaaaaaaaaaaaaay

SEQ ID NO: 8943 - DNA, 76 bp, Homo sapiens
ctttttcgcaacgggtttgccgcmagaacacaggtgtcgtgaaaactacccctaaaagccaaaaaaaaaaaaaaaa

SEQ ID NO: 8944 - DNA, 103 bp, Homo sapiens
gaggttgagacaagagaatcactwraacctgagaggcagaggttgcagtgcagcctgggwgacagagggagactccggccccctcccaaaaaaaaaaaaaaaa

SEQ ID NO: 8945 - DNA, 76 bp, Homo sapiens
cttttwcgcaacgggkttgccgccagaacacaggwgtcgtgaaaactacccctaaaagccaaaaaaaaaaaaaaaa

SEQ ID NO: 8946 - DNA, 392 bp, Homo sapiens
tawcaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgchatggcttcatggcattcactgattagtggtaatggtaaamactggtgtgttttgaagttgaatgtgcgataaaattattagccttaagattggtaagctagcaatgaatgctagggtgggaar

SEQ ID NO: 8947 - DNA, 138 bp, Homo sapiens
ctggacaaatgacttgaatagacagttctccawagaagatatgcaaatggctcaacattattaatcattagggaacattgttaataattagtggtatctccacagtgagatatcacttcttacccattaggatggctv

SEQ ID NO: 8948 - DNA, 65 bp, Homo sapiens
gaggttgagacaagagaatcacttgaacctgagaggcagaggttgcagtgcagcctgggtgacar

SEQ ID NO: 8949 - DNA, 96 bp, Homo sapiens; identical to SEQ ID NO: 8861

SEQ ID NO: 8950 - DNA, 95 bp, Homo sapiens
gaggttgagacaagagaatcacttgaacctgagaggcagaggttgcagtgcagcctgggwgacagagggagactccggccccctcccaaaaaaar

SEQ ID NO: 8951 - DNA, 88 bp, Homo sapiens
gaggttgagacaagagaatcacktgaacctgagaggcagaggwtgcagtgcagcctggghgacagagggagactccggccccctcccw

SEQ ID NO: 8952 - DNA, 152 bp, Homo sapiens
ctggacaaatgacttgaatagacagttctccawagaagatatgcaaatggctcaacattattaatcattagggaacattgttaataattagtggtatctccacagtgagatatcacttcttacccattaggatggctataataaaaaacaaa

SEQ ID NO: 8953 - DNA, 85 bp, Homo sapiens
  misc_feature 62: n=a, g, c or t
acagttaactttaggaccatagccaaaagatagaaacagcataaacgccaaaataaaaagmngccaataaagataaacacaaaaw

SEQ ID NO: 8954 - DNA, 96 bp, Homo sapiens; identical to SEQ ID NO: 8880
  misc_feature 62: n=a, g, c or t

SEQ ID NO: 8955 - DNA, 445 bp, Homo sapiens
attgaagtttttaggcagtggaaagtttggggctcttatgaataaggctgtcatgaacatttttgtataaatcttcatgtagacaaacgtttacatttttcttggaaacaagatcgcactatgttccccaggatggtctcaaactggactcaagcaaccctgmctcagccttccaaagtgctgtgattacagagagcttgcctcaggatgctgaagtgtggtttacctacacaggagatgcaaaattacttggaaatttgcacttcattggaggcaacccagaaggaatgactgattagtgtgaaggcgtaaatactctagtcccactaccactgacaaggacaactgcggcatttcccctggctttttgccatgggtggaagctccctgaggtcctcacgagaagtagatgctggcaccatgcgtcttgaacagcctgcagaaa

SEQ ID NO: 8956 - DNA, 96 bp, Homo sapiens; identical to SEQ ID NO: 8880
  misc_feature 62: n=a, g, c or t

SEQ ID NO: 8957 - DNA, 95 bp, Homo sapiens
gaggttgagacaagagaatcacttgaacctgagaggcagaggttgcagtgcagcctgggtgacagagggagactccggccccctcccaaaaaaar

SEQ ID NO: 8958 - DNA, 103 bp, Homo sapiens; identical to SEQ ID NO: 8028

SEQ ID NO: 8959 - DNA, 95 bp, Homo sapiens; identical to SEQ ID NO: 8877

SEQ ID NO: 8960 - DNA, 104 bp, Homo sapiens
aaaggttrarmcaagagaatcacttgaacctgagaggcagaggttgcagtgcagcctgggtgacagagggagactccggccccctcccaaaaaaaaaaaaaaaa

SEQ ID NO: 8961 - DNA, 89 bp, Homo sapiens
gaggttgagacaagagaatcacttgaacctgagaggcagaggttgcagtgcagcctgggtgacagagggagactccggccccctcccam

SEQ ID NO: 8962 - DNA, 90 bp, Homo sapiens
gagggttgagacaagagaatcacttgaacctgagaggcagaggttgcagtgcagcctgggtgacagagggagactccggccccctcccaa

SEQ ID NO: 8963 - DNA, 103 bp, Homo sapiens
gaggttgagacaagagaatcacttgaacctgagaggcagaggttgcagtgcagcctgggtgacagagggagactccggccccctcccaraaaaaaaaaaaaaa

SEQ ID NO: 8964 - DNA, 103 bp, Homo sapiens; identical to SEQ ID NO: 8028

SEQ ID NO: 8965 - DNA, 114 bp, Homo sapiens
tttctttttacattgtgcctttatcagtttatggtatcagggtgatactagcttcatagtatgagttaggcaggagcccatcctcctccattttttgaaatagtttcaatagar

SEQ ID NO: 8966 - DNA, 256 bp, Homo sapiens
gctgggactgcaggcatccgccatcacgcctggctaattttkttgtactttattggagatcctggccaacatggagaaaccccgtctctacaaaaatacaaagattagccagccgtgatggcgggcrccggtagtcctagctactggggagactgaggcgggaaaatcggttgaamccagtggtggagattgtagtgagccaagatcgtgccactgcaatccavvytggcgacaatgctagactccgtctcaaaar

SEQ ID NO: 8967 - DNA, 103 bp, Homo sapiens; identical to SEQ ID NO: 8028

SEQ ID NO: 8968 - DNA, 103 bp, Homo sapiens; identical to SEQ ID NO: 8028

SEQ ID NO: 8969 - DNA, 89 bp, Homo sapiens
gaggttgagacaagagaatcacttgaacctgagaggcagaggttgcagtgcagcctgggkgacagagggagactccggccccctcccam

SEQ ID NO: 8970 - DNA, 103 bp, Homo sapiens; identical to SEQ ID NO: 8028

SEQ ID NO: 8971 - DNA, 152 bp, Homo sapiens; identical to SEQ ID NO: 8665

SEQ ID NO: 8972 - DNA, 164 bp, Homo sapiens; identical to SEQ ID NO: 8086

SEQ ID NO: 8973 - DNA, 94 bp, Homo sapiens
gaggttgagacaagagaatcacttgaacctgagaggcagaggttgcagtgcagcctgggtgacagagggagactccggccccctcccaaaaaaa

SEQ ID NO: 8974 - DNA, 103 bp, Homo sapiens; identical to SEQ ID NO: 8028

SEQ ID NO: 8975 - DNA, 103 bp, Homo sapiens; identical to SEQ ID NO: 8028

SEQ ID NO: 8976 - DNA, 399 bp, Homo sapiens
rmraymcwakgakwaramtraywgmytrgskkswrakmswmkkrrrrrrawmwwksmcwmkkskswwrswgmmtkrmkgrgaaswagymswmtymtrrwryyryrkkactkwraagmwgkagwawmayakmwymawrrtamkywammkskrsmrrrrawyawmyymmarrtmwgmrascyrgaymasagmyywmmyymmrrkwmysagwsmmrkwtrrcasyscwssycmwgakmmmywktsrwsywyssyrctkyrrscccwsmscywktyyrswycascyysyktkrasccmmcccmkwrkmmammymmkmtyckktsamryyrscysakwrrwrmwccaywmktcswwmmcwttggctgattgatgctccatacgtccaaaccttccagtcctcaa

SEQ ID NO: 8977 - DNA, 96 bp, Homo sapiens
gaggttgagacaagagaatcacttgaacctgagaggcagaggttgcagtgcagcctgggtgacagagggagactccggccccctcccaaaaaaaar

SEQ ID NO: 8978 - DNA, 103 bp, Homo sapiens; identical to SEQ ID NO: 8028

SEQ ID NO: 8979 - DNA, 96 bp, Homo sapiens
  misc_feature 61..62: n=a, g, c or t
acagttaactttaggaccatagccaaaagatagaaacagcataaacgccaaaataaaaagnngccaataaagataaacacaaaaaaaaaaaaaaaa

SEQ ID NO: 8980 - DNA, 103 bp, Homo sapiens
gaggttgagacaagakaatcacttgaacctgagaggcagaggttgcagtgcagcctgggtkacagagggagactccggccccctcccaaaaaaaaaaaaaaaa

SEQ ID NO: 8981 - DNA, 92 bp, Homo sapiens
gaggttgagacaagagartcacttgaacctgagaggcagaggttgcagtgcagcctgggtgacagagggagactccggccccctcccaaaaa

SEQ ID NO: 8982 - DNA, 372 bp, Homo sapiens
attaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcagggcccaaaagaaagaggtcatcgaggatcagaacatctgaacagttacgaagcagaatgggacatggttaatacagtttcatttaaaaggaaaccacataccaatggagatctcc

SEQ ID NO: 8983 - DNA, 430 bp, Homo sapiens
cattaattgagtaaaagttataaatagtattatgataacaagagagttaaagaggattgttttcattggagtccagttgcattcaagagagtcattttctctttataggagatgcaggttgattgaagtctaggtctatggagaagggggratgtggaaaagcaaaaaatatgcaaacattttgattggctttacattttattttatgtcagaatcataagtatatatattctctgtactacttgcctttgtggggtaggggctggagatggggtgagcattgctcaatcaaacccawgccctcatcaccatgtgctactgcacccatgaaagtacacagagattttaaaggggaagcaaacattgattgggaggagaaaatatcacagcagaaaaaagttctagaatacattatcatttttcctggggc

SEQ ID NO: 8984 - DNA, 418 bp, Homo sapiens
ttgtaggatagtttttggtttttgtttaagggatagattatatacacaagattgcacatacataagagtgttgagatagaacttgtattttagagatggggtctcactgtgttgcccaggctgttcttaaacttctgggcttggccaggcgcagtggcccacgcctgtaatcccagcactttgggagaccgaggcgggtggatcacctgagctcaggagttcgagaccagcctggccaacgtggtgaaaccccatctctactaaaaatacaaaaattagctggagggggtggtggtgggcacctgtaatcccagctacttgggaggctgaggcgggagaatcgcctgaacctgggaggcagaggttgcagtgaaccgagccattggactccagcctaggcaacaagattgaaactgtc

SEQ ID NO: 8985 - DNA, 482 bp, Homo sapiens
  misc_feature 221..222: n=a, g, c or t
mcagtttcgcgagtactatcagacttgtcttcctgggtattactcgggtcaatgcctgasaccccagcmcccctcatgccccacaccacacccccagggcatcaagaaccaggctgagccccagggatacaacagccagctcagttcctgccctcagactatagaggctggtgggmctatgggcattaaaaagtaattgcgaccgggtgcagtggctcacnnctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgctgtagtcccagctgctcaggaggctgcggtgggtggatcacctgagcccaggagatcaaggctgcagtgagccaagatcacgccactgcacttcagcctgggtgacagagtgggac

SEQ ID NO: 8986 - DNA, 323 bp, Homo sapiens
  misc_feature 108,114,323: n=a, g, c or t
acaacacaatgattagactgacagcttggcttgagatcctaggagaaaaataattgactaggggctaagagacttgaggggaactagcccacttctgatgctgcatrnctgadnagaagtagtatcatagaatcatggtactttaaagctggagagaaacatctcaaaaataagcaacctggaccagagattaractccaggtctgagagccagataacagccctcctcaagataaccagtcaagtttggcactgcaggccctgagccattttggtccaccctgctttgaccccaccccttgtccacatcagctcctgtgaan

SEQ ID NO: 8987 - DNA, 542 bp, Homo sapiens
ttgaggtaaagaagatcaggtaatcaatgtttaagagctgaaggatgaataggaattaactcgataacagggaggaatggaggagaaggaggacatttcaggcctaaggaagagtcagtgcaaaggccccaagagccagtgaggcttggtgcatttaaggaccctactgaaaacaagactgttgtttcagagaataaagagaaaggggagaatagagtgagaaaagactggggaagcttgatcactgaggtcttatgggccattcaaagtgtgtagtttagtcttgattctaagaatagtaagtcactgaaaggatttaagcacaagttttacctgatctgatttgcattactctggctataagaagatgcatttagatatgttactctggctataaaaaggataatttcagtagttgaagagagagatgatggcagcttggttttggacccaggatctttaaattcttaaaaaattattgaggaccccaaagtgcttttgtttatatggcttatatctattgatattcactatatttgtaa

SEQ ID NO: 8988 - DNA, 58 bp, Homo sapiens
ctctccgccagaccgccgccgcgccgccatcatggacaccagccgtgtgcagcctatc

SEQ ID NO: 8989 - DNA, 410 bp, Homo sapiens
tgaatgtccatgtaatttattgaatattgtactgaaagcgtaaaaacagaatggtttatggatactcgaagtatggtttctactgaatgggaatcacctttgaccatcttgaagttgcaaaatcctaaactgaaccattgtaagtcaggcaccatctgtaaatgtctcatatttcctactgggaataaagtttaaaatgaaataactgattttctgaaactggcactcaatttaagtcaaaaatagtttaacagtaaggcttgcattgctaggacttacagctttagtgggcagaagtatcatcaggggagcgtgttaaaatgcatattctcctgagacgagattgcgccattgcactccagcctgggtaacaagagggaaactttgtttcaaaaaaaaaaaaaaaaaaw

SEQ ID NO: 8990 - DNA, 247 bp, Homo sapiens
ttttttttctttctaaggtatgtattgtgtggaggagcattacgtattgaacttctcacaaaacagggctgaagcagtgcctactcgacagaaccggtcatcgtacaaagaaatgccacgtgactcaaaggcaaagccagagtgcagcttggagcaaagaagatgatgtctcactctgtcacccaagatggagtgcaatggcacgatctcagctcactgcaacctctgcctcccagtagagacgggg

SEQ ID NO: 8991 - DNA, 89 bp, Homo sapiens
agaagagagaagtttaatggggaatctagatttgtataggtagagagatgagaggaagatgtttactaacaaggtttaaaaaaaaaaaa

SEQ ID NO: 8992 - DNA, 478 bp, Homo sapiens
atcaaagaatagaaggggaaaaaatgaggagtggaaaagctcgatttaacctttaagtacagataactatcagggtatgaaaaggcaagaaaacatgacaaaatgaaaggattattgatgggcaataaaggaagcgtagtaggtttaccttgagatttcactgagctaatatactggctcccatttctatgtttattgtaggaaaaagagaaaaacactaatccagggatagagctgactagggatgcccaagtcaaaaagactttgtagcactgggcttkgcagagggtcctgaagctaaatgcagaaaactgcgggaaatgtcttcaactggggctaaaggtcgtaagcaaggacaatgaacctggaatttggaggaattcatactccagtgaagaatttccagacccctcatgaaaatagcagattgcctactcaccagagaatactcaagctgaaactaagcagcccctggagg

SEQ ID NO: 8993 - DNA, 530 bp, Homo sapiens
aacaaaaacaacaacaaggaaatagagaagcaagagcaaacaaatccaaaagctagcagaaaacaagaaataactaagatcagagcagaactgaaggagatagaaacacaaaaaaacccttcaaaaaatcagtgaatccaggagctggatttttttgaaaaaattaacaaaaaatacctctagctaaactaaagaagaaaagagagaagaatcaaatagacacaataaaaaatgataaaggggatatcaccattgaccccacagaaatatacaaattactatcagagaatactataaagacctctacacaaataaactagaaaatctagaagaaacagataaattcctggacacatacaccttcccaagactaaatcaggaagaagtggaatgtctgaatagaccaataacaaattctgaaattgaggcagtaattaatagcctaccaaccacaaaaagcccaggaccagatggattcacagccaaattctaccagaggtacaaagaggagctgataccattccttctga

SEQ ID NO: 8994 - DNA, 522 bp, Homo sapiens
cacagaactttggccccctaactctggctgcaaaccagacttatctaggagactttgaaaagtagattccgggccagatgcggtggctgacgcctgtaatcccagcactttgggaggccgaggcgggcggatcacgaggtcaggagatccagaccatcctagctaacatggtgaaaccccgtctctactaaaaatacaaaaaattagccggatgtggtggtgggcgcctgtagtctcagctacttgggaggctgaggcaggagagcgtgaacccgggaagcagagcttgcagtgagccgagatcgcaccactgcactccagccttggcgacaaagcgagactccatctcaagaaaagaaaagtggattgcaggccaggtgcggtggccctcacttgtaatcccaacacttggagcggccaaagctggaggatcgcttgagcccaggagtttgaggctatagtgagctgtgatcataccactgcactccaggcagggcaacagagaccctgtctcaaaaaaaa

SEQ ID NO: 8995 - DNA, 206 bp, Homo sapiens
atccaagttcccacagctaccaagtggtggttgtggaattcaaaccatggctctcaaacttcagagtccaagggtgcggtggcacgtgtctgtagtccagcactttgagaggttgaggcagaagaattgcttgagtccaggagtttgaatccatcttgggcgatataatgagaacccatctctaaaaaataaaaaaaaaaaaaaaa

SEQ ID NO: 8996 - DNA, 62 bp, Homo sapiens
gaagggatagaggccttggaccaagatatacaggtatctttttttttttttttttttttttk

SEQ ID NO: 8997 - DNA, 526 bp, Homo sapiens
tctagagatgatttaaagggacgggaagatatatgtaggttatatgtaaatataccattttatataaggaacgtgtatatccatggattttagaatctgtagggattcctggaaccagtcttccatggataccgagggatgactgtattgttctgtgaaatttttgtcccagctacatatttgtatgtatgtatgtttttggtccggtataattgtataatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatat

SEQ ID NO: 8998 - DNA, 603 bp, Homo sapiens
atattaaataactttgtcccagagagaaagagagagtgggcagacatcgaagccaaacagcagtatcccggaagcactcatgcaactttggtggcggccactcagttttctctgccagtgtctggtaaattcctctattttgtcctaatctgacaatagtaaatagtaaatttccaaaactgtcgtttcatcatcagtttcagcaccgtgggcagctgctcgggtcctctcttgttgccccaaacctgcccggctattactgttcgtcagtgatgcagcagaaacagtgaaaactgatgcattcctttcaacaatgatgtgtttgttctccaaggagaacatctgcagtttttgatacaatataaataagtaaggtggctgtgctccaaagagttcttctggagaaacagatcaattcaagatttaaggtagggctttcaagagtttatgctatttaagcacagttttttaatgggtggacattagctccatctcgaagtaacaaaactggacagtgatagcaattaaaaagactttaaacaggaggtaagaagtgtagtgcagtgctgtagtgcaggaagtgtagtgcagtgctgtagtgca

SEQ ID NO: 8999 - DNA, 521 bp, Homo sapiens
ttaaaacaaaaatgctaggacagaaaagcaacatcggttagtacatccacgtctaaaagcattctataaataggccttgtttagctacacgagtctgcttagcagcccatggggagtgaggtttcttttaaagaaaatacagtatcgctcaaggtcataaacttcctgagtcctcctattagtgttctcatccccgtagtataacaaatgttttattacaactaaacagtgtaaggcctaataattaatgggtaatcaaaaacctttcacaatatcaccttttatctccaactatcggtctgtgccacaatggtgagtgcgtgctctaaaaacattcatattgtttagatgtacttcagataatcttctataaaaatagttatttgtacaaatgtttttaagatagtcttcaaatgagaagtttaatgtcttacctaattcatccacaagcaccagagaatgtgctgttgcatgcatgagtatgctggcagtttcacttaattcaacaaaaaatgtacttt

SEQ ID NO: 9000 - DNA, 169 bp, Homo sapiens
actttgaaattagccgggtgtggtggcacacacctgtagtcctagctacttcagaggctgaggatcacttgagcccaggagtttgagactacagtgaactatgattgcaccactgcactccagactaggtgacagagtaagaccctgactcaaaaaaaaaaaaaaaaaw

SEQ ID NO: 9001 - DNA, 446 bp, Homo sapiens
cagcacgagattttaaaaactcaaataagattgtgttattcacctgcttaaaacctttcatgactttcagtgtcacgtagaacagaaaacacttttcttaccaaaggctagagagctctacgtgatctggctatttttaacgtttcattgcactcamccttttcctctataatcaaactactctgatctcaagggttagttcttgaaagatgatcatgttctttaatgactttaggtttttgtgtgttattttctatttctgggatgtttattctctgttccttacatgctggcccttttgcatccttcttcaggtctcagcttacatgttaccttcaagaagcctttgaccactctaagtgggcccttccttccacttctgctgtgtaatcccactcccttctcccacttgttaattagttacatacttttttgtaattgtttat

SEQ ID NO: 9002 - DNA, 341 bp, Homo sapiens
tattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaacccgcaaaaaaaaaaaaaaa

SEQ ID NO: 9003 - DNA, 381 bp, Homo sapiens
caaagagttacttgttcagggggaaggagggagctacgattgagtcagggcatgtggtggggtttctgaggtggccggcacagttctatttcttgatttgggtggtggttataagggtatttgccttatcataactcctcaaactctagaggaagaagtctgctgtgaagaaaagattaaggccgcggtggctcaaacctgtaatcccagcactttgggaggccgaggcgggcagattgctcgagctcaggagtttgaggccaggctgggcaagatggcaaaacctcgttcctacaaaaagcacaaaaattagccaggtgtgatggcgcatgcttatggtcccagctattttgggggttgagggaggagaattgcttgagc

SEQ ID NO: 9004 - DNA, 171 bp, Homo sapiens
ttttattcagctttattctaggaatgaaaattggtctaccataagctactctatcttggaagtagaagtggcctattcattttttaaaaaatcatttttcctatactgatacagaaaaccttatctttcatatcttcttttgttacctaggtaacaaaaaaaaaaaaaaaa

SEQ ID NO: 9005 - DNA, 366 bp, Homo sapiens
tctctagtagtctattatcttgcagtctgttttgtcctgtgttcataccattgctctgacttactgttttcagcgaaaatctttttccattcttttcctttaagctcctttatgtttgtatttaaagtgattatttagtagacagcacgtaattgcaacttgctttttcagttcctaactctgctttttaattagattgagtttttgttgttaccttttaaatttttttaattttaatttaatttattttttctagagttgggatcttgctctgttgcccatgctggtcttaaactcctgggctcaagcaatcctcccaccttagtctcctgtgtagtcccggctacttgggaggcttgggcaggw

SEQ ID NO: 9006 - DNA, 349 bp, Homo sapiens
tgtagatcaaagaacaaatctttaagtcctcctgttcacctgctttactggcagatgaagcctagtcatggttcaccagggggaataccaaactcgccctgcagatcggtagtaattgtgcggagatgataggaaacaggagaggsctctaccgctgaaaagcacgggtctgaaarggcaggtgcctgtcctggaaaccaccttctcttggggcatccctggctgcccttctgcctgttgccaccaggtggggctctctcccagctcaccgttcttcctgcttaggacagcgccccacgtgacgttagtgaggcaatgcatgggaaactgcagcccaaacagactcctc

SEQ ID NO: 9007 - DNA, 452 bp, Homo sapiens
tatatttcatatatgggaatttaaaagttattttatatcctgttgtgctctgtagagagtggattaattcaattacatctttgcatgtgactaacattggagttcctaaagaaagccctaataaccagcatctctgggagtaaacggcttgcctgtttgtctcgtctgctacacatatgaagccacgcgtgataaggcatacctctagtcagcttctaacatgagcagtaggcgaggaaatagacaaataccagccattcttaagaaaagccatagaacaatgtttgttctgggaaaaagacatttattgcttttttatgcaaaggacagaaatatgatgtgtctttcaactttgaaaaggtaaggtatcatggaacaaagcctattccacttgaagtcctgattcttccatgatacatccctctaagagatcagaaacgtaaaatcagtgt

SEQ ID NO: 9008 - DNA, 425 bp, Homo sapiens
ttccattattccttagaaaatattttaaatttgccctcagtgagacatttgcttaagtcagtaataggtctgcaatttagtgtcaggcttgaaatgtgacctagtgcggctcaggagacggggtattagggttggtagattgcccgtgaaagtctttgcaagccaaaaattcatggatgaagccaaattcaggagctttgtcataattagacagtagagttcagagtgtggtttcttgatacattctttgtggtgctttccttttgcccttgattgcttgttttcccgcagtaatggttactctctctcaggttatttgaggagtaagtaaccgtattctaaatgtggttggtgaaacagcagcatcagcatcacctgagagctaggtggaaatgcagaatatcagacctactgaatcagtatct

SEQ ID NO: 9009 - DNA, 422 bp, Homo sapiens
tgaaatcgagactatttatttggaatatatacaacagtgtttttccactgtatttcatttgcaaaagttgagaactgctttctctaccttttgcaaaataattgatattccatattggattctcaaagacttcgatatggtgaacctawtwaamcctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtvaccagtttcatgctgtgtcattcacactcactacttaatactgccatggtgaaaatgtggaggaaaaatgtatccatgtgtgtctgggaagcatatacacttgtacat

SEQ ID NO: 9010 - DNA, 405 bp, Homo sapiens
acaacaacgagctggtcaagtgtgagcggcgcatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgcacagcgccgcccctcccggcccccagcaagtgtgtgctcagagcatctttgttcttcacggcagcagctaccttccctcactgtctcaggtgccgagaggggcaggtgccagcctccactggcatcagtgacaagcccagggsacagccacccgggggtcctcgcttcatgctcacacaggctatggggatg

SEQ ID NO: 9011 - DNA, 380 bp, Homo sapiens
aaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagt

SEQ ID NO: 9012 - DNA, 468 bp, Homo sapiens
tacccaactaaacctagtgtgctacacattctaggcacttgacaagtatttgtgaactaataaaatgttcaaagaaagtggttgcttatgaaataaaattggacctaggtgtggccatatagagggaagaggtatttgggttcactatgaggaagacaagcagtaagaactcttaatccaaaaggcaatagtctcccatgtgaagaagtgtcttcctcgtccctggctaggatagccagtggcaatattatttttatatccttctttaaacaattacttattgtgcacctactgattgcaggctactgtggtgaggataaattgccaaccaaagcagaaaggtctctgctctcttggaactaacttagcatctagtggcatagagagaaagtaatccaataatcagaaaaataaatccataagtaccaactgtgatttattttaaaagtcaagaggctggccaccgta

SEQ ID NO: 9013 - DNA, 443 bp, Homo sapiens
catggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaaaagagaaaaaar

SEQ ID NO: 9014 - DNA, 81 bp, Homo sapiens
taaattttgagcccattgttacaattaagtctttctgagagtattttttataccctgtatttttctttctttttttttttw

SEQ ID NO: 9015 - DNA, 381 bp, Homo sapiens
  misc_feature 167: n=a, g, c or t
cagttaatcgatctgaagatacttagtagcaatgagattttgtggtgaagctatatggattcatgcacaaaaagggctaaaagaatttcaggactgggyatagtggctaacacttgtaatcccaacactttgggaggccaagacgggaggcttgcttgagccccagnagtttgagaccagtctgagcatcatkctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaa

SEQ ID NO: 9016 - DNA, 515 bp, Homo sapiens
caatttcaacttttatgtgaagcatatttcttgtctgactttcagaaactgtttatgtgttccaaactttcattcttctatgctagttttccaaccctgattaaataactttatttaataaccagctttggtccctttattatcaacttagaaaaataagctaaaatgtatatatttagcatttatatatttataatgtaatacctacatgtctaaatacagaaatacacattttgtctctttttcctttacaggatatgtaaaactcaatgcttgttctatagaagaatgcataaaatttttagtgatttagaaaatgtatgttttcttgaagcccttcaggtagaatttggccaaataaagaatagagtatcacataaactacttaggaaatgaatcattcgtctctataaaagtaagggagatatgtctaattctagtcaggatgatgacatggggcaaaatgtgcctctttctgctgtcatttcaaacccatcccgagtgagccagaaagg

SEQ ID NO: 9017 - DNA, 442 bp, Homo sapiens
cgtcatttaggcttttgggatttgttggtatggaaaaatacatggattctcatggtactcggtggtttgagtagtctggcgttctctaggacactgtggggaggtaggacgcagttgtctgcccctgtgccccaaacattcagctcaggatggctgctgagctkggktttgggaaaactcacaaccctgtggatgtaacaggagtcagcagttttgatcactggttcatggaaacatgtgagaatatatatgaacatcttttgagtcttgctggtattgtcattcattctttcaatcactaattcattcatttatacattcagccccttgtttaaatatgtgcttcctgccggtcagcaggaagtcttaagaatggagcctggggtccaaatgagagccctcagtggctgttcaggggscaatccgttatgtacagtgggtc

SEQ ID NO: 9018 - DNA, 460 bp, Homo sapiens
tttttgggaatccctgtggacagatctctgttgaacaacaaaaattagtcacctatttaaactacaaagagcacttgtgattgagttaatgtcccatgcatgggaattaactaatcattagaaattgcttttgttaaaatggggaaaggatttcctatttaataaatggtgctgggagaacaggctagccatgcagaaaattgaaactgaaccccttccctacaccatatacaaaagttaactcaagatggattaaagacttaaatgtaaaactcaaaactataaaaactctagaaggaaatctaggtaataccattcattcaggacataggcgcgggcaaagattcatgatgaaaacgccaaaagcaattgcmacmaaagcmaaaattgacmaatgggrtcyaattwagctaaagagcytctgcacagcmaagggaactatcatcatagtgagcacacm

SEQ ID NO: 9019 - DNA, 261 bp, Homo sapiens
tttcaagtaaatctatagacccctgggaacttaaagatatgaaaataggtctaaaagttctccacaacttttttaatgttattttttcattttgatgatgatcttttaaaaaatacatggtgggcccaggcacggtggctcatgcctgtaatcccagcactttaggaggatcaccaggaggatcacttgagcccaggagttcatgaccagcttgagcaacatagtaagaccctttctctcctaaaaaaaaaaaaaaaaaar

SEQ ID NO: 9020 - DNA, 411 bp, Homo sapiens
caagatgagatttgggtgggtacatagccaaaccatatcaatgtgcaaagtctgatttgaagctaagccttatgctatgccctcaaaagagatgctacctaagttaatcacactctgaaaggaagaaggcaaaccgccccagggagagattattagcattcctgggaaactcagtggcctattgcctgtgagaaagacagtctgacgcgagtacagatctctgatgtggtaggggaccagcccaaatggaggctggcctagagtcatcaaaaaatgtgtttgtgtgactggagtctacatttctacaggtcaagagtcaaagaggggctgtgacacttcatctctgtgccaagagtcagcagagtgttttttgatctgagcacataggcacagttcttttgttgcctcttc

SEQ ID NO: 9021 - DNA, 303 bp, Homo sapiens
agmaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcytttttgacccttctggatttccgtttccwtwtctgtaaaatgaggagcttggaagatccggaaaatgaggcccataggaaacaagtgacttgctgagtccagataacactgactgtcagaagtctcgctctgtctccccggctgg

SEQ ID NO: 9022 - DNA, 281 bp, Homo sapiens
ctaaacgaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctggccaaatatgcactttccctagagagccatattycagcagtgaaacttgtgct

SEQ ID NO: 9023 - DNA, 509 bp, Homo sapiens
gatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataaagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcytaaatattgtacactgt

SEQ ID NO: 9024 - DNA, 387 bp, Homo sapiens
tttttcggaggctgccagcgtcccacaccatccgcagtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgtacagtgcttggtactgagtaggcactccgtcagtattttagtagctattattccaaaggacactgtattctaggtactaagacaatgtgaatggaatggaaaacaattcctccctgcagaagccaactgtctaggaagacagataatgacattattaaaataatcagaacattggcaaaataaagaagattgaaatgcaa

SEQ ID NO: 9025 - DNA, 76 bp, Homo sapiens
attgtgsggctgsaggaggtgtcgagcggcgttatttttttttgcggtttgcctttttttttcttttttttttttk

SEQ ID NO: 9026 - DNA, 472 bp, Homo sapiens
tatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttycagctgggtgtcagccaggtgtggtggctcacacttgtaagcccagcactttgggaggccgaggcaggcagatcatctgaggtcaggagtttaagatcagccatgaccaacatggtgaaaccccatctctattaaatacacaaaataaaaattagccaggcatggtggcacacgcctgtcatctcagctactcaggaggctgaggcaggagaatcacttgaacccaggaggcagaggttgcagtgagtggagattgcgccattgcactccaacctaggcgacagagtgagactccgtcgcaaaaaaaaaaaaaaa

SEQ ID NO: 9027 - DNA, 315 bp, Homo sapiens
agcaacctgctctggtccctttccacactgtggaagctttgttctttcactctttgcaataaatcttgctgctgctcactctttgggtccacactgcctttatgagctgtaacactcactgcgaaggtctgcagcttcactcctgaagccagcgagaccacaaaacccaccgggraggaaggaacaactccagacgaacaactccagacgtgccgccttaagagctgtaacactcaccgcagaggtctgcagcttcgctcctgagccagcgagaccacaaacccaccagaaggaagaaactccaaacacatccga

SEQ ID NO: 9028 - DNA, 385 bp, Homo sapiens
cattgggaagsctatgaggsctttacatttttggtgtgagatggggaagaaacataaaatgccactttacaacttcaataatagcctgtaatttakatttactgtgtgaatttttagtcctakattttaataatttgtaaattgatctcttattccaagaatcctttgaacttgtagamcatctgggagtccacttccctgtcctcttcctgatccctgctttctggactgtktaaatcctctttgggatggatcagagagtctagagaggccactcataggtccagctgctggcctcctgactctccaaagccttcactggaattgggacatttgctccagccctagctgtgaacatgaccagagacattatttataattcagc

SEQ ID NO: 9029 - DNA, 465 bp, Homo sapiens
ccacttgccaatcgtgtattcaaagttaagcctagttctatactcagatctcttttcccctattgcaataatcttgaataaaatttgtttttaccactttaagtattgtccatctctggttttccctgacacaaccatgtgacttcttacattgtttactgtttgcttatcttaactcattcttcaaagctaagatgctgattcaaacacttatttctacttgcgtgagaaatataaaagtctgaggtctagtgtggtactaattcactataattgaaagaagtgcttgacctataaatgaagcttatgcttaccttagaattgaaacatatggctgggcgtggtggctcacacttataatcccagcactttgggaagccaaagcaggcagatcacttgagcccagaagttcaaaaccagcctgggcaatatggtgaaacatcatctctaccaaaaaagtcagaa

SEQ ID NO: 9030 - DNA, 470 bp, Homo sapiens
ttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccatgaggacatcttagcaagggtgcctgcgagggagtgtgggactgggcctcatcctcgccgga

SEQ ID NO: 9031 - DNA, 484 bp, Homo sapiens
tagttatctctcaaatatatttatatcattaattgctaaagtgtacattgatttcatttattcttgttacagaggtaaaaggtcacaaaaatcttgtgttctaacagcatttcaacggaaactcaattacactctgaataagtcaattttcaattawtcttttgagagcttaagtatctttctcttataaataattacattgacctaaagaatagttcctaattctatgaataattcctaattctatgaagtataacatatgcctaatgaagcatagaggctacccatgtaatgtggtttctatcttataatatttgaggatgataaagtctttaaattaaacttactgtgctaaattagacagaaaattttatttaacatttttctaaatgtatgtataaaaatatcatattattttgacctctaatatcagtatgaataggggttcaaaagttctgcttactaatatagcaagtatatgtgt

SEQ ID NO: 9032 - DNA, 62 bp, Homo sapiens; identical to SEQ ID NO: 8200

SEQ ID NO: 9033 - DNA, 136 bp, Homo sapiens
tgttatgtagatgttctttagaagatctggccatttggtacataatccagcacagataagctgggtggtaatgataataaaaatggttttctcaaaaaaaaaaaaaaaaaaaaaaaaaaaaaaaaaaaaaaaaaaw

SEQ ID NO: 9034 - DNA, 422 bp, Homo sapiens
cttagagctgggccgccttggccctgctggccattagcgcgacttggggttattcagtacacttcttgtttgcagatggtgaagagcgctcgcccggtagcagaaccgaacccgggcttctggtctcagctccagaagtatgaggaggccctccaggsccagtcctgcctgcagggagagcccccagccttagggttgggccctgaggcttgaagcttgaaggcctgctgcctggaggaaggatgtccctgcactgatacagaagctgtttctggcaaagcctgccgtgtcttacatttgtctctctatccggattagatgttgctatatgaacacatcgggactgtgtctgcaggaaggagctccccattcgaggccttcacagtgtcacccacattcasctctttccacttaaacgtgtc

SEQ ID NO: 9035 - DNA, 83 bp, Homo sapiens
gcaatctcttgacctcttgatctacctgccttggtctcccaaagtgctgggattacaggcgcgaggcactgcgcctggcsgcc

SEQ ID NO: 9036 - DNA, 280 bp, Homo sapiens
cctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagbrrattggcccgaagaaggcccagctaatcgtgggctggcgggastccacggccccttcagccaggtggaggacctggaacgcgtggagggcataacggggaaacagatggagtccttc

SEQ ID NO: 9037 - DNA, 117 bp, Homo sapiens
cataccactgttgaacatactttagacstgatttattccacaactgcttgagaaaggtcctcttttaaaaattttgttgtaataacaaamcamcatgaaatataccctcttaacaaa

SEQ ID NO: 9038 - DNA, 72 bp, Homo sapiens
attgacagaatggtgtagtagtagatggggtggagccgctgggtggggtcgagactggcagctgagagatac

SEQ ID NO: 9039 - DNA, 471 bp, Homo sapiens
caaaattgaaatgatagtaattttagggaaaaatcttacttccctctttaaaaatacgatttttttttccacattgaccctttacctctgtgtgtactgagcctacttgcttcctccaagtttctctctcctgggtttatggaggaataacccaatgcagataatttttgacatcaagcctttgtctttatcatctttactggtttagaaatgtcaggttagccgggcgcagtggctcatgcctgtaatcccagcactttgggaggccaaggtgggctgatcatctgaggtcaggcgttcgagaccagcctgaccaacatggagaaaccccgtctcttctaaaaatacaaaattagctgggtatggtggcgcatgctgtaatcccagctacttgggaggctgaggcaggagaatcactcgaacccgggargcggaggttgcctaggcaacaagagtgaaactccatctcaa

SEQ ID NO: 9040 - DNA, 139 bp, Homo sapiens
kkgtctgagaaaacaatggcctcaagggaggggccttgggccaccctcacagggggtctctgtgtgatctcttgggatttctccttgtttttgtgagtacctgggaagtgttgtttgttttcttattttctttttaatt

SEQ ID NO: 9041 - DNA, 523 bp, Homo sapiens
ccagtgtgactagagccaaatacataaggctcaaaatagcagatgacaaggacagaagggtaatggaaggctggcttttgtagggtcttcttggccattgtaaggactttgacttttactctgaatgagatgggaaccctgggagggttttgagcagaagaatgactttggttttaacaggatttctctggctcctgtgtagattgagggggcggggggcagtatacaagcagggagaactttgggaaactcttgaaattattgaagtaagagacatggtgtttggatcatggtggtagtggtggaattggaattctgagtatgttttgaaggtagacccattgggatatgttgatgcattgtgaaagcagggagtccgagacgatgccagaacacagttggaagacggagttgccatctactgagatggggaaataggaagagcacatttggggaaaagatttaggagtttgattttggatgtgttaaacctgatgtgagaggggatatcaagtagatagtg

SEQ ID NO: 9042 - DNA, 432 bp, Homo sapiens
aataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaat

SEQ ID NO: 9043 - DNA, 455 bp, Homo sapiens
atttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctarctttcttcttgtctagctattarcatgatttgtcaaatgcatgtttttttcagccaaagccttgtttccatttttgttgatgtgtactcttgctcttttagctagagtgtatgtgaaaataaagaaatacatcattgtattcacaaaaaaaaaaaaaaa

SEQ ID NO: 9044 - DNA, 287 bp, Homo sapiens
gaccttttgcatttggattctttcacttggcatattgttttgaagtttatccatgttgtagcttgcataagtacttccttccttttgagaccaagtaatattccatatggatacactgcattttatttatccattcatctatttgtagatatttgggttgtttctaccttttggctaccatgagtaataccgatagaacatttgggtacaggtatctgatggagcatgtaactgtattcaagtctctggggcatatacctaacaacgatattgctagctgtatagta

SEQ ID NO: 9045 - DNA, 372 bp, Homo sapiens
cccctttgttaatctatcttgaattactcacttttaggtttcagctccctactgagaccccaacttgctttaccttctgttccctcctggttctgcttatcttccattgaccctgtggacctgctttctgtcattgccttccctgccctcagtctcaggagcctgagactggcttctagatgggtttggacaatggatagcactggcaggaggagagtagagttgctgtgtttattttcctggtttcctcctgcaagatcatgtcatgttggctctcccagagggcatggctcatatcatggggccctctttgtctttccaagcctgtagatgatagcagcttcaggaggttgcactatcttttgactgtgc

SEQ ID NO: 9046 - DNA, 508 bp, Homo sapiens
ttttattttcatccatttcagtccaaccaccttccccttctccaccaagtttcagagtatacagctcctcaaattcaatttctctggagactaaaccactggtcttctgtgggtttggggactgggaaaaggaactttggtggggktggtctaagkgsykacatacagtgtttctaccttctgtttttagtacagtaacttatccctgcctaccttggtactactgtacacttctaatttatgaccatctccaggattcttatggaataaaacttgtkdctataaccctctctgctgccactccatttatagcttctttcattctgctaaatttaattagcatcatccagaaatgtgttaaaatctctcttcccctgttgtcttctctcttttgtatttttcgtattttattgtcattttaatgagtcagggtggagaagaaatagacacagtgtgctatagttaatcagaagcctcatggttctttttgagatggggtcttgcctgc

SEQ ID NO: 9047 - DNA, 467 bp, Homo sapiens
ctttggggtgactcttagatcaggtatggtcttttattcaacatgtagaaatggaaaaaatacctgagaaagatacttatattctctagctttcagttccaatttcattttcaagtggcaactcagtatgaaagtatgttcttttggccgggsaaaggtgactcatgcstgtaattccagcactttgggaggccaaggcaggcacatcgcctgagctcagcagttgcagaccatcctggccaacatggtagaaccctgtctctattaaaaaatacaaaaaaaaaattagccaggtgtggtggtgcatgcctgtagtcccagctaatcggaaggctgagcgggaggctgaggctggagaatcgcttcagcccaggaggcagagaggttgcagacagccgagatcacgccactgcactccagcttgggctacagagtgagtgagatgccgtctcaaaaaaaaaaaaaaa

SEQ ID NO: 9048 - DNA, 461 bp, Homo sapiens
tatgagttgtaaatttatacaggttataaacttacaaaaaaatgacagaatttcaaactaatagaaaactccatagtcacagtggaaaatcttaccactttacgcaataattgaagccgagcagtgtggcaggtgcctgtaagtgctagctaactaagctactcgggaaactgagaaatcacaggtgggaggatggctgaagcccaggagtttgagttcagcctgggcagcatagcaagacctatctctaaaaaataagtaagtaagtaaataaataaataacaaaacaagcagactaaaaaatcagtaaagatagagaaataagggccaggtgcagtggctcacacctgtaatcccagctactcgggaggcttaggcaggagaatcactcgaacccaggaggtggaggttgcagtgagctgagatggcaccattgcascctggccgaggcgacaacagca

SEQ ID NO: 9049 - DNA, 232 bp, Homo sapiens
ctatgctgcatctgaaatctatgaaatctatcattgtctatagtatactgtgattctccatgtttaatattgtataaaatttaactttatttaatttaaaaaatttacttttaattttwatttaatggctaaattactacttgagataaattttgagaacaacattrmcaaaaccacttgaggccaggagtttgagactagcctggtcaacatggtgaaaccccatctctca

SEQ ID NO: 9050 - DNA, 132 bp, Homo sapiens
ccataacatcattaaaaacatttgttttgtytwgtyttgttttgagacaggagtttcactcgttgcccaggstggagtgcaacgacgcgatctcagctcactgcaacctccggcctggacgacagagccggr

SEQ ID NO: 9051 - DNA, 434 bp, Homo sapiens
ggacacgggagcaagatggcgattccgggcaggcagtgagtgatccgggagttagggtcaggctgggggatgagaaactacggcgactgtatctttggccgaggagttttaaatgcgctggaagtgaagggactgtgtcgtcaagggtagagacgggaaaaaacgagaagtcctgaggaacatagattcccctcccccgtacattttcccggatggaagcccgaagtttgagggagaaacttgtgaggaaataaaggaagttaggctgaggggcagagagcgagacttttctattttccaaaagctcggtctgaggcccctcagtcttgcttcctaacccgcgcttgagtttctccccgcttggatgctctcaggggcagtgtgaagagagacagttcctggcttccttagagggccttgttctccttggcaga

SEQ ID NO: 9052 - DNA, 63 bp, Homo sapiens
ttdccactgcactctagcctgggcaacagagtgagactcttgtctccaaaaaaaaaaaaaaaa

SEQ ID NO: 9053 - DNA, 438 bp, Homo sapiens
cttttttaagatgatcttgctccgtcacccaggctggagtgcagtggcgtaatcatggcttcctgcagcctcaaactcctgggctcaatgagttccttgagatcttccatcctcagcttcccaagtagctagtagtagtagtggcttgcaccaacgctccctgcctaattttcaatatttttttgtagagatgggatctcactgtgttacccaggctagacttgaactcctggcctcaagcgatccttccgccttggcctcccaaagtgttgggattacaggcattagctaccacacctggccaaggcccaggtttcgacagaaagggagagaaaacctgccagagatgccatttcggagccactctgcttggcagggacctgtgttcccctcatgcaggttcatccttagagggctgcggtcttatctggttgtgca

SEQ ID NO: 9054 - DNA, 392 bp, Homo sapiens
caatcgttgttacagataattctgctgaagtttgtgtaagtaaaacttatgtgaaacagtctgattttatcttggagagttaagttcatgattttgtgcaacttctgaagaaattaccatgtattcaaatgtgactgtacttgctcacagcatttatgcaaactgctatcttataactgtcaatagagaatattcacatctacaaagaatatatcttatttcattacaactttaagatacttcacttgatgtaatttttttctcattcttcctcttttaaaaatgttgcttagctctggctgggcgcagtggctcaagcctgtaatcccagcactttgggaggccaaggcaggcagatcacgaggtcaggagatcgtgaccatcctggctaa

SEQ ID NO: 9055 - DNA, 404 bp, Homo sapiens
agtgggagmagcggcagagcttcggctgctgctttcaggctgccgctgcattaggggcttcctgaggaagcgcgggcggacgacagaggatgccgaaccactccagtgagtaagctgtccgcgcagaamvygaacttgccvttgacaacttccccsggaaagcggagggacctcctcgtcccaaggtcctccggtacccggaggtcacgcgcggacgtcggagccggagtgggtgctggagggctgggtccgggtcccgcggtgaggcgtgggttgtttcctaagtgtgggtgcaaagtaatgggcgctaggcgctggcgtcggtattcagcccagctgcacatctgaggcttggcagcttctcatagcgccttatcctctgccatacagcatccatctggagc

SEQ ID NO: 9056 - DNA, 149 bp, Homo sapiens
taatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtat

SEQ ID NO: 9057 - DNA, 386 bp, Homo sapiens
agdtgargcatttacctatctaggtaagtcakgakgagctcaaaaggagragaaaacagtaggaggcagggkaagcagcctctgtctccatctctgscctttgaaacaaaagggtatttcttttctctcttcagcccccaacccagtgggagaagtgatagcdgctacgasttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggwgascatcactcagcaaggacgaacgccaakgacagtaactga

SEQ ID NO: 9058 - DNA, 381 bp, Homo sapiens
  misc_feature 148: n=a, g, c or t
tcaaagtgagtctgttcctacattcacattgtcttggagagacaggtttgcatagttgtttacagaggcaggctctgagaggggtgagcctgggtttcagtcttagttctcttgatcttgggaaagtcacttaacctcccaackagkntbcyysakgtataaagcggagactgtaatattacttatgtcctaggatggctgtgagaattacaggagatagataaagagcacttagcccactgcctggcaaaagcaagcattcaataattatcagatatcactagtaattaataatcaggtagtgckattgttaacgttatcattacatcacagcactgcagaagatgaaagggcacctagaggttttttgaaaacacctgc

SEQ ID NO: 9059 - DNA, 79 bp, Homo sapiens
  misc_feature 79: n=a, g, c or t
awwtttcgcaacgrgtttbccgccagaacacargtstcgtgaaaactacccctaaaagccaaaaaaaaaaaaaaaaaan

SEQ ID NO: 9060 - DNA, 459 bp, Homo sapiens
  misc_feature 378: n=a, g, c or t
tctcaaaacaactcagtgaggttgatacaggtataattggtgtcttttttttcttttttctgacactggcatatcgaggcccaaaggttaagtaatctatgcaactaggaggcagtagaactgggatttaaacttagactgcctgtwrraggccatgtycttaaccactactagatttttggcgtccagatgtcccttgtatttctaacttccgtttagtttttctacctcccattcaatacatccattcagttaatctcaagtgcctgcctctttcccttgacaaaacacacttgctcattctttattccttgccacattaaagttaacactatcctccccatcgctagtactatagaggtcattgaaccttccccntgcgtatggcctgtgagttttattgattccagcatgattatttggtgatatttgagtgcgattttgtgctagatcctgggs

SEQ ID NO: 9061 - DNA, 358 bp, Homo sapiens
tttgagattgggtaaataatgttttaaaaagttgcaatacaaatgctgcttcaaaaagtttttgttatggccaggcacggtggctcatgcctgtaatcccagcactttgggaggccgaggcaggtggatcaagaggtcaggagttcmaccaccagcctgaccaacatggtgaaaccctgtctgtactaaaaatgcaaaaattagccaggcatggtggcacatgcttgtaatcccagctactcaggaggctgaggcaggagaatcacttgaacccgggaggcggaggttgcagtgagccaagatcgtgccactgcactccagcctgggcgacagagaccatccaaaaaaaaaaaaaaaa

SEQ ID NO: 9062 - DNA, 423 bp, Homo sapiens
attacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggcatgtgagaggaggaactcgctgttgccctgtgtcttccccaacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagat

SEQ ID NO: 9063 - DNA, 442 bp, Homo sapiens
tacaaaaaattagctgggcctcgtgccgggccgcctgtagtctcagctactcgggaggctgaagcaagagaatggtgtgaacccgggaggcggasttgcagtgagccgagatcacgccactgcactcaagcctgggtgacagagcaagactctgtctcagaaaaaaaggaaagagtcatctgggtttggtgactaggagcgtactggtgacctcagtgagaggggtttcagaggcttatggagacagatgcaggttgaagtgggttgtggagcgcgggagaggtagaaagcagtaaacacacccccctgccaacaccgctctcaggagactggtgtgaagggtaggggtcaggacgctagctggagaaggaatatgggttcaagggagaagggcttttttctttttaatagaagagatcagcaatgtgtttagatgctgatg

SEQ ID NO: 9064 - DNA, 439 bp, Homo sapiens
aaaaaaaatttttccacagaaaagaagagaaagggctacccaaaaaatgggagaggaaaaactaatcggatgttagcagagctcaaatccttatgaacccaaactcccaagccactggatccggtgagatggctggaactcagcagggtcagcatgaggaacaccgcgaggactgctgaaacaccacattcccatggctgccgcagacagcggggtggctggaaggcacagtgtctgtgaaactgtggtcctcggcaaggggtgtgacctcatggtgggtcgcctgacctatgagcagagatggaaggaagaatgccaatttggaggcagatgtgggaagtaggagtgctgtggcaacacggtgtggaaatagggagttctcttcaggcgtgatgctcacagtttacataaatctattgatctatgtaaaaaaaaaaaa

SEQ ID NO: 9065 - DNA, 62 bp, Homo sapiens
taaccctgagattcttactactgatgagaacattatctgcatatgccaaaaaaaaaaaaaaa

SEQ ID NO: 9066 - DNA, 455 bp, Homo sapiens
aacgtttagcttaagttcaggaaaacaaaatactcagaagatggaccttttagtatgtgtgttcttgtatgttatgttcaagttttggtttttattttaattaccagctttatcttgagtagtataattttccgtggtggcacgccagagatttagggttatagaaagatgctctgtttaagactcttgacagggaagagctgtaaattgaaacagtggttatagttaccaatcaagccttgtacattaaaatatacacacgcaatttgaacgaaccgatggttcttaaaacagaaaatattggctgggcagtgtggctcgcacctgtaatcccaggactttgggaagccaaggcaggaggatcatcgcttgaggccaggagttgaagaccagcctgcgcasatagcaagaccccatctctacaaaaataaattttaaaaacaaaagcaaaaaar

SEQ ID NO: 9067 - DNA, 439 bp, Homo sapiens
taaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccamccmactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataatgctcctttagtttttcagccagtgctaacacagtaatcaaagcagcaaatcgaacctgaaa

SEQ ID NO: 9068 - DNA, 485 bp, Homo sapiens
atgtagcaaacccaacagttcttcacccctaacaatttatcatcaggaaaacaatttcgcattgcttaccagtcagtatgcaggaaaccatttttgtttcatgctccagcttttcttctttaagagagaaatttgaaacatcttaatwaargggtatgtgcacgggaggctagatagtgctgagggtgtggtttttagatattttgtcatttggattttttggtcaggatccttaatgttttgcatcagcttgggcttttaaattagatgtgaagtaagacttctttctacatttttatagttaatttagtgaaagatgtgaaagtgaaagcttgtgaaagatgctgggattggcagccccgcagactgaagtcctctgttcatccacagaacaggtacagcacgggcaagatttacccacccamcctcagccctgatctggagggaccaccactaggggtgggagggtaattcagcttctgaga

SEQ ID NO: 9069 - DNA, 487 bp, Homo sapiens
cttcatattttgtttttaaaaataggtaacttatccacattttaaatttttgggctgggtgcggtggctcacgcctgtaatcctagtgctttgggagggaagcaggcacatcacttcagatcgggagtttgagactagcctggccaatatgggtgaaactctgtctctgctaaaaatacaaaaattagctgggctttgtggcacacgcctgtaatcccagctactccaggggctgaggcatgagaattgcttgaacctgggtggtacaggttgcattgagcagagatcatgccactacactccagcctgggtgacagagtaagtctgtgtctcaaaaaaataaataaataaataaataaataagcatgcctgtgggttccagctactcgggaggctgagatgggaggattgcttaagcccaggaagtcaaggctgcaatgagccatggttgcaccactgtacttcagcctgggtgacagagtgagac

SEQ ID NO: 9070 - DNA, 361 bp, Homo sapiens
gaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttgacatttctttgtggkgtctgtctggacatgcttcctaaaaacagaccatttttccttaacttgcatcagttttggtctgccttatgagttctgttttgaacaagtgtaacacactgatggttttaatgkatcttttccacttattatagttatattc

SEQ ID NO: 9071 - DNA, 447 bp, Homo sapiens
aaatattttttttttgwatgkgcatactaaaaatgtacatttaggttttttycwatcagtgttactgaatatattatatacttacccatctaaagtgtataattcactggttttagcatcttcacagtgttaaaagaaaaacttcagccaaattaaatttaaaggcgtttaattgrgcaatgaacgattcgkgaattgagcagtccccagaatcacrgcagattcagagagactccagggatgcctcatggtcagaacagatttatagataagaaaaagggatgtgacatacagaaaccagatgtgaggtacagaaacaactggattggttamagcttgcwgtttgccttatttgaacactcagcaatgtatgagtggttgaaatacagccgtgagcctggggcscadtggctcacgcctgtaattccagcactttgggaggctgag

SEQ ID NO: 9072 - DNA, 403 bp, Homo sapiens
  misc_feature 50,320: n=a, g, c or t
agtcggcgccasggccgcacgccgcggasaggggctcggaggtcccgggnttacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagraagatgtagatgtccgtaggagaattgaacttattcaggactttgaaatgcctactgtgtgtaccambattaaggtgtcaaaagatggacagtacattttagcanctggaacatataaacctcggggttcgatgttatgacacctatcaattatccttgaagtttgaaaggtgtttagattcagaagt

SEQ ID NO: 9073 - DNA, 383 bp, Homo sapiens
tcactctgcsccacagccacagmccctgactgccgcakcccccacagagcccgccgcgcaccccacgtcccccacgccagcgcccagccatggaggccatcaagaagaaaatgcagatgctgaagttggacaaggagaatgccatcgaccgcgcggasaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggargagt

SEQ ID NO: 9074 - DNA, 463 bp, Homo sapiens
tagaatgcacagattttatctactttctcatttgtttccatctaggaactgagtaatggctccatggttaggatcactattcctgaaattgccacctctgagttaggtacgattgagaagtttcatttataagacatgaagtaattgtgatttacattaataattggggttttaaacattattttgccatttttgaagccactggatcaagttcttagctttgtagaggagctttaaagagctagggagtgctttgtgatgtccactctacgtgcgctctaaggttggagtacaggtgaaggatgtgctagttctgttccctgaggttcttctgttggggaatattgtgcagtataataatatattgacatgcctgctgggcatggtggctcacgcctgtaatcccagcactttgtgagactgaggcgggtggatcgcttgargtcggtagtttgagactagc

SEQ ID NO: 9075 - DNA, 385 bp, Homo sapiens
attctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaac

SEQ ID NO: 9076 - DNA, 372 bp, Homo sapiens
ttcrtaaacttctatagacagtggtcttgkcagtagcccaagtggsagatagtacatggatctggggasaaacagsctctactgttaggaatgktccatcctcctggcctgagttacacctgctcattgtgattccgaatttgaaaggwacacagtargaattttcaagaccctggggaagaggaargctgtggtaaacaggaaggatgagattagragaaggagtttaggtgaggtgagcccttgttttactagtagggtttaagaatatccaagtcagctggacatkgtggctcacacctgtaattctagcactttgggaggccgaggtgggcagatcacctgaggtcaggagttcgagaccagtctggc

SEQ ID NO: 9077 - DNA, 245 bp, Homo sapiens
ctatgsaactagcaaaaatctgcataatgsaacaacacagttttcacacttcaaattttacatgaggggttcttcacgattctcctggaacccagtctagcaaaatgagaggaaaggscctagggagatttatttctgktaaataggttaactctgctgagtatgacaaatagtgtctactatctcaaccctccaaaatttgcagagtgttgggactgtcatttgtgatttttttttkttttttk

SEQ ID NO: 9078 - DNA, 435 bp, Homo sapiens
tttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaaaaaaaaaaaaa

SEQ ID NO: 9079 - DNA, 223 bp, Homo sapiens
accttgtgscgcagtccttcccgggaracctggggaccggaactgcccggagttcccgcccccagasagaaccctgggttgctgggcaaccgatgcggcccccgsagctggtctctgtggtgctgggagcgagcccagtatagstcccacctcctgsgctggtaacctcccgtsccghscggctcccttgttgtcgcctctcctcgmgtcgcggaatccttgs

SEQ ID NO: 9080 - DNA, 209 bp, Homo sapiens
ammctaaaactcccacagraagggggaaaattasaaaaggggtgatataatttgactctatgtcaccrsccaratctcatcttgarttgwaatccccgtaatttctcacctggcaagagtgggaccaggtggagacaattggatcatggggggcagttttccccatgctcttctcgtgataatgattgrgtctcatgggatctgatgat

SEQ ID NO: 9081 - DNA, 370 bp, Homo sapiens
tagttacataacttgtagtatacccaggcaatggaagactatgcaatcctcagaaagaacgaggcagctctacacatgctcacttggtaccataccctaacatgtacaattaaaaagcaaggttcaggattgtgtgtacagcatgctatattgcacacacaggatgrataggcaagsaasatattacacaaatatggctatatttgtataaaaatttaaaaatgtatcaatgtacacatacatgcacttatactcatgtgttcattgactgtctttgggaggatacaccaagatctctggggagaagtaaataactgaagtataagggtatgtgttcctttggtagctttcaaattgtataccatttatt

SEQ ID NO: 9082 - DNA, 456 bp, Homo sapiens
aaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtargagagrarscgccgsgaacagcgakcgcccagcaccaagtccgcttccaggctttcggtttctttgcctccatcttgggtgcgccttcccggcgtctaggggagcgaaggctgaggtggcagcggcaggagagtccggccgcgacaggacgagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgc

SEQ ID NO: 9083 - DNA, 511 bp, Homo sapiens
aactaagttggtctccaaaatgtacctttctggcatttagatggctactttgaaacccttttgtaaatgaaatttacatctataaaggaaatcgccatctgtaagggcatctacactgagaagagggtggactgggtcactagaaactcttaccactgatctaacataaatcttamcsattgttwaaggtgcttttccttgccatcttgtcttaaccgggcctttaccgacacttttcttccttggtttagggaaccagtggtacagtatttaggcccaaagtctcagctctgtgcttttgagatatgaatttttcaccgtgttccacctaatagcatccctttagaagtacaaatttagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcg

SEQ ID NO: 9084 - DNA, 468 bp, Homo sapiens
gtaaccacctgggaaaacttcacagaaaatcagagtttcagatactgagaatagaaccactaagaagcagaaaagagaagatattctcgtgggggagaacaacggctgggaggggaggaagcatggccaaggcaaagaggtgggcattaataaggaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaaataccgatttatatgamaattaagattacaaattaaagcctggctatcctggagttttccagttcatcagccatccaataaaaatgatgtcaagcctgaaaaa

SEQ ID NO: 9085 - DNA, 459 bp, Homo sapiens
tatatttgtgctgagtgawctatcacataaatggcttcagcacagtcaaaatgcagaggatyctgkatttcaatgtctagtctggagctctcagttgagttctggatctgtgtatccacctggccacttgacgcctccacttggatgtccacaggcacctccaatgcaaatgactcatgaccttctcctccccatcagcactctcacaggagttcctgtctaaggaaatggtatcaccatcttcccattacaaaagccatacatttgagcaccatccttgactaattcctgttccttcctctgttgtacccagtacccaaaagaatgcccagcacatggtaggtgctcactaaatagctacttgattgaatggatatgcaacccaccaccaaggaatgccactgtgatgaattagaactcttctatctaattccattctctgcaccctggtccagacac

SEQ ID NO: 9086 - DNA, 97 bp, Homo sapiens
tgctctctagccaataaaccgtccttgtgtgcgagtcaaaaaaaaaaaaaaaaaaaaaaaaaaaaaaaaaaaaaaaaaaaaaaaaaaaaaaaaaaar

SEQ ID NO: 9087 - DNA, 498 bp, Homo sapiens
aacactgaccagctctgattcagtttgagaaaagaggacacaaaagcatgaataacaggaggatggatatagaataccagcatcagcaagtgtacacgatttaaagcacatttggtatctattaccaagctgcccttcagagaggttgtctcgttacacatyccacagctgtgactgagaaaccgtcttgtcgcatttgacaatccaggttactatctaaaaacttgagtttgtaagagcaacacgccatgagataatattcgtgcaaatgtaactgacaaaagactaacatcccataatactagagcacctacaaaccaagaagataaacatcccattgggaaagtgtaaaaatatgaacataaagtttacagaagaaaaaacacaaatggctcataaacacacaaaaagatgatattgcttcctggtaattggggaaatgcaaacaaaaactacaatgaaatatcgtggtatcgtgtatcaaatttgcagagcata

SEQ ID NO: 9088 - DNA, 183 bp, Homo sapiens; identical to SEQ ID NO: 8195

SEQ ID NO: 9089 - DNA, 471 bp, Homo sapiens
  misc_feature 157: n=a, g, c or t
tgtaatcctagttctttaaacagtagttctcaaactttagtttgagattgcaccactgcactccagcccgggggacagagcaagattccatctcaaaaaacaaaaadcaaataatcacctggagagtttgttaaaacaggttactgcataccactcntggagttttctaattcattgggtctagggtggggtctaagaagttcgcagatgatgcttctggtccaggaccactgtttaagaactgttggccttaaatgttaaccttatggcttttttcctatatcttttattctccccaggatgtattgttttcaacctgttgatcatactgtatgtgtctgccctgtttttgcttaatatttttgcaactgtttttcccagttaaaaataatgactaggggccgggcgcggtggctcacgcctgtaatcsbaacactttgggaggttgaggcagacaaatcatgaggtcag

SEQ ID NO: 9090 - DNA, 219 bp, Homo sapiens
tggtaactaacgatactacaatggtctgctatttgctaggcaattgacattctgtaattttcaacctgtatttgtacccacctctctttcttctggtatattttaaagtaaatataagttatgttattttatttctaaatacttcagtatacatgaagaagaggacattttattagttattttttatttcattttatttaaaatctttttttttttttk

SEQ ID NO: 9091 - DNA, 448 bp, Homo sapiens
  misc_feature 373: n=a, g, c or t
ttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggachsthnhgcatagctggtaaatcaagttagagatgtaactgccttaaaacatgccagcttaggctgggcacggtggctcas

SEQ ID NO: 9092 - DNA, 420 bp, Homo sapiens
ctgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactacaaaaaaaaaw

SEQ ID NO: 9093 - DNA, 175 bp, Homo sapiens
agggacacaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctgggtgcagatgaacc

SEQ ID NO: 9094 - DNA, 267 bp, Homo sapiens
  misc_feature 173: n=a, g, c or t
caacatctacataacatttaggattgaaattgtggtagttgagaatctgaaggacagaaatactggagtaaagaagcaggctttcagctgggtgaggtggaggttgcagtgagctgggatggcgacactgcactccaacctgggtgacagagggaggccctgtctcmaascanccaaaaaaaagaagtggtctttcaaactgagagagagaattgagattaaattattgctacctgtttacttagattactttcttttttttttttt

SEQ ID NO: 9095 - DNA, 156 bp, Homo sapiens
aaaaggaactgtactcaataaatatcagtggaacccagagctcctggcctttgcaatctccacgttgcgatggatccttggacccacttttgttaactctcaaaaaaaaaaaaaaaaaaaaaaaaaaaaaaaaaaaaaaaaaaaaaaaaaaaaaaa

SEQ ID NO: 9096 - DNA, 448 bp, Homo sapiens
cacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactt

SEQ ID NO: 9097 - DNA, 556 bp, Homo sapiens
aacaaccgaagtaacccgcaatgcgaagggcgaggggattgcgagtcaccgagtttcccgcgcggcttgagaacgtgttaggaactagtacttaaataatctcaagtccctgaggggccagagatcccaccatgcaaaatagcaaacagacccaagacttggggagaggcggtgagtgcatcagaaatggatgggtacatctgattcccaccacgcggggctcagcttagttagcaggagaccttcagactgagaaaaaatgcaagtctttttttggcctctaatatctgggaaggatggagggagctcaggagacacagaaaagatggcgtatgaatcctgtccggcctgaacgaggctggagttgtgcctctggatagcttcaagcactgatcagattgtcagcccccgctgcttgaacagatgctttagagcctcttccagttgccggtttgttcctgaagccccttcaccacctgcgctgcccaagtattcctggactcgatgttctgacatcctgcataagagtcgacagaaacttgctagcgtgatgtca

SEQ ID NO: 9098 - DNA, 429 bp, Homo sapiens
gataaggaatctctaacctaagctggaacacagaggccaactctacatctaccttcctcaaaagcaagaccactgctacaatcatcagggaatgggcccaactggcactgaacgtctgaccgccactgtctttcatcaggcgaatttgaacatgctggagataggcagagaatgctattcgggcctgcattttgctatagaaatccaaaacaacataccgttatgtgacagaagtgtaaaactacaaaatgtgtacttgcttctctccaagtggcctttgaggatgcttctattatgatggctaagaaatatgaaacccatcttacagcctgtgaataaggattccttctaagcagtacatgaaggtttttctttttaaatttcctattaaaagaatcagagatggagaatccaaaaaaaaaaaaaaaa

SEQ ID NO: 9099 - DNA, 475 bp, Homo sapiens
gaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatactbaagttgtatctctttcctttttgtacttcatggcaaaattaattttctaaaggattcagagaggcgtttatattttataacaattattagaaataatttgttccaccactagattactgtattttatggaatctaagctgtatatgtgtacatttgtatacatgtatgtgtaaatgtaagcctgacgtgggttcagattccagttttgtcac

SEQ ID NO: 9100 - DNA, 442 bp, Homo sapiens
acaatgcatatttcctaagaacatggatattctcttttatagctacagtataattgtcaactctagtaattttaacattgatgtaatactttattttctgaatttctgttttgttagttgactcaataatgtcctttatagcttatttttttccttccagtacaggatccattcccaggcctggtattgtatttagttctcatgtctttttagttgattttttcttgagacgaagytcactctgttgcccaggctgcaacctctgcctcccaggttcaggtgattctactgcctcagcctcctgagtggctgggatgataggcgcctgccaccatgcccggctagtttttgtatttttagtagagacggggatcacctgaggtcgggagttcgagaccagcctggccaacatggcaaaascctgtctctactaaagatacag

SEQ ID NO: 9101 - DNA, 475 bp, Homo sapiens
caattttataatatgttaatttaaaggtaaaaataaatatttgagaaatatcatagatggaagctgcaatgataaatttactctcataaacatattgacaatttattaatcccaagtttgaccttgaagaaacttcaatatcmawttgaaataagagttctacatgcagaaatgcctgaaagtaggacattatgtaaaagtggcagccttggcatggggcagcagatgcaatggggagatgtgtgtaacaggatgagacgtaacaggcagcataacctagccaaggggccagaggatcagagagcaattgctcccaggtagacataaaggccagggtcaagtacaagggtctgagaacagaaaccaaaagcagaagttcaggcatggagccaagaacacgtgctggcgatgaaaaatcagactacagtttagctgcctcacagagctcaaggcaagagaccatccagctcttgga

SEQ ID NO: 9102 - DNA, 460 bp, Homo sapiens
gacacaagtgcatctgctagctgttagcacttggcagacggagttctcctctagggtagttctaactttgggtaataatgtttgtcagctacctgatattaacattgctccacgttcaaacagcagtgttagcaagacctkggggaaaaggtaagccaaataaaatatcttgtcagaagttgtattttttttcagcattatatttcctcttctatctaccaagagggatcagggaatggaattttatggggtgcaaagagtaatgctttatattacttttgtaggcttctcttgccttttcttatatgaagacttcttttcttcttgaagaattttatactttctaaaatgtcattttgaagctgtctgtgcagttgccacactgggaagttgctctggccttggtgacagatgcctgtagcacgcacgcttctcctgctgtagcaaaaaaaaaaaaaaa

SEQ ID NO: 9103 - DNA, 413 bp, Homo sapiens
tatgcagtgaaattttaaattatgatcaattctgcaaatcggaaagtatacaatactatgagaatatagcaatcagggacctaacctggcttgggggaaaaagtgatgttaaggttcatggtcaagggaaagctttcttggggaaatggtattttgagttgtactctaatgatgagttgaagtcaaccagggaaaagttaggtggggaagacacgaattaaaaacttacagatcaggaaactggcacattcaaggaactgacagaaggtcagtaaggctggaacaaagaaaataagggagaaaataactcaagctggtgctgataaagtcagcaaaaggccagatgctgcagccttataaactaagtcaaaaatcttgatcttggctaggtgcggtggctcacacctctaatc

SEQ ID NO: 9104 - DNA, 414 bp, Homo sapiens
gagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaacccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggcaagtcaggattaactatttacaggctgtggattgggtgttggtctgcttcatcgrtaaggaaactggagcaactcam

SEQ ID NO: 9105 - DNA, 248 bp, Homo sapiens
agccccggatgttcgttggggattcaacatggcggcgggagtgtccgcggtggtggcggtgcaagagagcggaaggagtgtvtggaggagggaggagggtgaagactgaggctaggtgccagaatgaactggagtgaaggcgtgtctagagtgtgggctggctgttgtgctggaaagctggggacaggttgatggtaataaactgctcaatgaccagtgaaaaaaaaaaaaaaaaaaaaaaaaaaaar

SEQ ID NO: 9106 - DNA, 464 bp, Homo sapiens
  misc_feature 394..395: n=a, g, c or t
gagtccgggtttcgctgtgttgcactggctggtctcctgacctcaactgatgtgtgcatcttggccttccacagtgttggaactgtaggcgtgasaccgcacctggcctactcctgtgttcttagcttgagttcctggttgatgggtggtgcaccaattgagagagaataccatggtttgtggattgggtacggtggcttacacctatagtcccaacactttgggaggctaaggcaggaggagttcaaggcttgagctcaggagttggagactaacctgggcaacatggcgaaatcccgtctctccaaaaaatacaaaaattagctggctgtcatggcgtgtacctctagtcccaggtaattgggaggctgkkgtggaaggatcgcttgagccnngaaggtcgargctgcagtgagctttgattacgccactgsactccatcctgggtgacagagtgagatctt

SEQ ID NO: 9107 - DNA, 157 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttttk

SEQ ID NO: 9108 - DNA, 470 bp, Homo sapiens
  misc_feature 441: n=a, g, c or t
tctggatctttcctttaactgcattttttagtttattgtcaaagcctgtggtttgtaccataaaaataatataatacaaggaagaaaaatgagttatttcactgagtggtttgggtatgtttgggtttaaaataatgtttacttgcagccggggcgtggtggctcacgcctgtaactccagcgctctgggaggccgaggtgggtggatcactggatcacttgaggccaggagttcgagaccagcctggccaatgtggtgaaaccccatctctactaaaaataagaaaattagctggttatgctggcgggtgcctgtggtcccggctgctcgggaggctgaggtgggaggatcgcttgaacctgtgaggtggaggctgcagtgagtcgagattgtgccactgactccagcctaggtgacagaatgagactctgcctcaaganaaagaaaaaaaataatgtttacttgggat

SEQ ID NO: 9109 - DNA, 251 bp, Homo sapiens
tcttttggcttaggattgacttggcgatgcgggctcttttttggttccatatgaactttaaagtagttttttccaattttgtgaagaaagtcattggtagcttgatggggatggcattgaatctataaattaccttggaaggaaatagagacacaaaaaacccttcaaaaaattaatgaatccaggagctggttttttgaaaggatcaacaaaattgatagaccactagcaagacaaaaaaaaaaaaaaaa

SEQ ID NO: 9110 - DNA, 247 bp, Homo sapiens
aacgtggtgtggaaggtagcctgttacagtgctggattcataaaagggcctttatggtttgtgaaagaatatctgtgtgcttagggaggaaactttttgatctgcagaaaagccagaagacatctaggacatccataaaaattcatcagagagcattttactactgagctgcaaagggaaaaacttaaaatggatatgaaaagtgaagaaagtgatgcttctcgtgccgtttttttttttttttttb

SEQ ID NO: 9111 - DNA, 452 bp, Homo sapiens
taawcaacccaagttcagtttatttttgcacattgctttagagatataacttggctgggcacagtggctcacacctgtaatcccaacactttgggagaccaaggcggatggatcacttgaggtcagttcgagactagcctggccaacatggtgaaaccctgtctctactaagaaacaaaaatcagccaggtgtggtggtgggcgcctgtaatctcagctactcaggaggctaaggcaggagaattccttgaacccgggaggcaggggttgcagtgagccaagatcacactactgcactccatcctgggctacagtagagcgagactccatctcagaaaaaaaaaaagatacaactataaaagatacctcataaagaacacggrttcactaggaagaggcgtcattaactgkgcccttttagaatattttgtccattaacttaaatawattta

SEQ ID NO: 9112 - DNA, 416 bp, Homo sapiens
tgttataaagtaagcactttttctttggtgccttggccttctgcccataattttgtttaaggcttcccaaatgtaatgtctataggtgtgaaatgttgaccctgtgcagacctctaataacagtagcactgatctggccgggcgtggcggctcaggcctgtaatcccagcactttgggaggccgaagtgggtggatcacgaggtcaggagtttgagaccagcctgaccaacatggtgaaaccctgtctgtattgaaaatacaaaaaaattagccgggcgtggtagcgcgtgcctgtaattccagctactcaggaggcagaggcaggagaatcgcttgaaccctagaggcggaggttgcagtgagctgagaccgcaacactgcactccagcctgggcgacasgcgactccatcccaa

SEQ ID NO: 9113 - DNA, 444 bp, Homo sapiens
ctttgggatcccaaggcgggcagattacttgaggccaggagttcaagatcagcctggccaaaaatggcaaaaacctgtctctacaaaaaatacaaaaaattagccaggcgtgatggtgcacacctgtaatcccagctacttgggaggctgaggtaggagaatcacttgaacctvggagacagaggttgcagtgagctgagatcatgcactgcactccagcctgagtgacagagcaagactctgcctccaaaaaaaataaaaaattagccaggtatggtggtgggctcctgtagtcccagctacttggggagctgaggcaggaggaacacttgaacttgggcgcaggagtttgaggttatgggtaagccatgatagtgtcactgcactccagcctggatgacagaatgagactctggccamcctactcaaaaaaaaaaaaaaaaa

SEQ ID NO: 9114 - DNA, 359 bp, Homo sapiens
tctgtagatatatgagccatgtttttcctttatttttgaatttttttttcctgtgctctaatggcggtaggagattgtggattatctttttaaatagctgaacaaattataaagaaattaaagtacggtattgcggtagggttggcgtaggcttttgggtctcatttcatgtgtcagtattattactgtcctttatagtaggcacgtaatacttttgacatgttattatttttagtaatctcagcactttgggaggctgaggcaggtggattacttgaggtcaggcgtttgagaccagccttgccaacatgatgaaaccctgtctctactaaaaataaaaaaattagctgggtgtggtg

SEQ ID NO: 9115 - DNA, 298 bp, Homo sapiens
tggatactgcgggcaacacagctggaccagatcccccagtgcaaggggttggcaagcatgagctcagccatgggaacgaggtggcaagtggttctccctgggacacggacaggcccgcagctgagctcttagctacacgcagccctcaggatgtcccascaggcccccaccagggcadatagtggtgcccagccctcccctmagccrsgccgtgtgctctgcctcamagaaaaagatcaacatccgsgtgstgraccccttsaccatmaagcccctggamagaaaactcattctcgav

SEQ ID NO: 9116 - DNA, 326 bp, Homo sapiens
ttctatttttagtggagatggggtttcaccatgttggccaggctggtctccaactcctgacctcgggtgatccacccaccccggcctcccaaagtgctgggattacaggcgtgacaccacacctggcctcatttcatcttctaaagtactctccctaaaatcctagtgagtcttgctttccaaactcaggtaattcacccccagtctggaaagccacagagtgtctgtgcagctccagagttggtgctcttagctacttcagtagcagccctctgcatcagactatgaagaaatcagtgtcactggagggacacaggtacaatatt

SEQ ID NO: 9117 - DNA, 312 bp, Homo sapiens
cataaagatttctgtgggtccttttctttccttaggatacaaaatttggatttaaagtctttcatatgttaacttggacttaaaattctaatcaactaatctagaaagaagaccacaactcatcaaatattycctaatgcgcatttacagaatttaaacatataagtcagccgggcataatagctcacacctataatcctagcactttgggaggctgatgcaggcagatcacttgaggtcaggagttcaagatcagcctggtcaacatggtgaaaccccatctctactaaaaatacaaaaaaaaaaaaaaaa

SEQ ID NO: 9118 - DNA, 277 bp, Homo sapiens
cwaaggttacacaggtgctttatatctctattttgcttatwttttttcattccaggaatacttcattgctccatcagtagatatacaagawcaggtttatcgtgtccaaaaactccaccatattctaggaaatattagtcagtkgcatgcctttcattaaatctcaacatgaactcctcttttctttaacacagatctgcataaagtattacaaacaaaatcctcttgatgagcaacacatttttcagctgccagtcagaccaactgckgtaaagaa

SEQ ID NO: 9119 - DNA, 258 bp, Homo sapiens
aacccatcccctcaagcatttataagatatttcttaatgaaatatgaattagattaagtcaacaaatgtttggtattaattagcttgattgtaataataatttcacaatatacctatgtatcaaatcatcatatkgtwcakcttaaatgtgtactatttkwatttgtcaatcatattttaacaaagttggaggggaaaaatgttcagtaacaaatatatacatatgtatttagttyctgctactagaacagttccagd

SEQ ID NO: 9120 - DNA, 494 bp, Homo sapiens
  misc_feature 357,359: n=a, g, c or t
caaaaattagccaggcacattagcgtgcatctgtagtccagctacttggagggctgaggcaggaggattgcttgagcctggaggtcgaggctgcagtgagctgtgattgtgccactgcattccagcctggggtgacagagcaagaccctgtctcaaaaaaaaaaacaaaaagcaaaaaataaacaaatatttattgtatgcctactatgtgccaggtactctcccaggtgcttgagatacagcagagtacaaacaaagccgtgttcttgtcctcctacagcttgcattcacgcagcatttgaagggcttactatttagtcccaatttatgaaaggttctgtgtgattaaaggctgtndnhtggagaatatgttgaataaagagatgggcagggttggccaggcacggtggctcacgcctgtaatcccaacactttgggaggccgaggcgggcggatcacgaggtcaggagttcgaggccagcctggcagcatgg

SEQ ID NO: 9121 - DNA, 434 bp, Homo sapiens
agtgggccccgcctctacgggggcactggcgcggaaactggccctgtgtcgaagaaggaacgtactttggcgttcttatgagctgcctagtacaaattattggcagaaacaatgaattaaacattcaaaaagtaacccaccggccggccgcagcggcttatggctgtaatcccggcactttgggaggccgaggcgggcgcatcacctgaggacaggagttcgagaccagcctggccaacatggcgaaacctcgtccctactaaaaaatacaaaaattagccaggcgtggtggcgggcgcctgtaaccccagctacttaggaggctgaagcaggagaatcgcttgaaccccggagtggaggctacagtaagttgagatcatgccactgcactctagcactccagctgaggcgacagagcgagactctcaaaaaaa

SEQ ID NO: 9122 - DNA, 212 bp, Homo sapiens
gaggagtttgagaccagcctggccaacatggtgaaatgctgtctctactaaaatttcaaaaattagctaggcatggtggctaatgcctgtagtcccagctacttgggaggctgaggtcggaggatcactttgaacccaggaggcggaggttgcagtgagctgagatcacaccactgcactgcagcctgggtgacagagcaagactctgccaa

SEQ ID NO: 9123 - DNA, 410 bp, Homo sapiens
  misc_feature 346: n=a, g, c or t
tgaataaacctcttaaagcaaaggaagcatatcttaaagcactagagctggacagaaataatgcagatctttggtacaacttggcaattgtacatattgaacttaaagaaccaaatgaagccctaaaaaactttaatcgttctctggaactaaatccaaagcataaactagcattattcaactctgctatagtaatgcaagaatcaggtgaggttaaactcagacctgaagctagaaaacgacttctaagttatataaatgaagagccactagatgctaatgggtatttcaatttgggaatgcttgccatggatgacaaaaaggacaatgaagcagagatttggvnmaagaaagccataaagttacaagccgacttccgaagtgctttgtttaatctggctctcctgtat

SEQ ID NO: 9124 - DNA, 286 bp, Homo sapiens
atcttasggactgrtattggtaattatggtcaatttaataatattttggggcatttccttacattgtcttgacaagattaaaatgtctgtgccaraattttgtattttatttggagacttcttatcaraagtaatgctgccaaaggamstctaaggaattagtagtgttcccatcacttgtttggagtgtgctattctaaaagattttgatttcctggwatgacaattatattttaactttggtgggggaaakagttataggaccacagtcttcacttctgataas

SEQ ID NO: 9125 - DNA, 422 bp, Homo sapiens
tcttgtagttttcgtagcatctttgctatctggtatgaccaggtgttgcaggcttatcttttacagtttctaccccagatttataacctattatttcttcaacaagccctggttttagtggcagaggtatttagggcgcctaatatggaccttagagattattgctgctgtgagttgtcattgtttctaggacagagttatgggtgatatatatgtatatgtgtatatctgtacacatgcttttttataaaacttaaccacttctgtattataatacatcggtgtatatttttccatgttaaaaattctggttctcaaggatagggaataatgaactagaatatcctcattattaattactcgcttgttttctcgtatattacacagtagtctcagaatagcaatactaataataccataac

SEQ ID NO: 9126 - DNA, 390 bp, Homo sapiens
agtcgggaacggttctccgagtccgagctggcggcgcgctgtgggctgtttgcctgattctagagctcaatgctgcccatcaggtgtttgaagtcatgatttggtgaaaatgggacagtgaagacgttctgaaaaaaaaaaaggcwtwtgatgrggtttggacattgagaggtataggctggctgtaggagtcgggtttatgctgtgatgcacagkgamasgkacctctctctgttcagcaaggttcattccggctattcatttaacagctggaaagttctatatctgtggcaaaratgatctscggtggagggtttattcctggcccctggcttcctggccttggtcttttgartgcttgccggatccctaattcctttccggttccak

SEQ ID NO: 9127 - DNA, 453 bp, Homo sapiens
tataagacacgacttacagacatcttttagattattatagtttggttagacattgtcataaaamcagaagagaaactggtttaaccttactttattcagacttcactgtggtgtcagccaactttatccctcaaatattttaacagtaatgtacaaaatggagctatagatctctaatgctagaagagatgtccaagccttcactttgtagacaaatcccaaggcccctgaagattatgtgatttcccagaagttctattacgagttaattccagaacaagtcaagaattaggtttcttgactctaaatagagtatattttctaccatgttacattgactcatataaggtgattgttttcatgaatagaatatgttgtaattttttaattatatgtgttaataattaagtaaaaggatctggtacagatgtgagctcaaaaaaaaaaaaaaaa

SEQ ID NO: 9128 - DNA, 528 bp, Homo sapiens
tcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaacccagttccgtcccatcctgagggcaagatcctgggctcataggcagtccctttcacttc

SEQ ID NO: 9129 - DNA, 271 bp, Homo sapiens
ksgaaaaggaaaaccaccatctttcttttaaggctgttcctgggcctggcgggggaggcaggggtgagaggatggaattgtgtgcacaagaactgtggctattttaatatataatgttagagggctgcgttctttgtcgccgcctcccctgtgtgccagccctgtgtgcacggyctctgccccccggcctttgctgtggctggagctggacagtgcagtgactgsgrgsgkgggggagccaggtcgcccttttggcagctgctavgctgas

SEQ ID NO: 9130 - DNA, 275 bp, Homo sapiens
ttattttgtgacagggtcttagtctcgtccaggctggagtgcagtgctgtgatcttagctcactgcaatcgccacatcccgggttcaggcaattcttgtgcctcagcctgccgattagctgggaccacaggcatgcaccagctagtttttatatttttggtagaggcggggtttccccatattggccaggctgtcttgaactcctggcctcagttgatctgcctgcckcggsstcccatggtgctgggattataggcatgagccactgcccgggw

SEQ ID NO: 9131 - DNA, 108 bp, Homo sapiens
arttgtgttcgcagccgccgccgcgccgccgtcgctctccaacgccagcgccgcctctcgctcgccgagctccagccgaaggagaaggggggtaagtaaggaggtcts

SEQ ID NO: 9132 - DNA, 221 bp, Homo sapiens
araatgcgaaagcgactgccttcttggtccaagcacaaatgtggatcactgaacacagtactggaagcgccatttgcagggaatctacaaaccagtatcacatttaggagtcaaagtgttawttcttcagcattccttacaactagaaagcacattcactgaaggctgaaggagcctcacactgttggaagatgtactgctgctggttaaggtcaacctgg

SEQ ID NO: 9133 - DNA, 93 bp, Homo sapiens
cttsttgatcctgaactgggttaggtgccgctgttgctgctcgtgttgaatctagaaccgtagccagacatgggactggaggacgagcaaaag

SEQ ID NO: 9134 - DNA, 94 bp, Homo sapiens
ktgttcctggagttcttcccattgaggtcctaggatttgcacaccactgtcccacawkagctttcctgcctaatgaaaggaggtcttgtggtgy

SEQ ID NO: 9135 - DNA, 303 bp, Homo sapiens
  misc_feature 231,233: n=a, g, c or t
tcggacacttgggttgaattttggaaggcctctacatatctatctgggtcatggaggacttgcctaggtccccctttatttgtctaaggtcctgaaatggaaaagaaagtttwaagtatagtagcaccatgtccatcagacatttcttgtaagggcaacagtgaagttgggtgtgttacdtargtggcatatccagaggatctcataaaatggkrrrkggaaccccaggtnangggatcaggtrgggcatbcagaaggtgcattagagggttccccmgggaatttgwctttctgactttgggg

SEQ ID NO: 9136 - DNA, 235 bp, Homo sapiens
acttccggcttttgtgacgctttccctgggctctgaaggccagggggcttggatgtgagtctagtgctcctggtccccaaagtcacaaccccttctatcccagcatyccagacttctccgggcggggacagagttggacgtgcatggctgtgtcctgcaatcccctcgccacgaccgcccgggacggagtggaagcgggtccgtgcccccgttcctcgcgccagcctcggcggtk

SEQ ID NO: 9137 - DNA, 465 bp, Homo sapiens
cctttatggcctatcttttgatattcagagctttactttgtgatataggagatttatgttcgtgtttcagttgacttatggataaattcctaaaggggaagatacacgtttcatttggtttcttaaactgtctcggtgccaggcagtgcctagcacacagtaggagcacaataaaaaaagtgcgctgagtcagtcgccacatcctaattatagcggccttgtgtgcctgttgatactggtccagctcccctggcatgggcctgtgttcactgggtaatacttggaattaagttttaggtctgggcatagaaggtttataagatagtgaatataactgtagaggaaataggtctcttttaagttttacaaaaccttacttgtcttggcttgtgtcaattacaaaacgaaacaaaaaagagactcatcagaccgtgacaaatgatagtaaactttgcgcatggtggt

SEQ ID NO: 9138 - DNA, 335 bp, Homo sapiens
ccawagaaagaaaaagtaraaactaaaaggcagaaatgaaatccacaagcagacagcccagygccacaccctgggcctggtagttaaagatcaacccctgacctaatcggttatgttatctacagattacagrcattgtatagaaatgcactgtgaaaatccctatcctgttttgttctaatctaactaccggtgcatgcagcccccagtcatgtaccccctgcttgctcaatcaatcatgaccctctcacacacatccccttagagttgtgaacctttaaaagggacaggaattgctcacttggggagctcagctcttgagacaggagtcttgc

SEQ ID NO: 9139 - DNA, 380 bp, Homo sapiens
catttaaaaaaataccttccaacaaacaacactcttataggataagaccaaatcattgttttaaaattgacagagtcttaaacagagacacattaatggcagataagcccatgaaaaagtgcccatcattattggtcatcagggaaatgcaaattaagtcacaataagatccccaaaacagcctctagaatggctaaattgaagagatggataaccctgaatgttagcaaggttgtcaggaatgcaagttctcatacattgttggtggcaatgaagatggtacaaccacttgaatagtttgacaatttcttaaaaagttaaatatgaatctgccctatgattaatctgtgatggaaatcagagtagtagcaggatctggt

SEQ ID NO: 9140 - DNA, 294 bp, Homo sapiens
tyaggatgtgacatttaagctkrtttctgaaaagaattggtgraagttaggactggaggtkagraartyaactaggaavcaatttcaggrtttaggaaggagctaacctgrtcctgaattaggacacaggctttagagataasmatgaagargccgggmrcartggctcacgcctgtaatcccagcactttgggaggccgaggcaggcagatcacagggtcaggagatcgaraccatcctggccaacgtkgtgaaacctgtctctgctaaaaatgcaataattggctgggcgtk

SEQ ID NO: 9141 - DNA, 477 bp, Homo sapiens
aaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataaaaaaaaaaaa

SEQ ID NO: 9142 - DNA, 359 bp, Homo sapiens
ttttyttaatccagtctatcattgytggacatttgggttggttccaagtctttgctattgtgaatagtgccgcaataaacatacgtgtgcatgtgtctttatagcagcrtgatttatagccctttgggtatatacccagyaatgggatggctgggycaaatggtrtttmtagttctagatccctgaggaatcgccacactgacttccacaatggwtgaactagtttacaktcccaccaacagtgtaaaagtgttmccgcatmgccaagtcawtcctaagccaaaagaacaragctggaggcatcacactacctgacttcraactatactacaaggctmcagtmaccaaaacagcatggy

SEQ ID NO: 9143 - DNA, 366 bp, Homo sapiens
gaagggatagaggccttggaccaagatatacaggtatctttttttttttttttttttttttttkgggatggagtctcgctctgtcggccaggctggagtgcagkggcmcaatcytcggctcactgsgacctccacctcccaagtttaagcgattctcctgcatcagtctcctgagtagctgaaactgcgggtgcgtgccaccatgcccagataatttttkgcatttttagtaratggggttttactgkgtkggccaggatggtctcgatctcctgacctcatgttccccccgacttggcctcccagagkgctggaaagtatwcagaggagaascagaaaaatgggaataaamctagaaaagtttak

SEQ ID NO: 9144 - DNA, 373 bp, Homo sapiens
ctgacctttggaattttatctgtgtttttactgagagctatttctgctgtcttctaactactagttttaagatttacaaattttattatctgtcttatgttacacttagtttctacctttaattgtaacaaaatagtatttcagggatgatggttcaaaatcatggtgtttcatgacttggattctcatgccacccctgggcttgctggttggataggctgtcttggcaagatccctggatttttatgaaatgcaatttccagagtgagagctactaggcccagaaaatacttgaaacaaacatatccttgagtttagttaccgttgaatatgatgctgttcagaagccagatatctacagtccagcttgaaa

SEQ ID NO: 9145 - DNA, 350 bp, Homo sapiens
taaaatgttaaaaattttgaagtatgtgtttattaaaagaaagaggtgtatttacataaagttatgacaaatgacaagtcctaagagtttgcatttaagttttatcaactaaaattgctgaatttcacaaaattaaaattcctagaattttaagtgtgataagattgtgaagatagctcaagggagtgtgtctataatatgcagaaatcacttctggatttattcctaataatgtatccagtatcacagtatcacctgtatttccctgtttataacaaaactggcatcatgatgattagtaggccttaatagtgaaaaggctttttaagtacacaacaaatgtttctgtm

SEQ ID NO: 9146 - DNA, 102 bp, Homo sapiens
agttccagcggcggctacggtggtggcagttccggcggcggcggcggcggctacgggggcggcagctccggcggcggcagcmgctccggcggcggatacggm

SEQ ID NO: 9147 - DNA, 412 bp, Homo sapiens
taaagttattttgccaagtcatgccaagatatattgaaatttccactcatattggtttttaaaattttttttagtcctaaaattaataagtatggaaaatcactaaaagcagtgtaggataaggtgtgtttwaactggccgggcacggtggctcatgcctgtaatcctagcactttgggaggccgaggcgggcggatcacttaaggccaggtgttcgagaccatcctggccaacatggtgaaaccccgtctctagtaaaaatacaaaaaatagctgggcatgatggtgggtgcctgtaatcccaggtactcgggaggctgaggcaggagaatcgcttgaacccgggaggtggaggttgcagtggccgagatcgcaccactgcactccagcctgggtgacagagcgagactcc

SEQ ID NO: 9148 - DNA, 422 bp, Homo sapiens
aaatatataacaattttaagtatatgtgcagtcaaccctggagcacccagatatatgaagcaaatattattagaggtaaagaaagagatagaccctaatacaataatagctggagacttcaccccactttcagcattaggcaaatcttttagacagatattaacaaaaaaactcaatctgcactatagaccaaatggatctaatagatatttacaaaacttttcacccaatggctatggaatataaactcttcagcacatagatcgttctcaaggatagaccatatgttaggtcataaatcaagttttaaaatattcaaaaaatggaaataatatcaaacatctactctgaccacaatgggataaaactagaaatcaataacaaggaattctgaaaaccatacaaatacattaaaattaaac

SEQ ID NO: 9149 - DNA, 447 bp, Homo sapiens
acttaaaattcatggtcccaaacagcaattacttttgcaccaaactaaaaatataagttaaaatggaagagtctaggagcaaaccaagaaaagatcacctacttcatcatctctggtcaaaaacaaamccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttt

SEQ ID NO: 9150 - DNA, 432 bp, Homo sapiens
  misc_feature 219: n=a, g, c or t
tagaagatgctgtggggatgaggggcatgtccctcgaggaccgtgccagcagcgaggccattcggagaagacctgggaatggctgtggtcacaggcagttcagacctggcgggcaggtctacagcctgatttggggaagtcttgaggccatgagtctgcaggcacagagacagccctgcagcagcatctgcggaggctgaagagggagcccctggtgtncacctgggcagggggagggacctgttgcgattgggtgtaactgcgagaacagcatagtggatgggcggtctctgcacctgcgtgtgtggagggaaaagtaagacaggaaaggatgtgtcatgaaaaacgtggtcgtgagttaaaaatgaggcacatacaacaatagaaattctgcagatgtatttaaataatacactgtctaccgtgtgtgra

SEQ ID NO: 9151 - DNA, 369 bp, Homo sapiens
tatctaattttggcaaagtctttagctttttagtgccgtattttttttttcawataavggatagaatatttaggccgggmacggtggctcatgcctgtaatcccagcactttgggaggctgaggtgggtggatcacttgaggtcggtagttcgagaccatcctggccagcatggtgaaacctcatctgtactgaaatgcaagaagttggccgascgtggtggcacgcgcccgtggtcccagatactcgggaggctgaggcaggggaatcacttgaacccgggaggcggaggttgcggttagccgagattacgccactgcactccagcctggtgacagagcaagactccttcccaaaaaaaaaaaaaaaa

SEQ ID NO: 9152 - DNA, 432 bp, Homo sapiens
tttttgcgtccgggaggagccaaccgtggcgcaggcggcgcggggaggcgtcccagagtctcactctgccgcccaggctggactgcagtgacacaatctcggctgactgcaaccactgcctccagggttcaaagctttgcctcagcctccbaagtagctgggattacagattgatgttcatgttcctgacactactacaagattcatactcctgatgctactgacaacgtggcttctccacagtcaccaaaccagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctgt

SEQ ID NO: 9153 - DNA, 398 bp, Homo sapiens
  misc_feature 320: n=a, g, c or t
aagtttagggaagtgaaaggcgccaggtgccagtcctggcctctgatgtaacccagcgccccgcagtcccgacacagattcctggatctcagccccatagcagctatgatcccgctgctgctggcagcgctgctgtrcgtccccgccgggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccgganggsrccgtgggcgaagcctgcagccgctgtaccggagcaacaccagccagstcgscttcctgctctacaatgaccaac

SEQ ID NO: 9154 - DNA, 439 bp, Homo sapiens
cmgcccattgtggtggggcatctgtccagccccattgccactcagggcatccaaacaggaggcacccgctgggaagggtctaaagatactccttgtggccactgctactgttcacacttgacttgtggagaagcgaagggctgagggggaggtttgtgtacacccatgtatttaaaagtgactgactgactgaaatgagcacataccgacatatgcaacatactaataccttcctgattttcgagactttctaattactacaactaacctgttgtgctcacctctggaattcagaaagagagccactgcgagcactgaccacaagggctgccttaggaaggaaatgtgtgctttcaggagttcttattaggggaattttaagagcacaaaaattttattgaacccaccttagtgacaaacagaaaatgatttgttagat

SEQ ID NO: 9155 - DNA, 56 bp, Homo sapiens
ttctcacttaatttgtcatgttgttgatttctgtttacacagtttttttttttttt

SEQ ID NO: 9156 - DNA, 423 bp, Homo sapiens
ggaagaaaacgcaaacggcggttactgacaggctgggcgagcgctcgggggctcaaactgcctggagacaggcggggctcctgctgaggcttggtccgcccggacgrgtaaggagaggagccagggaggasstgctggcgtgagacgcctctgcccggtagaagatactggaagatcaactctaatttgtggctgccttcccagcagtctctacttcagcatatctgggagccagaagcactcaagtttgataactcaaaagacagaacaatcagtcaaggggtagaggctaccttccattctgctcatcttacacttcttggaaaggagacattcggtgaagatcactactattctccaaacttcattcgggaccctattccttccctgtttgatgtcagtgtgtcaaattctaaattatgt

SEQ ID NO: 9157 - DNA, 426 bp, Homo sapiens
acacctgagccaattagctccggagatcagaagaggcctgaaaacggagccgagcccttattctcgggatggagaaagtcacttgatcccaggtgacacacaactcccagctgatggaagacatccccaggcagaggagggagggcagcctctggctcgcccggtrgacaatcactgttccgtgtgcagaaccatgactgactctgaccaaatggcaagttcctgacagatattcccaggaagcagctaccccagctctcggtcctgatgcacacaagtccctcgttacagacatgccatgatgtgcacccacctccaccatttcagggtgggaattttgaaataaaatgtatgttcttcctttgatgttagtaactrcagagttatttaaaattcttattggacttgatttatgaaaataacaca

SEQ ID NO: 9158 - DNA, 432 bp, Homo sapiens
tgatttctctttcagatagttcactgttaatatttggaaacagtactcatttttgtatactgattttatatcctacaacattactaaatttgtttattctaatagttttttggtgcagtctttagggttttttatgtataagatcatgtaacctgccaggtgtggtggctcacgcctgtggtcccagcactttgggaggcagaggtgggcagatcatgaggtcgggagttcgagaccggcctggccgrcatgctgaaaccccatctctactgaaaatagaagaattagccaggcgtggtggcgcatgctgtggtcccagctactcgggaggctgaggcaggagaatttcttgaacccgggargcggaggttgcagtgagccgagatctcactgctgcrctccagcctgggtgacagagtaacactctgtctc

SEQ ID NO: 9159 - DNA, 433 bp, Homo sapiens
cttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggg

SEQ ID NO: 9160 - DNA, 434 bp, Homo sapiens
caccgtcctcgatctgtacgaaatgtgaaatgtttagggacatctccatgctgtcacttgtgatttgccctcttatgtattttggtcatattgccaactggaaagtcaaaattttctaacaactttaagtaagttctttcaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattatagtgttttgtaaatgtatccagaccatgatgcattgttttgtgctcaacttgtgttttgtatttaaagcatttt

SEQ ID NO: 9161 - DNA, 436 bp, Homo sapiens
tagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatccc

SEQ ID NO: 9162 - DNA, 342 bp, Homo sapiens
tgaataaattaatgtgtgatttcttttaggatggaagagtgtagaaagtgtccaaagttggtgtctgaatatatgtccaaaaagataaaagttgatgaatttgtgactcacaatctgtcttttgatgaaatcaacaaagcctttgaactgatgcattctggaaagaggtaggctttctctttatatatcatagaatgtaataatgatgttgagtttgaggggatggagagtcgaaaaacacaattttagttgtcttaaaggtatcatttaaaacttagtatgttgcttccttttacagcattcgaactgttgtaaagatttaattcaaaaaaaaaaaaaaaa

SEQ ID NO: 9163 - DNA, 367 bp, Homo sapiens
ttaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcaggkkgcaggactgttcctcccaatgtggcccccagccctgatgtgggccccctgctccagcagcggctgaggakctagatgccttgctcctggaggaagaaacagtagatcgggagcagccccactggacctaggtgccccatctgttggtcatccatcctgaagggacaggaaacctcccaggcagttatttttttw

SEQ ID NO: 9164 - DNA, 395 bp, Homo sapiens
tcagtagttaacagcatctacagccccgtgtttccacatttgtacaaaggaatgttcagactgaaccacacttaagtacaattttgaaacagcatgaggctgggcgtagtgcctcacgcctgtaatcccagcactttgggaggctgaggcgggtggatcatgaggtcaggagattgagaccatcctggcgaacatggtgataccccgactctactaaaaatacaaaaaaataggccaggtgtggtggtgtgcacctgtagtcccagctacccgggaggctggggcaggagaatggcgtgaacccgggaggtggagcttgcagggagcagagatcgcgccactgcactccagcctgggcaacagagcgagactttgtcccaaaaaaaaaaaaaaaa

SEQ ID NO: 9165 - DNA, 464 bp, Homo sapiens
cacagtggaacagccatggatgagtaacttaaagtaataattcttataccagagaggctacaataattttactgttaagagctggacagaattttgagatcttgagagtaagatacttcataaatgctttgtattgttgtctaacttccatatggtctgttaaaataacttactcaaaaaataacttaattcaaaaagaacaatctctattgaaaaaactaaaataggctgggtgcagtggctcatgcttgtaatcccagcattttgggaggctgaggtggccagatcatgagatcaggagttcaagtccagcctggccagcatggtgaaaccccatctctactagagatgcaaaaaattagctgggcatggtggcacatgcctgtaatcccagctatttgggaggctgagaggagaattgcttgaacgtgggaggtggaggttgcagtgagccgagatcacac

SEQ ID NO: 9166 - DNA, 190 bp, Homo sapiens
cactgtggttttgtattgagttttgaaattagaaagtgtgagtcctccaactttgttcttctttttcaaaattgttttgtttattctgtgtcccttgcatttctttgtgaatgcagggatcatgttgagactgtagatcatttgggggggcattgccattttaatggtattaaaaatcttctcatccarr

SEQ ID NO: 9167 - DNA, 168 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgccctacagatttggttttttttttttttttb

SEQ ID NO: 9168 - DNA, 401 bp, Homo sapiens
catgagcttcagtgatgtttaggaagtggagaagtgtagcagtaaaaacagaacaagagacatataggaaagaccttatggatttgattagataaagttttataacatttgcatgagtamcatgmagaggcgtcgaagatgttgataaacctacattagggttgacctatatgaagttaccagtatttgactttttaaacctacaaaagtggtagttttaaatagttctttgtaatagacacctggcttgggttggagatgactactcttcaaaatggacaatggcatcagtgaagaaccamgaattgcaaagatactgcaattctgccagttaagtgaggacaaaagccttaagtgattaccggcattttcagagctcttagctggtagcatagtgaatt

SEQ ID NO: 9169 - DNA, 385 bp, Homo sapiens
tacgtatattttaacaaacctgtccttgatattagttaaggtgacacataagggtgacacagaatgtgtaatgcaaatttcatagtaatagtaactttataaaataatattataaaatacaggatttaaacctttyctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtktggtagcatgtgcctatagtcccagctacttgggaggtggaggtgggaggattataah

SEQ ID NO: 9170 - DNA, 469 bp, Homo sapiens
aagtgctcccccatccccacagtataaaaagattatttgcatgggtgcaaaagaaaatggtttgccgctggagtatcaagagaagttaaaagcaatagaaccaaatgactatacaggaaaggtctcagaaagaawttgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgcc

SEQ ID NO: 9171 - DNA, 404 bp, Homo sapiens
atgttgatgatcaaaagtaacatgttgagactctgagcttaatccattaaatggattttagaatctagtagaagttatctttcttataaattaaaacatattttatgcttcttttttgagggaaatacctgggatcttttgcatcactatatgttagtgtctattatagatgattaatctttctaacttgatctttaaaagaaagaaattgattttagtgattgagtgttatataatagtagatacaaatctagttatggcattataatgtcgtagttcctatattctatttcatttctatgaatcaagatgcccatgtttagatgagcttagaaagctacttctcattgttcctactcaggccacatttttagaaaaaattttaagataactcccataagcaa

SEQ ID NO: 9172 - DNA, 424 bp, Homo sapiens
  misc_feature 72: n=a, g, c or t
ctggaggtttgcgtaccggtcgcctggtcccggcaccagcgccgcccagtgagtgaacaccggccgcagggnggtggggagaagggtcagcccggccatgtcagtcagcgcgatctcctgggctccgggcttgccargcagcgctgggccccgctcctcgtgarcggccggytctttggtctcgaacksccccctgggtgctgataggtgtggtttcccataaggaagctckkcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctgr

SEQ ID NO: 9173 - DNA, 350 bp, Homo sapiens
  misc_feature 297: n=a, g, c or t
tttcttccagtgctcctcgcaaacttaggctctaaacscatcagcgattcttgtcacaatttcactgacaaaatctactttatccttgtctcacagagagtgttgtatcttatgtagaatatagtattccatatactttccaactaacagaggaccatggattcctttctatcacctcagcagcatgtttccaacacttccacctaaaattactttagagtatcagctcaacacacgactgacttggaaacatcaggaracctctgtaatgattacaccaccttgtactttgctccnatttctggtctctggattttaatccctttccttccttctgagatggaactgga

SEQ ID NO: 9174 - DNA, 390 bp, Homo sapiens
agagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagac

SEQ ID NO: 9175 - DNA, 473 bp, Homo sapiens
attgaagaacataacatcaaaatctatcacttacctgatgcagaatcagatgaagatgaagattttaaagagcagactagacttctcaaggtaagaactggcttcagatccacaacataaataactcctgtttactgttgtccatgttgaggtgagagagattgcctgggtatgttcagttacgagagtatttttgctttcaatatattttaagacctcatgcagtggctcatgcctataatcccagcactttgagaggccaaggcagatggatcagttgaggccaggagttccagaccatcctggccaacatggtgaaatctcatctccatcaaaaatacaaaaattaggtggatgtggtggtgcacacctgtagtcccagccactcgggaggctggggcaggagaatcacttgaacccgggargcagaggttgcagtgagccgagatcgcgcctctgcactctagcctggc

SEQ ID NO: 9176 - DNA, 428 bp, Homo sapiens
twagrwtgggkwaaggcaraascaccasctgwactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaacaataaaaaaaaaaaaa

SEQ ID NO: 9177 - DNA, 384 bp, Homo sapiens
aaaaaatgccaccaatcaagccatttctttctcaaggggaactgagtgatttgcagggtttggggaaggttgcttgtccctaaagcatcattccgtcccactctggtgctgtgcaggagctcgactatcctgaatccaccatgattcgacctcatgtcagtcctttggctgccagcccagttcaactccaagctgatgaccagtgtcgaccgccagtcattctgaacatttgaccagttgagctttcaaatgatggcagtcctggctgacattttgggtgaacaatatgagagactgactggttgagcccttcccaaatttctgacccacaacattgtgagaaaaataatcttaagcctctcaaaaaaaaaaaaaaaatgcgaa

SEQ ID NO: 9178 - DNA, 470 bp, Homo sapiens
  misc_feature 222..223: n=a, g, c or t
acaagaccagcctgggcaagatagtgagacattgtctctacaaaaacattttaaaaataaaatgaaaattagttgtcgtggtgcatgcccgtagtcccagctacttgggaagctgaggtgggaggatcacttgagcccaggaggtggaggctgtagcgagcagagatccbaacactgtactccagcctgggtcagagcaagaccctgtttcaaaaaaagagnntttcaagaaggacagaatggtcaacagtaaagaaacaagtaaagaaacatctgcttaaagcacaaaagcagatcttaagttcagctatcatcctggaatatatttgccttccctttttgattgttactttcttcagtttacgtataatttctcagggagatcctccttcgttaggattgatcttcttgctttgcattcccgtaccactctttttgtccttttatatactgatcacctcataattgct

SEQ ID NO: 9179 - DNA, 435 bp, Homo sapiens
taaaacgataagtcagattactgctttttattgtaaactttaacaaactatttgactctctaaactatatgcatatgcaactttatttattttattttatttttatttattattttttgagatggagtttcactcttgttgcctaggctggagggcaatggtgtgatctcggctcatggcaacctctgcctcccaggttcaagtgattctcctgcctcagcctcccaaatagctgagattacaggtgcctgccactatgcccagctaattttgtatttttggtagagacagggtttcaccacgttggccaggctggtttcgaacgcctgaccccaggtgatccacccgcctcagtctcccaaagtgatggaattacaggcatgagctactgtggctggsctaactttattttttaaaataaaaataaaagctaca

SEQ ID NO: 9180 - DNA, 185 bp, Homo sapiens
cctctgtaatttattttgtcagtgttttgttgttttcagtgtgcaggtcttttacctccttggtttaatttattacaaagtattctaattttttgatgctatcacagtctagttttcttgattttttttttttycagtwaggckgtwatttrggcatgaaaaaatgcwactggactgggtgcggk

SEQ ID NO: 9181 - DNA, 424 bp, Homo sapiens
  misc_feature 332: n=a, g, c or t
caacaaaatgtggtatattcatacagtggaatattattcagcctctaaaaggaagatacgctgacatgtgctgcaacatggatgaatcttgaggacatgatgctaagtgaagtaaggcagtcactggaagacaaatactctatgcttccatttatgtgaagtatctagagcagtcaaatgcatagaaacaagtagaatggtagttgccaaggactgggggaggaggaaatgaggagttgtttaatgggtatagtgtttcagttttgcaagataaaaagtcctgtggattggttgcacagttaagttatgtgaatgctgtatgccaactcaantgtacactctaaaatggttaagatggtaaatcttatctttattttaccacagttttttttaaagcatggtaaacaccatttcccaggatgta

SEQ ID NO: 9182 - DNA, 435 bp, Homo sapiens
cagaaaataggattattctagtcaaaaagaatgtgaacctaattttttaatagttgggagaagtttttgtagaaatcatttcatgctttttaggtagaaaaggggctagacatggatcaaggaatcatataagaatagaaagagcttctgaaaagggacacacatatataagagatggtgaaaggaatttggatttagcatcccagtacctttagttggtgatatagcagtttagtagagggtaactgtaacacagtaacaaagacttttcagaaactcaatgtaaaagaaagaactgtagcagtggctcacgcctgtaatcccaacacttggggcgtctaaggcgggcagatcacctgaagtcaggagttgaagaccagcctggcaaacgtggtgaaatgccatctctactaaaaatacaaaaaaaaaaaaaaa

SEQ ID NO: 9183 - DNA, 427 bp, Homo sapiens
catggtgctggcatctgcttggcttctggggaagcctcagggagcttttattcgtggcaaaaggtgaagagggagcaggcacatcacatggcgagagcaggagcaaggctgggggagataccacacatttttaaatgaccagatctcatgaggtctcactcactattgcaaggacagaactaagacatgaggaatccacccccatgacccacacatctccaaccaggccctacctccaacactggggattaaatttcaacatgagatttgggctggacaaatatccaaaccatgtcagtgaatatattttagagtttaaaagtctgtttctaagcttaactttgatatgaataatttaaacacacatgaatgtgccttcaaaccaaactatacaatgtgtaaaaaccccttcgttccacattggggt

SEQ ID NO: 9184 - DNA, 422 bp, Homo sapiens
tagctgggattgcaggtgcctgccaccacgcgcastgatttttgtagttttagtggagacggggtttcgccctgttgcccagtctggtctcaaactcctgggctcaagaaatctgcccatctcagcctcccaaagtgctgggattgcaggtgtgagccaccgcacccagccttcttgtactgtttcacaacaccttgttcatagttgatatctawtaaatttggtatcaatatattttgatacctaataatttttgtggacttaagtgcaacaaaggtatgcacagtatagtatctttcctatggaaaagtctgggacaaaaaagtcaggtgaagtaaaaaggccaattctagggccaggtgcggaggctcacccctgtaatcccaacactttgggaggccaaggcaggtggatcacttcag

SEQ ID NO: 9185 - DNA, 392 bp, Homo sapiens
aaaaaatgccagsaatcaagcccatttctttctcaaggggaactgagtgatttggcagggtttggggaaggttgcttgtccctaaagcatcattccgtcccactctggtgctgtgcacggagctcgactatcctgaatccaccatgattcgacctcatgtcagtcctttggctgccagcccagttcaactscaaagctgatgrcccagtgtcgaccgccagtcattctgaacatttgaccagttgagctttcaaatgatggcagtcctggctaracattttgggtgaacaatatgagagactgactgggttgagcccttcccaaatttcgtgacccacaacattgtgagrvbkaataatcttaagcctctcaaaaaaaaaaaaaaatgcgaa

SEQ ID NO: 9186 - DNA, 417 bp, Homo sapiens
gttttggggcttgccctttcagaatgctacctccaggtgatgaaacatgaccagctgacagccaacaccaacctctagacatgtgtgtgaggccatattagaccccacccctccacccaggctcagctgaactgccagatagatggcttcggcagcatgaaccatcaggcacaaccagcagaagaaccactaggagctacgcaatcacaaaggtcacttcttcagtcaagtgcagcagatgggatcttgaaagtgcctacaagtagtctagaacaccttgaatccggctgtgaaaatgtagggtaaatctgtagctctcagtaggtaaacaccttatttaggtctggaggcattttgctatgttattgagtcatggaaacctattaaaagagctctatggcaaaaaaaaaaaaaaaa

SEQ ID NO: 9187 - DNA, 411 bp, Homo sapiens
aaaattaaaatatttttttaaaaaagaaaacattcaagtcatggtttttgaatgttcatatgaatcattttattaaaatatttcaataaaatcaataaattcacaaaaaaactgtactttttaaatggaaaaggtttatctcctggcaccctacactaaaagcactttagtattttttctttccctcattctgttgttctaaaaggatcattattatacatggccaggttatgtgatatgatagaggttgaagtaagataatgtgcatagccttctacttttgtcttccaatgataactgattttctacctgtttgagcccaagagtttgaggccgcagtgagctgtgatcacaccactgcactgaagcctgggtgacagcaagaccctgtccctaaaaaaaaaaaaaaaa

SEQ ID NO: 9188 - DNA, 460 bp, Homo sapiens
  misc_feature 166,263: n=a, g, c or t
ctgattcagcttccagagtagtcagagctacaggcatgcaccactatgcctggctaatttttaaatttttaataatctatttatttattggcttatgaacaacataaatgtatttcttacagttcgggaggctgggaagtccaagatcaaggtgctggcaaacttngtgtctggtgggggtccactctctggttcatagatggctgtcttttcactgtatcttcacatggtggaagaagtgaacaagctcctttgggtgwcwnwcataagggcactaatcccattcatgagggttccacactcatgaccttatccccttccaaaggcccctctagctaataccattaacttagggatttgaatttcaacatatgagttttgaggggacacaaatattctgaccataacaccatacaaaaaaaaataatttggccaggtgtggcggctcatgactgtaatc

SEQ ID NO: 9189 - DNA, 426 bp, Homo sapiens
acttgtctgtctctaataatatttcttctctaattgccccaaaggtttagaataggagtgagcatcacggtgaaacatgctactcaagtttgttttgctaatcagcttttccaccacagcataaaatttaaaagaggctttcaaggtgtatatttagtttgttttcagtgggaaaattttctagagggaaaaagtattcataatgtttaagtattgatttggctttctgccagtctgttcaaataagcattaataaatttaaatacaaaagcaaaatagacctgagtggtagctgaactgcaaagcaatttgcctatacaaaactacatgcgagaaatacatgctttaggctgggcacgctggctcacgcctgtagtcccagcacttttggaggccgaggcgggcggatcatctgaggtcaggagt

SEQ ID NO: 9190 - DNA, 369 bp, Homo sapiens
cagtgtcatgaaatctgggttgaaggagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaatcatctaagttatgaaatccaacataggcgctatattacaaactgtgccggattatgcaaattgtagttgttactgatcaaagtttaattgcttcatttttgtttaaaaagggatactgatgtcagaaaatctgtaa

SEQ ID NO: 9191 - DNA, 380 bp, Homo sapiens
aacatgcaagaccagatggctaatctaaacagagagaaactctaagaaagaatcaaaaggagttgctagaaatcaaaaacactgtaacaaatgaagaatgcctttgataggctcatcagtaagttggaaacagccaaggaaggaatcagtaaggaaagaagacatggcaataaaaacttcccatgctgaaatacaaaggaaaaaaagactgaaaaaaaggaacagaatatccaagaactatgggacgatttcagagtataacatacatgttattggaataccaaaaggagaagagaaaaagaaggagaagaaatatttgaagtagtaatggatgagaattttccaaaattaatagcagataacaaactacagatctggga

SEQ ID NO: 9192 - DNA, 313 bp, Homo sapiens
atagctgctttttcactcgtggtcctctccccatcccttgctctgaccccagagctctgtgtatttgbcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagacaaaaaaaaaaaaaaaaag

SEQ ID NO: 9193 - DNA, 349 bp, Homo sapiens
ataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggcc

SEQ ID NO: 9194 - DNA, 371 bp, Homo sapiens
cttagagagttgaaatcaagtccaaattctttactgtgtgtaacattcaggatcatcaagtgatctgaattgaacctatttttccaacctcatcttcagttattctcaagccaaactagactcacccttctggaacatagcctactttacagttctctctatcttaattaccttaaatacattacctgccaaaatcttatctctttttaaactaaagaaatgtgacattttctgggttttctatagtttacatatatttgtaatataagatgtgggaagacaaatgtctggataagaatgggggtagggggattgcctgacaggtgggaggttgtgtggggagactaatgtatacatggagtgagaatggc

SEQ ID NO: 9195 - DNA, 167 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttttttttttttttk

SEQ ID NO: 9196 - DNA, 283 bp, Homo sapiens
tattggatacttaccaggtgtgcagattacaccagcttctttggtttgtatgaggcatacataatggaaagccctgccctaggatagctttcaatgtatttgagaagtccagatgtataatgaaaccagaagacatttgaaaagcaaatgaacagtaattatactgaacaaattttattatatgcaaagtggccctgaagatgtagaataaaggagtgacctgcttagtataggctcagtaagaaaggcacatcttgttggatgggtgagttttgagctggay

SEQ ID NO: 9197 - DNA, 418 bp, Homo sapiens
cgtttgcattttaaaattaaagttttcaatagttttcaatacaacaatgatactatctcaaaatactcagcatgtctaacaggcctcttttaaaagctcagcatgtttaatgtaggtgttgctaacgtccaggtggctcctataagttaagggtccattgatttagaagttctaaaagagactaacctaagggataccaataacagatatttttaaagaatttcatagaggagatacacattagaaacccagaactctaagatgtgcatttgctaagtcctgtaaacagacaagaaaacacatttacattagtttgccctttaaagattatttcctacttgtcycttatcaatgkgagtacataaaagagaccttattacaattaaaaacaatgatggtttagcagcagatttagatr

SEQ ID NO: 9198 - DNA, 383 bp, Homo sapiens
cattacatgaagtccagtgttaggcaggcaggagctgctcccgtgactcagtgacatcaggttggtccacatcctagcagttctcttggtgttcctgcgtgatcaaaggatgactgccacaccccagcctgctgacctcagccctggcgtgggcataggagggtctgcgtggctgagcatccagtgtccttcgtactgccactgacagcctcaggcctgatttccagcactgtctgtccaggagcaatgggagcaagagtcactccacaagactctggaggcctgatagacaaaatacatgaagaccagtttctacacagagaatcactaaaagatggccaggcgcggtggctcacgcctgtagtcccagcactttgggagac

SEQ ID NO: 9199 - DNA, 415 bp, Homo sapiens
  misc_feature 415: n=a, g, c or t
agcacccgccaccgtcgccggccgcccgcacgtccgtccggagctgtgactgatgagaattaaaggccatggatgaagatgggcttgaattacaacaagagccaaactcattttttgatgcaacaggtataactacttgaattgttccacttcccatctaccagatttggagttggttgtcatcaatgaattgctagaactctcacattgatcattcacaggttatcttgttatcctgtcaaaattcacaggtgttacggtgagcacattattattaccctcctcaaagatgtggctccctcacaaccaactctcatattcttgtcagtaacagcagcaatatcaaaccttagttttatcttcagttatgaagataatatcttgacgagttatgtccctaattcctgttgttttn

SEQ ID NO: 9200 - DNA, 446 bp, Homo sapiens
ctgaagaggctgagaatcccgacagtaaggggatgcccagggcatgttggaaagggttttggggggaacagtgaaagaatgatttggaaagagcaaagtatgagggtgattttttggaagagatcagtgtctagagaagcagaatactctgctctaagcctgttctgatttagagagatttccttagtcatcagacttgatcctgggaaaactagtcaagtatagaccttgtgatgttcaactcacacagcttagctctgtatctactcaccaagacttcttagagacttactcctattgtctgaactttaatacagacataacttgttttttcaaatttaagttagcattttgttttatgattataagagtactatatgctcttataaaattcaggccaggcacagtggctcacacctgtaatcccagcactttgggaggccgag

SEQ ID NO: 9201 - DNA, 420 bp, Homo sapiens
agttccccggggcggasgaggcggcggccgccgmrccrgabggawwttcctcagataggcgactacatctctggaagcagcagctccatgctggatgtggtggaagaatcgwgagggaatggactggaagtttggaatcaccggamaataacaaggcatagctaagctgtgactagcaagataaacgatttgttcgaggtttgattgtcctttccctcctccactcggaagacatagttgtctttttttaaatcatgttttgtaccgaaatatttktattttataattgaatccctgttgttgggcctttaaaaacccatagaaacattgttatgtgccacgaaggtgggaaacacggctttctcagtcattgctgtactcccacaattctgggtcatgcacacaatacaggtttagtaa

SEQ ID NO: 9202 - DNA, 442 bp, Homo sapiens
tcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattgatctgtaaaaacttctttaatctacaactgtttacaaaaacaacattcaaacaaatagtacagatgtcagtgacagaacaaaatgacttttcttggagacattccagattgccatattactttattttaaacagcgctatgactttaaatccaaggctgctcggaagatttttttaggtctctcataagcctattcttccctgatcacatgagtgggaraggtagccaaattttgaatt

SEQ ID NO: 9203 - DNA, 414 bp, Homo sapiens
cactggttggcagtctgaaatctgcttttatatttgatgaaacagttgatattgaaccccatttctgaacttctaattctattaaaattaacattataatcatgcatattcctgtgaccgccccgccacaagatataattggtttgttgttgttcttaattttcaacacctttgttttaccacatagccagaatgataagcaatgctcactggatccaactaggagttggaagtaaattataggtagccatctggtaaatatacacagccaatgagttgttcttagaaaattgtcaaatttagatttttcttccagattaaaaaaaaagacagccaggcatggtgtctcacacctgtaatcccagcactttgggaggccaaggtgggcagatcatgaggtcaggagttcaagac

SEQ ID NO: 9204 - DNA, 423 bp, Homo sapiens
gtttggaaattggttctattagaaaacactgtttgcacatccaaatgttcccagtcaagatttcccaatagtggcagtgagaaagagaggcagagagaattaggatacttgggttcaaattttagcttagtcactgatgggctgattgagtgagaagaacttaatcacctgcaaaatgaattgcttacagtattttgatctctaaatacacttttgattctgatatttaatgattttgtattacaaaattgggcagaaaacgcatagcttcataacaagcaaaaattttactgttaacacatcatacttattttagagtaaatttgaaggaggttgatgttttggaatttggttggagagttatccaaaagcaatgtttccctgactcaactacaaccaattacacacagtggccagtaggaa

SEQ ID NO: 9205 - DNA, 149 bp, Homo sapiens
gtagttaagacgttctaggcartaccatagacacatctgactgtgtctctctctttgagtgcaagaaactcaagtcatcttaaaaaaaaaaaawtmcaaaaaaaatttwcaaaaaamcaaacmcmcaaaaaatatcttttttaggccar

SEQ ID NO: 9206 - DNA, 89 bp, Homo sapiens
cagcattaatgtgtaatttaaatacaataaaactcacatatttcacatgtacatggctgttggttgtatacatccaggtaataatcaag

SEQ ID NO: 9207 - DNA, 378 bp, Homo sapiens
cattagaagtactcaccgtgtcaggatctttccacttatgtatttggaggaagtaggccctcatgcctggcttataagttgaatttttaaatgggtattaagaaaatagcattcaaccagtaaggttaactttttaaacttttttaaattaaaaaaaacaattttaggccacgtgtggtggctcacacctgtaatcccagcactttgggaggctgaggcgggtggatcactttaggtcaggagtccaagaccagcctggccaacatggcaaaaccccatctctgctaaaaatacaaaaattagctgggcatgttggcactcgcttgtagtcctagctacttgggaggctgagacatgagaattgcttcggtctgggaa

SEQ ID NO: 9208 - DNA, 473 bp, Homo sapiens
tcttcatcgagcgccatggccgcagcctgcgggccgggagcggcgggtactgcttgctcctcggcttgcatttgtttctgctgaccgcgggccctgcctgggctggaacgaccctgacagaatgttgctgcgggatgtaaaagctcttaccctccactatgaccgctataccacctcccgcagctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacgg

SEQ ID NO: 9209 - DNA, 448 bp, Homo sapiens
aatatgagtaatgcagtggcagatcttctatgagaaattaaaactggagaaagagggctttcctccttgaaggaagggtgttgggtgaactaacactattttctcctgccctttcccccaatctcaatccctttctctccaaacattcttccttcagcaccccactctggcactcaaaaagccatgggaatgggaaagaagtggctggaagtaaacagcctgcttactcacagcaactgaaaattttgtttcgacgattctggttccaggggcaggagctgaagattaatgcctggagtctgccccattctgagagcagcagcctggctcctggtggctccagcagcagctcctcacatctcctagttctggtgaaatatgctgccatgggggaaatgacaaagcagaggaagaaatcagcagcaatatcagtaacagcacccagaat

SEQ ID NO: 9210 - DNA, 434 bp, Homo sapiens
taatggatgttaaaattttatttctttgttttggtaagtagattaaatcgagaatcatataatcagtacatttgagaahkatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaagtttcataaatcttttagttataaacaggaaagttttatattagtggtgtcatttcatttctagactgttgatggtgatgatgataaagaatttggagccaattttgatatatgaatgtwtkgcttttacatgtgatgattaaagctcttca

SEQ ID NO: 9211 - DNA, 369 bp, Homo sapiens
caaaaaatctgaccaaaacaaacaaacagaaaacagaaaacaaaaaaacctctatgcaatctgagtagagcagccacaaccaaaaaattctacaacacacactgttctgaaagtgactcacttatcccaagagaaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaa

SEQ ID NO: 9212 - DNA, 361 bp, Homo sapiens
cttttttaagatgatcttgctccgtcacccaggctggagtgcagtggcgtaatcatggcttcctgcagcctcaaactcctgggctcaatgagttccttgagatcttccatcctcagcttcccaagtagctagtagtagtagtggcttgcaccaacgctcctgccctaattttcaatatttttttgtagagatgggatctcactgtgttacccaggctagacttgaactcctggcctcaagcgatccttccgccttggcctcccaaagtgttgggattacaggcattagctaccacacctggccaaggcccaggtttcgacagaaagggagagaaaacctgccasagatgscatttcggagc

SEQ ID NO: 9213 - DNA, 457 bp, Homo sapiens
actactgtcttcacatgttgttcttaaacttttcccagtttgatggaatattagttaatcctatgattaggcctagtacttttggaaaaacaaaaaagatctacctattacatgggctggttaaatccagatgggggtattccccagcactggttctattaacttctatggggcagttaaataatgttttaagtagtgtacttgtccttcctatcagtatcagcagactaaagagggccagccaacttattcttgacgggtacagaaccaggagttgcaaattcaaaagccttcactaggcaggaaaaagagatgtatgcagcttcccagcagaggtccacaggagagaggaaaacaaactgcagtgtgtctggtgattataaagttcattctaggtataaggaaccggagctaggtattcattcacggagctcacagtcttgttctgaagattaga

SEQ ID NO: 9214 - DNA, 388 bp, Homo sapiens
  misc_feature 140: n=a, g, c or t
aacctgctcgggtcacgttccacacagtggaagctttgttctttcactctttgcaataaatcttgctaccgctcactctttaggtccatactgcttttatgagctgtaacactcacctcgaagatctgcagcttcactcntgagcccagcaagaccacgagcccaccgggaggaacgaacaactccagacgcgctaccttaagagctgtaacactcactgtgaaggtctgcggcttcactcctgagccagcgagaccacgaacccaccagaaggaagaaactccgaacacatctgaacatcagaagggacagactccagacgcgccaccttaagagctgtaacactcaccgcgagggtccgcggcttcattcttgaagtcagtgagac

SEQ ID NO: 9215 - DNA, 429 bp, Homo sapiens
atctgcagcttgctggctctctctttctccttctctgtctcactctctctctttctctccctctcctatcggagcacaatgaaagcctgtgtatcgccgtgactccgggcgggagccagtgtcagcaaagcggctaacaacagacgagaaagagaaaggaaaatacaagctactttttttttccatctatagagcggasaaatacaggagatagaaccagattgcttattgcgagtccagaccctcagatccactggccggggatggaatgtacaaaagtggacagaaaagtggctggacatgactcggtgcaatttgctggaagtttgtaagtttgaccatcgtttgtaaattactctcggaagagtttgtctctcttgatactgtattagaatagagccgggggtgaggaatagaaacgtaagcgaa

SEQ ID NO: 9216 - DNA, 56 bp, Homo sapiens; identical to SEQ ID NO: 8337

SEQ ID NO: 9217 - DNA, 465 bp, Homo sapiens
ttgcccgggcgctgggttcaggggctttccgcccctctggttcacagctggacgtcgggagtgctagtttggagtacgccatttgagagtaggcgtgagaagttgctctgtgtgctgagcgttctaaaggaagccgtccgttggccttcgtacccgtcttgattgagctctcacactttggatacgctcctctaatcctgtctgaaagagctaagctgacccccaccaccgttggaggaaactcctggagcagtgctggggttttcactgcaatcagctgctccaactttgtcttgtacatggctctttgaccttgggcttgtggattaggggcctgtggaggagctctgtgactgctctgatatctgtggatggttctgaggcattgtatttagtgaaaaaactggaaaccatatgcatgtccatgaataaaaaatggggcataggcaaaaaaaaaamaaaaaa

SEQ ID NO: 9218 - DNA, 861 bp, Homo sapiens
gtaggcgtctggcagcccggcgccatcttcatcgagcgccatggccgcagcctgcgggccgggagcggcgggtactgcttgctcctcggcttgcatttgtttctgctgaccgcgggccctgcctgggctggaacgaccctgtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagsaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatagtttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggg

SEQ ID NO: 9219 - DNA, 448 bp, Homo sapiens
cttctttttttttttctgaratggggtcttgctctgttgcccaggctggagtgcaatgttgagatctcagctcactgcaatctccacctccctggttcaagcaattctcctgcctcagcctcctgrgtasctgggattacrggcacccaccaccatgcctggccaattttkgwatttttagtagagatggggtttcaccatgttggccaggctggycttgaactcctgacctcgtgatctgcgcacctcagcctcccaaagtgctgggattataggtgtgagccaccactcctggcctatttcttcttgtccaatctgcatgccttttatttcttgtcctttttaaaatttcttttyctttycttattacattgactggattctcgrgtaaaagcaatgaatgaagacatctttgccttgttttcggcaatagbaagaaaaacatgta

SEQ ID NO: 9220 - DNA, 225 bp, Homo sapiens
tcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaa

SEQ ID NO: 9221 - DNA, 452 bp, Homo sapiens
cacttgtgtggtcatgcctagctctaagagaagccaggaaatataaacttattgctgtgattctttttgtgaagaggaaggggatatagtgaggcagccagcattttcatggcagtggcagtcatgtggtctttcttcatcatgtgtttcaaacccagagagaagagtaacagcagctaaaaggtgggtagaaaagagagaagaagcctacaggctacctgtacagatcctagctggggatgcagcaggaagtcttactgtttgtttgatcttctttagagtcaatgthmgacattgacttgaacgttctattttctgaatcacaattattttttgtgacttaaaagtaactttaggactttctgttacctacaagtggccagaaaattatagggcctactagatttttccttgagtagcacgatagaagcataccccctaaatatcatata

SEQ ID NO: 9222 - DNA, 451 bp, Homo sapiens
gttaattacatggggctgaactgataaaatgccaaaataatattttcataacctttttttggtttgagacattgctgatactttttatgttttgttttccagagtcaagaaaattgtttttttcttttgagctgtacatagcttacagtaattagataaattacacttttgtgagaacaattgaaacactaacctttctctctacctgatgtctccagaatttggaaagtatttgtgagtattcttcacttttggcaatatagttatttgtacaaattcgataggaatctgttttcttttgtaacagaacacagttggatacactgattattttgccaagactttcattggaatggcataattttttaatgaccagactgctttgaggatttgaagttgactttatagagcctataaaaagcctgttggaaaaattagcctgataccttgg

SEQ ID NO: 9223 - DNA, 449 bp, Homo sapiens
taattattttagtatctctctgtctgtatctgttttaagctaaactgatatctcttgatctaatctagcatcacatggtttgttctggccttcccccattgtttatctgtagtttcctaatccagtagtaagaaacctggctttcgggcgggtgcggtggctcacgcctgtagtcccagcactttgggagacggagggggtggatcacagggtcaggagatcgagaccatcctggctagcgcggtgaaaccacgtctctactaagaatgcaaaggattagccgggcgtggtgatgggcgcctgtggtcccagctattcgggaggctgaggccggagaatggcgtgaatccgggaggaggagcttgcagtgagccgagattgtgccactgccctccagcctgggcgacagggcaagactctgtctcacacacaaaaaaaaaaaaaaaaag

SEQ ID NO: 9224 - DNA, 277 bp, Homo sapiens
  misc_feature 200: n=a, g, c or t
cattctttttttttcytttttgaagacagagtctcactctgttacccaggctggagtacagtggcacaatcttggctcactgcagcctccaccttttgggcttaagctattctcttaccttagcctcctgaatagtggggactacaggtgcacaccaccatacccagctaattttttttttgkgtatatatatataabbnbbktttgagacatgcagttttgccatgttgcccaggctggtctcgaattcctgggctcaagcgatctgcctgtcttr

SEQ ID NO: 9225 - DNA, 97 bp, Homo sapiens
tatggatactggstccasctgyttgkktctcttgctggggtttgtgatacccgtagctgtggtyttctgtagtcasatctctctccagtkttgggas

SEQ ID NO: 9226 - DNA, 355 bp, Homo sapiens
atgataaaactgaaacccataaagggtaagggatttgccgaagtcacacggctaatgacagagctggtggcaccagaagaagtctacctgttctttgtatgttttaaatagctttattgaggtataattgatcagcaaaagctgtacatatttaacgctcacagtttcgtgagtttaatcattgtgcctctttggttttgggggcggtttgggatttttttgttgctattgttataagaacacttaacatgagatattccctcttaacaagtttctaagtgtacaatacagtattgttaactataggcacttctgtttctccaacagatctgtagaacttacacatcttacataa

SEQ ID NO: 9227 - DNA, 447 bp, Homo sapiens
tccttagtgtcagaacagtacttagcacatcataagcactcactaaatatttatcaaatgaattaacgttggagatgagaggaaggaggaggtaataatggaaagaggacaaagaaagagaggcaagggaagacagaaagaaaacagatttggcctccccacattttctgggcacagatataacggctctctcttgctctttgctcccaatcaaaactcagccagcctcatgtccaacatctcatgggcttgcctccagttctctgcactttccaaagtgatagctgactaatcaaagatattgtgataatgaattgcctaactacgcagcctgccttcttctcttctagcatgtatttgattaggggcctgctgaaaccaattaagtaaataattcagtatgactttatgaactacctactacatgcatggcttaacacaggcagc

SEQ ID NO: 9228 - DNA, 371 bp, Homo sapiens
cattagtctgtcttatactgtaaataaaaatgaaagcaccagctggtaaagttttcaaataaagacataaataaggtttgatatgactcagtgtggtatgttccttctcttcctaggaaactgaaaaacagagtagcagctcagactgccagagatcgaaagaaggctcgaatgagtgagctggaacagcaagtggtagatttagaagaagaggtaaaactacttaaggtcaaactcttttatccattgtatacccttccttggtgaatgttctgatatttgcttcccatcccaagttgtttcagcccctattagaatacaattgaatatatgattaaaagttaaactaggctgggcatggtggctcatgc

SEQ ID NO: 9229 - DNA, 384 bp, Homo sapiens
acctttatttttgaccagcttcatttgtcagctttgctcagatcagatcgatgggattggaatacattgtaactaaaatcttcctcaggactataaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtaattccatcattttgggaggccacagtgggcagattgcttgagcccaggagttgaa

SEQ ID NO: 9230 - DNA, 379 bp, Homo sapiens
twrgtttttaaawttsyttttttymawarggwattwawaaakttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagaaaaaaaatgaaatggttgtttactaattttatactcccattaaaaatctctaatgttaagaaaaccttaaataaacatgattgatcaatatggcagatgatttacagtccattatatgacatttgtargccactmaacacta

SEQ ID NO: 9231 - DNA, 409 bp, Homo sapiens
  misc_feature 409: n=a, g, c or t
tatgagtcaggtactttacaaggtgttcaatggacattatctattttacttatttttattttatctttttggtttactttttttctttttttttcattttacattatctattttaatcctcacaatatccctgtaargtaggtatattaccttcagtttccagatcaagaaactgaagtgcacagaagtttgaagtaacttactcaaaccacttcactaataaccagggtaggcaggactcaaatacagacagtttgcctccaaaatacatggtcctaatcacctcccwatgttgtgtccatgcagtcacgagtttggcatgaggagagctggaggaagagcccaggagacagtgaagaggaatcaagaggctgtatatgtagccagctgggtttgggggcactcatan

SEQ ID NO: 9232 - DNA, 408 bp, Homo sapiens
  misc_feature 131: n=a, g, c or t
attgctcgcgctgtgaccccggcttgaggtaacaccgcgagctgaggctggggcccttggcgcggaggctgagggacccgccgcggcgctgtcgccggagagggagggcaccgctgtcgtcggccagaagncaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggataggccctgggtcccgggatgcccctgcccgagcccagcgagcaggagggtgagagtgtgaaggccagccaggagccatcccccaagccaggcacagaagtcatc

SEQ ID NO: 9233 - DNA, 427 bp, Homo sapiens
  misc_feature 378: n=a, g, c or t
aagacggaggttgcagtgagctgagatcgcaccaggggactccagcctgtgcaatagagtgagactcggtttcaataaataaatgaacaaactggaaatgacattttttccawccatttaaattcatgttgaaaaattttagatgtctgtttaaatgtgtgagggcatatatagtttataaaaatttaatttatagcaggtatatgtgcagaatttttttgaagatgactaatctatagcagggtttctcaacctcagtgctattgattttttggactgggtaattcattgttgtggggaggctatcttgtgcactgtaggatgtttatgagtatccctggtctgtastcrctatatgcccctagcagctccccagtnacaactgaaaatgtttccagaccttgccaaatgtcctctggggagtaaa

SEQ ID NO: 9234 - DNA, 425 bp, Homo sapiens
  misc_feature 390: n=a, g, c or t
tccccaggcagcctgatttgcttctggatttttattctgttccattcacctgtccttgttcttatgccaggatccacaccattttcattaaagaggctgtatagaaaattttaacgtctgggcagcccattcccctctgatactctccagggttttctcaggtgttcatgtttgtttctctaagtgggttttatgatcaacttgtctagcaccctgagaaagaaaaagatgatgtgtttattggggctccttaagtgtatgcattaattcagggagaactgatgtctttgtcatgtggagcttccctatctaaagctatcatataccttttccatatgttcaagtcttctgtgtctcaggagtattttatagttttcctcgtatcagcanttattaaacgagaatgctgaaaaaaaaaaaaaaaa

SEQ ID NO: 9235 - DNA, 438 bp, Homo sapiens
caaaataataatttacaaagatgcatctttacccattattttaaaatgattaaggaggatagttgcttcaggtaacaagctaatttttcaaatattaggcccttacagaactatttagtcaaaaagtaagatattcctwwaaaatatataacccaaagctttcagttaaacatgatatatcacaaatactattaaaatgttaaagagaaatgcaaatagcattaaatgatgaccaaaatgtaaaatattgtagatttcaaaagctgtgtctctattaggtgggataccaaatgtatgatgtaactgacgttgttttttactttttactttttaaaaaagactaaaaacgttttgatattatacaatgtatttgtttcagataaggtcattgtcatttagtatatataattaatatatgtacaagtttaagtaaattcc

SEQ ID NO: 9236 - DNA, 435 bp, Homo sapiens
ccagttttctgstrggagtccggattctggtgctttgctccgaagcagtgcccgtgggcctccgggcctggctcatcatcacagcttctctgctcagtgaggagaccatcattgtgctgcttttctgatgccttccatttgcctttttctccacttgggaaaaacaaaaaaagctagtatgctacatcctgaaaagttgttaatccttcaccaccacatacattgaaaaatcagttcctgccgggaagtaccactaaaggcatattgtaaactttttttctaattggaaaggtaaacttttttcccccataactatttttcgtgtdaaggaagtamygagctcttgrgtcaaagarratggcactcsgagtttttccccawgggtcttgcctgctamactcctggccaccctttctgtggggcttgaccaaatgg

SEQ ID NO: 9237 - DNA, 88 bp, Homo sapiens
tatattattttcacttatttcttctttaatgtttttcctttatatagatctcagcttctgacctatattttccttttttttttttttk

SEQ ID NO: 9238 - DNA, 455 bp, Homo sapiens
caataaaatgtgatagaaagtagtctgtgcgttgttagcgccttggtgtcctcttagtggaatgctgtaacctctcctattcagatctcaagtctctggtgaaattttccatcttctagttttttgaacataattctcatagcttttttaaaaaagtcattctctgttaaacatagaattatcatatgctctagcaatctcacttctgggtatatacaccaaagaactgaaagcagagacttcaacagatatttgtccaccagtgttcatagcagcattactcccaagagccaaaaggtggaggcagcccaagggtccactgacacctggatatgaatggataaacaaaatgtggtacatacatataatgggatattattcagtcttaaaaaggaaggaaatgatgatgcatgctacaatacagatgaaccttgaaggtacattatgttaagtga

SEQ ID NO: 9239 - DNA, 126 bp, Homo sapiens
cacatttagattataagtaagatatattgcaaaactgtagtaggcagccaatatgatatacctgcttatgtatagcagatgactgagaaaacttcaggtaacctattttaaaaaaaaaaaaaaaat

SEQ ID NO: 9240 - DNA, 510 bp, Homo sapiens
gagttttggatctcagctcctttgagagttgtggaccagtcagacacaaaattatctttaaatatacagatagggatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagattttagaaatcttgagctgtgtcttcagtatgctgtctgtgaaataaggctatcattgcgtggcagccaagattttcaccagattgtgattcccttatgaccatttgccttcctgggtaggaagtgataaatggcctgataacaaacctggcaaagaaaacggtctcgacaatgagtaggccacccatcactactaactacagatgacttgccatttcatttacaaagatgtcttctgctgctgaaaatggagaggcagcacctggaaaacaaaaaa

SEQ ID NO: 9241 - DNA, 483 bp, Homo sapiens
  misc_feature 440: n=a, g, c or t
acataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctcntttcctttcctaaaattggggaagtacagcccatgctgacatt

SEQ ID NO: 9242 - DNA, 496 bp, Homo sapiens
atttcatattttatttatttgggtcatctcccttattttgttagtctgttaattttgctcatctttaaaaaaaaccaactttttgtttcattgatcttttctttatttcaaattcatttatttttgctctgatcttcatttcttttcttctactaattttggtttggtttgttcttgcttttctggttctttaagatgcattgctggctggatgtggtggctgatagctgtaatcccagcactttgggaggccaaggcacgtgactcacttgaacccagaagtttgagaccagcctgggcaacatggtgaaactccatctctaggaaaaatacaaactagtcagatgtggtggtgcacgcctgtagtcccaactacttgaggggctgaggagggaggattgttgagcccaggaaggtctaggctgtagtgagccatgatcatgccactgcactacagcctgggcaacagagtttctctctatctcaaagaaacaaa

SEQ ID NO: 9243 - DNA, 214 bp, Homo sapiens
  misc_feature 12,128,159: n=a, g, c or t
ttgtctagcccnagtgcaggtgatacatgcagttatcatttattgagcatgtaccgtgtgccaggcactaaattatgtgttttgtatacttttcatgtaatgtttgtgatagtgtaggtcattttatncccactttacatgggaaaactgagactacangamataattagcctagttcttgctgaaaaaaaaaaaaaamaaaaaaaaaaaaaaa

SEQ ID NO: 9244 - DNA, 439 bp, Homo sapiens
tactcaaagaagtgtagaacagatcctgtggaatttcttttcaggactagtaacagtataattwtwgcttgtacacaaatcaggttttttccccccaccagaatgccaggttaaattatttcaagtctataaaaattgtttgttttggccaggcatggtggctcacgcctataatcccagcactttaggaggcctaggtgggtgaatcacgaggtcaggagttcgagaccagcctggcctacatgattgaaaccccgtctctactaaaaatataaaaaattagctgggtgtggtggtgggcgcctgtaatcccagctactcgggatgctgaggcaggaaaattgcttgaacctgggaggcggaggttgcagtgagccgaaattgcgccactgactccagcccgggtgacagcacgagactctcaaaaaaaaaaaaaaaa

SEQ ID NO: 9245 - DNA, 472 bp, Homo sapiens
caattctattttattgatctatatgtctatgtttatgccaagaccacatagtcatgattactgtggctgtgtagtaaggttttaaatttagaagtgtgagttctttaacattgttctttttcaagatagttttgactatttttggtccctttaatttccatatgaatttcagatcaccatgtcaacttctgccagaaagacagctgggattttgttagacattgcagttaaatccgtagaacaatttgagggaatatttccatcttaacaacattaggtgttctgatacatgaacatggaatgtctttccatttatttaggtgttctttcatttctttcaccagtgttttgtagtttccagtatacaaagtttgcattaattagttaaattcatttctaagtattatttttcagaccattgtacgtgaaacagtgttctttatttttgcattgtttattgctagtgtataga

SEQ ID NO: 9246 - DNA, 409 bp, Homo sapiens
aaaataatgtaaaaatcctctataaaatattagcaaactaaagtcaacaacacatcaaaaagatttcatatcatgaacaaatgggattcatccctgacatgcaaggctggtttaacatatgcaaatcaatcaatgtaatatatcatgttaactgaatgagagattaaaaaccacatgattgtctcacttgatgcagaaaaagcattcaacaaagtcaaaaatcctttcttaataaaaactcttaacattttaggtaaatacggaaaattcctcaacataataaaggccatttggaaaaactcaccgctaacattagaatcaatggggaaaaactgaaagctttttcattaagatccagtatgaagccaggttgtctactctctttaattctattcaacatagtgttaga

SEQ ID NO: 9247 - DNA, 398 bp, Homo sapiens
  misc_feature 328: n=a, g, c or t
cagaaaattttggtttcagtccaggcactgctactgaaaaactttggtctaatcactttatctcaataagtttcaattatttctcttataagatggggccaataccacttgcttttctaccctaccagagattgtagctactaggaagaatggaaataattgaaagctttaaaacaatataaatggaaatgtaccccatcttaaaaaaaattagccaggtgtgtttgtagtccccgctacttgggaggctgaggcaggagaatcccttgagtttaggaggttgaggctgaagtgagccatgatgatgacagtgtactccagcctgggngatagagcaagaccttgtctcccaaaaataacccctaaaarggasgctgaggcgggggaattgcttgaac

SEQ ID NO: 9248 - DNA, 387 bp, Homo sapiens
ctttccggttagcagtcatgcctttccaaagatttgtccaaactggtcgcattgcgaaatgctcggctggtcccttgaagggacgtctcgtcgctattgtcgacgtgattgatcaaaacagagttcttgttgatggtcctttgactggtgtcccccgtcaagaatacagattgaacaatctgcacttgaccaagtaccgcatcaagttccccttcactgcccccacccgcattgtccgtaagcatggcaagacagtgacatgaaggcccaatggaaggtcagcccctggtccacaaggtctcaaaacatctgcaagcgttcccgtttgaatgatttcgatcgtttcaaattgcgttatgccaaacgtcaacgcaacaagttgctcac

SEQ ID NO: 9249 - DNA, 509 bp, Homo sapiens
tagcgcttagacacggttcctttactaaagaccatttgtaggagattaggtgtcctttttttccctttcatttcaccgtctaggaagcgaaatgccttgttctataggcactaaaccaccacccctaccaaacctttctcggggaagcagaaggggaacttgtgccttgtgaggaagcgacaaaggccccttctggccctggagacttcacgccaatggagcaccagctctctgtcctcgcaatagcccgagtgcaggcagaacgcagtcatttgtgtttatctgagaggagctttgggatataaatagtttcaggccccgctgcgctgtcattccagcccagcctcctgattgagctgcttccgggcgggctttcttcttgttggcggtcccatgctgtgttcagatgggctctgtgacaggtttggatgttttctatcactgaataaaactttccactttggaacatattttctacactctattatctcatgtaagtcctgcaacaa

SEQ ID NO: 9250 - DNA, 203 bp, Homo sapiens
cactgtggttttgtattgagttttgaaattagaaagtgtgagtcctccaactttgttcttctttttcaaaattgttttgtttattctgtgtcccttgcatttctttgtgaatgcagggrtcatgttgagactgtagatcatttgggggggcattgccattttaatggtattaaaaatcttctcatccaaaaaaaaaaaaaaaa

SEQ ID NO: 9251 - DNA, 440 bp, Homo sapiens
  misc_feature 289: n=a, g, c or t
aaccttatgtaacttgtgttacatcaagtaacaagctaatctagtttgtttcactggactaggcttgtgctccctacttcagtattttgatgctttccttgatctttgtttcacaaaatgttgtgaattttggtatcattcaaaacaaatgacatttattaggtbtcattttgaaacgatgtacagacaagtccccaacttagaaaccggtttgttcttaaggttcttgcgtcasccatggaagcccactgacctmcaccacagcccaaatggagggctgtggtggccngatctggttggcttttgtgggctgacccagacatttaatcaccatctcttatgttgttgccgtaagaaatgcattccaggttgggacttgggatcctgagagcacattcgccccctgtggtggccgcttgccaccttgcaagatggaagcc

SEQ ID NO: 9252 - DNA, 163 bp, Homo sapiens
caacaaaaaattagctgggtatggtgtcacgtgcctgtgatcccggccgctggggaggctgaggcaggagaacctcttgaacccaggaggtggaggttgcagtgagctgagattgcgccactgcattccagcctggggtgacggagtgagactgtctcaaaag

SEQ ID NO: 9253 - DNA, 376 bp, Homo sapiens
agaaggcaacggscccgtggaaagtaatgcagtactcaccaaggccgtcaaaaggcccaacgaggattcagatgaagatgaagaaaagggagccgttgtcccccctgttcatgacatttacagrgcacggcagcagaagcgggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtga

SEQ ID NO: 9254 - DNA, 441 bp, Homo sapiens
ctggttctcgtctctgccctgccggagactgggacatccttttctctccctgggtctgtgtccccgtcgctacatcccagcctggagggcatggcccagcggttgcataggtccctcggtttctgcagagcccgggagtcaccctattttggtaaaggtgaattgctcctccatgggtcgtgaaagaagatcatgtcagtggtggtgtttctgctcgtctcagaagggaagtctgtgacccgtgggagttgctggggagggcctggtctgggccaggcctcttctttgggttgccccctcacacactctggtcatccaggaagcctctgtggccctcggaatgtgtaaaagatggtggttttaggagctgctggttttgcaactgagtgctgacggcttatttcttgttaatgattctgtcaaaagtgtcttagcgatgsc

SEQ ID NO: 9255 - DNA, 402 bp, Homo sapiens
tagacatgadatagagttccaaagtcaagttaacctatttctcattaagatgtattagtttcagtgtatcttgccctgctaraaacaatcttttttaatgctctatgttttgatctatttaatttttttaaaaraarcataataggrgtttccagtatggaaaatctggttgtctctaattcagtctctttatactaagtccagtagatccattttaagagcaggatagacctttttaaggtgaatatctttcagaggggaacacagtgtctgatgtatgctgatctaaatctaagaagttttttccaatctgagatctcttgccttacagatactgaaagcatcagtgtttctcttttctaaaattttcacacaaatttcagtcctgatggtgtgattttt

SEQ ID NO: 9256 - DNA, 531 bp, Homo sapiens
catttattgcccagtccatttaaagacccatgcaagagcctggtttgtcatccctgccctagcccaatctgaggctaagattggtaaactgtaagcccacacttaaccttgtcaataggttcttgaaaacttgtacttcaagagaaatgatgtataacaaaaccatactttttctcatcagttgttacaaggaaaggatgttgaacaaaaggcagttatttgaggactggctatacactgtttcacgtaaaagttggagttttcattgttctattaacaatgttaaatgaagacttactgtattttgaaaaccatcattaccttctccataccatttggctcccaaatttaaataaacaagagaaaacggtgttcatctattaaggacctgcagggtctgttcatctctgtggctcaacttaccattgcttttttgcttgaaaagcagcacagatgcaggaggaaaagtgattggcgcatagactgtcgccaccagggccatgtcagcagtcaggaatctctgcaattatg

SEQ ID NO: 9257 - DNA, 402 bp, Homo sapiens
atgggaracatatttagaatagaactagtaacacaaaggcaagcggaasaaagctatgtcatgaataagggtaagacattgcacaaaaaaaatccaggctcaggctaactattgcaatcaagttcagagtgtatcacttcctggtagccaaagtaaagagggaaatacaatgagttacttctctctaatgaaagagcaagcaactttctccaacgtgaagaaggggttttggctgataaaaggatcagtaaggaaatcttctggctttgtaaattatgttcaccttattggttcaacagattgaaaagtaaaggcaaccggccggggcgcggtggctcacgcctgtaatcccagcactttgggaggccgaggcgggtggatcacaaggtcaggrgatcgaga

SEQ ID NO: 9258 - DNA, 461 bp, Homo sapiens
caacgagtgatgatgaaatccctaggaaaaggccagaaatttggtctcgatctgcaatagttcactctagggaaagagammatattccacgaggcagtgtccagtttgctcaggaaatagatcaggtatcttcttcagagatgawacagmagatgaaagatctgaagctgaaaacgttgcagaaaatttctctatatctaacccagctcctcagcagtttcagggaataattaatttagcttttgaagatgcaactgaaaatgaatgtcgtgaattttctgcagataaaaagtttaaaaggtcagttttactttcagtcgatgaatgtgaagagctgggatcagatgaaggagaagtccatactccctttcaggcttctgtagattctttttcacctkctgatgtytttgatggcatttckcatgaacatcatggaaggacctgctattccagattctcac

SEQ ID NO: 9259 - DNA, 504 bp, Homo sapiens
aattgtgtgttcttatccttaaaattggcaatactaaaacctaccttatggggtggtcacaaggttagatgaaatcatgtatttgaaatttctatgtgaattttaaattactataaagatgggaaatgctgtttcaactttggttctacatccctattcccagtggggcagtcctagttatcataaaatgatatttttctcttgttgaaattaaacttgctcttatgacctttaacttttgcacaactgagaaccattaaaatagatttcctggatacagtgattgtcaaactatgggtaaagggcactggataattgtaggttggttcgttggtttgttttaaggaatattttkatttttcaaagcactatarracaaattkkcttagaaggtctggaatatgaaaatcatagccatgaacatttgtatgcttacaaagctgccaaatgatgcatggctagtgagtctcagagtatttcactgatgctcaaatgctgcttgtc

SEQ ID NO: 9260 - DNA, 291 bp, Homo sapiens
tttcattcacatttcgtcttcgtgtttcagatgtaaattataaggggttttaaaaagaggtggttaaatatgtgtacatgttaatagtgtgatcaagccaagaaggaggcctttgtctttgactggaggactcagaggaattttaattttgaaactcgctgattcacagcatagtcacgctcaagttcattagcacatttaaatggcagttttgtttcctcttctaagagtttacagtaaggtaaagaactcaaacttcctttcagagcaagtagactttttttttttttk

SEQ ID NO: 9261 - DNA, 590 bp, Homo sapiens
gaaatatatataaaatagaaaatcaaaacaagacctcatctaagatcatttaagctcaggggattttcctctacccactttcctctacccagtgttgtgttttctgtggcactgtttaccagttaacaggccactgaaactcaggatattctaatgcacattcaggacataaattgcattagttgggcagtacttggataaaactaggatgctccatggtgtcttactagatatcataggggtaacatcattttgcttatcatttcatcaacacgtttgttagaaaagagcccatgatgatcttacttttctagcttactbatatcacctaacagtttttgaagtgcacttaagtgccatttgttttcgaaaaataaaaaagacattaaaccacaccataagccataagtactaataaaggttgatagttgggtaaacttattggggaaactctaattattgcacggtgctcatgtgggactttaataaagtacattaagagtataggcctgaactgaaaattttcattgagaagttcatgagaataaaataaaatcataggtgattctttccaacatcattaaatatac

SEQ ID NO: 9262 - DNA, 519 bp, Homo sapiens
atctttgtyttccttycttgagacagagtcttgctttgtcacccaggttggaatgtagaggcacaatcatgtctcactgtagccttggcctcccagactcaggtctttttttatcctcttaatttgtttcaaatgtatatgatgttgaaagcaaaaaaaaaagtaataatgtgtgatttatatgtagatgtaatacatatggcaactatatcagaaaggactgggataggcaggtaaatagagtcatatggttacaagtttcttaacatttttcataaattgtatgatattaactctaagtagagttaatatctactagagctaatatctactcccatgtatagttcctaaggtccctcctgcttcagcctcctgagtagctgggaccacaggcgtacatcactatggccagctaatttttaaattatttgtagagacagtgtctccctatattgcccaggctggtctcggactcctgggctcaagtaatcccagcactttgggaggccgagacaggcg

SEQ ID NO: 9263 - DNA, 466 bp, Homo sapiens
catgattagaggaatgaatagtgctgtgttttaactttgtaaaatacaactcatgattagaggaatgaataatgtcaactcacatctctgtgactagatgcaggcttcttaggatatttgtaacttgaagaaatctggaaggacctcattctctaattgcccattttcccaatttgctttacaaatccttctgtggaaagtctttttgaaaatagcatttttgctccctcttagcctctggggttctgaacgctttggcagtgaccattgagaatcaccctgccttccatcagttaccttgtatcaccttataaaagtcatttggccgttgcagtggctcacacctgtaatcccagcactttgtgaggctgaggccagcggattgcctgagtacagaagttgaagaccagtctgggtaacatggcgaaaccctgtgtctacaaaaaatacaaaaaaaaaaaaaaaa

SEQ ID NO: 9264 - DNA, 455 bp, Homo sapiens
aggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttcctwccaattgttgtcctgatatttaaaagcatactattcctgccatgcttgaggaataagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaaaaaaaaaaaaaaa

SEQ ID NO: 9265 - DNA, 491 bp, Homo sapiens
aacaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacarattagatctaatactactgtcagttttaatgtccactgtgttttatacagtatcttttttkgttcactttggaaatttttactaaaaattgcaaaaaataaagtattgtgcaaagatgtaaggttttttgaaacttgaaatgcattaataaatagacgattaa

SEQ ID NO: 9266 - DNA, 534 bp, Homo sapiens
  misc_feature 86: n=a, g, c or t
acataaaacacggacagtgttttggcctcaggagcaggactgcagctggtggataacattctggcttctcattctcattctttaantgagataaatggtggataacattgtkvcttctcattctcattctttaaatagacaattcaggatgtgttctatctgtttctcgtggtagaattccctcactagtgaccatgatgaatgcccttcagtgagtttctctccttcccctctcactttccctgatctctcactcctggttcctggggttacttcctcaataaaccacgtttgccccataacagtgagtaaaaaggcacttcagagaagactatagtacaatgtattatttttataaatttcaaaaacatgtttatttagccagcagaaggggaagaaccactgacatatacaacaacatacatgacaaatctcacaataattatgctgagcgataagaaagtctgactggtttcatttcattttccagaaaatgcaaattagtttacattaaaataaagctgaccaaaaaar

SEQ ID NO: 9267 - DNA, 252 bp, Homo sapiens
tttctgttagactgcttttcagttctgtattgagtatcttaagtactgtagaaaagatgtcacttcttcctttaaggctgttttgtaatatatataaggactggaattgtgtttttdaagaaaagcattcaagtatgacaatatactatctgtgttttcaccattcaaagtgctgtttagtagttgaaacttaaactatttaatgtcatttaataaagtgaccaaaatgtgttgtgctctttattgtaaaaa

SEQ ID NO: 9268 - DNA, 487 bp, Homo sapiens
cagaatttgtgttaataymtgtaargctacagaaggtactctgaataatcgctgttacatgtaagagatggatttttcattccctttcattctctgcattcttaatatggaaattactctgatgggagggatgtgcagagggagtgactgccttagaaatagatgtatgaatggcgtaacttctatcattagtcaggaatgacctccatttataacctgtgcgttcccttccatttgcagatgtaagcaataatatgatacagcaagtgttcactcctgtggcatacttttaacctttctaagcttgtcagtgggaacaaatgagaggggtagagttttttgcactaattctgctctttggacaagtgcctgacatctgcttcattgggttttagtttttactggtgttggtgcttttgtctgtcataccatagtatttcaaaacttcaattgtttctactctgcaggttaatatggctccaaaagg

SEQ ID NO: 9269 - DNA, 357 bp, Homo sapiens
agaagctcctcaatggccagcgccagwsaagccccggctgccactcgcctcacctgagcctgggtggaacaatccaaagttttaatcaaagaaggtggtattcagttgctgcttacaatagttgataccccaggatttggagatgcagtggataatagtaattgctggcagcctgttatcaattacattgatagtaratttgaggactactaaatgcagaatcgcaagtgaacagatgtcagatgcctggtaacagggtgcactgttgtttatacttcattgctccttcaggacatggaccgttacataactgaagactcccaccttcaggcaggattgggtagtacatgtttgtaa

SEQ ID NO: 9270 - DNA, 424 bp, Homo sapiens
gattttgcagatgtcattaagaatactttatttggccggatgcagtggctcacacctgtaatgccagcactttgggaggctgaggtgggcggatggcctgaggcaaggagttcaagaccagcctgggcaacatggcgaaaccccatctctacaaaaaatacaaaaaattagcggggtgtggtggcacgtgcctgtagttccagctactcgggaggctgaggccagagggtcactcaagcctgggaggtggaggaggttgcagtgagctgagatcacgccactgcactccacctagggaacagagcaagactccatctcaaaaataaataaataaaaagtgaaaacactctaagtatctatcaactgatgaatggataaacattgtatattattacacagaatattgtcaaaaaaaaaaaaaaaa

SEQ ID NO: 9271 - DNA, 578 bp, Homo sapiens
aacttcgctttctgcgtccaatcagatgttttcatagggcataactttgtaacttcacttcagcctcccattgatcgctttctgcaaccattcagactgatctcgggctcctatttcatttacattgtgtgcacaccaagtaaccagtgggaaaactttagagggtacttaaaccccagaaaattctgaaaccgggctcttgagcgctatcctcgggcctgctcccaccctgtgagtgcactttcgttttcaataaatctctgcttttgttgcttcattctttccttgctttgtttgtgtgtttgtccagttctttgttcaacacgccaagaacctggacactcttcactggtaacatattttggcaagccaaccaggagaaaagaatttctgcttggacactgcatagctgctgggaaaatgaacatcagtgttgatttggaaacgaattatgccgagttggttctagatgtgggaagagtcactcttggagagaacagtaggaaaaaaatgaaggattgtaaaactgagaaaaaagcagaatgaaagtgtctcacgagctatgtgtgctctgctca

SEQ ID NO: 9272 - DNA, 471 bp, Homo sapiens
ttgtttattcttaatttagaccgttctctttaatgtcagtaggctgccaaggattaggtttttctctctttttcagagggttccagatttttttttttctctctaagtgttcctagtgaatttcaaggtcagattagtttttgtgaatttataagttagtctaaagagtttttaaaaatttatccataaaaatgtttttttatattacaagttaatgttaaattgtaatcaggataaatttgctaggaatataactaattgttgcaacttcatatgcaaatgttgggaaagatctgttaaaactcttgcattaaacttatttgtctctaaccatgcatttaggttggataagaaaaatacttaagttagtgggtgcagcgcsagscakggcacatgtatacatatgtaactaacctgcacaatgtgcacatgtaccctaaaacttaaagtataataaaaaaaaaaaaaaaa

SEQ ID NO: 9273 - DNA, 449 bp, Homo sapiens
tattcaaaagactaatgaatgacagtctgctttgttaaatagttgtgccataagtatctcatttttatcagttaactatttagtatttacctatgcattcttctagcagtttttgggaagatgggaaatggagaaggtcattgctcagaaaaactggagacatttcgttggcgtggtggctcacgcctgttatcacagcgttttgggaggctgaggcaggcagatcacttgaggccaggagttggagaccagcctggccatcgtagcaaaaccctgtctctgccgaaaatacacagaattagccaggtgttgtggctcatgcctgtagtcccagctactggggaggctgaggcaggagaattgcttgaacccgggaggcggaggttgcagtgagccgagattgtgccacggsactccagcctgggtgacagagggagactctgtctcaa

SEQ ID NO: 9274 - DNA, 305 bp, Homo sapiens
  misc_feature 126: n=a, g, c or t
caaagagagacaggcttaaatgttctcttttaacttgagcgtgaggtgggggtcacactttgcagcaacttcaagaggattttaaagtttccattactactactattaggttatagttgattcctnhctcactcaatgttctgtgaaggtgctctgtagataggattaacatttgtggccaggcgcagtggctcatgtctttaatcacagcactttgggaggccaaggcaggtggattacttgaggttaggagtttgagacaagcctggccaacatgatgaaaccccgttcttttttttttttty

SEQ ID NO: 9275 - DNA, 450 bp, Homo sapiens
ttgacctcccaggaccagcaggagcacctcagagactggttcaggggtgggaaccagtgaagcgtagaatatttcctgccagtccaaggaacagctgctatcagagttcccacgtttgcagaaaatgctttgccctaagcagtgaggtgagagctggacacctgcatggtgagcaccgtggaagaagagacccctggttggccacgtgctgtgtccacatcagggtttttcatgttttattcttctcacccaggagaaaaaaagtaagttgcctgtagccaaccaattatttatttctcctttcaaatctagtatcttaaccagtgagttaattctgtagkdctagattttactgcagtttttgatcagtaattcataatctggaatccataacctacttgtgctacacccaacagtaataaaattggaaggttgggaaaaaaaaaaaam

SEQ ID NO: 9276 - DNA, 419 bp, Homo sapiens
cataaataaccctcatcacatggcattttttcttcttcaaaaaccttgatttgtagccgggaaaaagtgattttgtgaagatatggagctctccatctaagcagcacctgtatgaaaacttacgaaaaagaactatgcttccaaacacgatttaattaaaaccatgtaaggccataaatctagtaatatgatacctgctcagagccttccttagcttgcacggaaaatgcatagacgttgccaacatctcctacgtgcatttctaaaataatacagttggccattgaacaacacaggtttgaacttctcaagtccaatgttatgcagagttttaaaaataaatatattggaaaattttttggaggtatgtgacaatttgaaaaaaacagatgaacctcatagccaaaaaaaaaaaaaaa

SEQ ID NO: 9277 - DNA, 398 bp, Homo sapiens
aggcaagggaattgcttgaaccagggaggtagaggttgcagtgaactgagatcacacactgtacaccagcctgggcgacagagtgagactctgcctctaaataaataaatactggttccaagattaaaagcacttaactaatgtgtttattattatgttgtagctttttttaatgtaggagtaaatgttcaaaggaaatatctattttaaacttaaaagctgatatttgtgggttaacctttctgtggtactacagataactgtgttccctcattgaggaatggagtcacaacaggttggtgtgtgcagtatgtgtagcagacaaggaaggcacatggggaggagttgaatcagttgtgtaagtttcaaaattgaaccacactgaatttcccttgtag

SEQ ID NO: 9278 - DNA, 447 bp, Homo sapiens
  misc_feature 200: n=a, g, c or t
aggccagttctgcagcaccctctgtggcagctgagagcaggccctctgcagaagagagccaggggcatggagagttcaggcctccagcagagggagtgcagatatggggaaagctgacccctggagtcagcaggcccagccctaggagggggcagtcccacagcaggctcacaccctgcccttcagagttgcagcagctnatgctgatgccaggaccthgtcctgccaggaagcctctgattagggctgtgaaccaacttccttttcacatctgcaaggacacttggaggcaactgcccaaggccactctgaggagggttgaatgttctttattaaaaggactgaggatcatgtgtgttggtgggccttggactctgctctaagctcaaattttgcagtttctgctgtcatcacagctgggaatgagaaagggaaggggctccagtt

SEQ ID NO: 9279 - DNA, 512 bp, Homo sapiens
aacaaaacggttccatctttggctaggcctttggtatttcaaggcgctgccggtggggagagatgccgcgtgcctgagaggctctgggagagagctaatgctggcagctgttgggatgtcctcttccaggaatggtgatgagtttccctggatccagccctggcttggctgaggtttttctcactgtaagaagaggacaatagcctatgatctacagtgcccattccaactcagagaatctttacatctggagatctatagcagggctatccctagtgacatgcgtgaagaagcttggaaatggtgctgggtaggagctgagtgcagaatgtggaaaggcattctaaaccaaaggaagaacacgagtaaagatgatgaagcagggataaggctaaaatgaaatttgtgatctgatccacatacaagcacagtgtagtacagctggaatatagagaagagcttgaagacttatgagcactatcccggtactcttggaggctctgcamcacagt

SEQ ID NO: 9280 - DNA, 409 bp, Homo sapiens
attcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaaaaaaaaaaaaaa

SEQ ID NO: 9281 - DNA, 368 bp, Homo sapiens
ctttcatatcgttattgtacaaaaagtaaagagtatcctaaagattgtattcattgtaatcaagtaatgcaatcatctctcctctcttgaaatcttgctggacctcttaggctasaataaactgtacsagactaaactgacagtccttcgataatatgaaacattaatttacaaggacccgttaggcsktcaatgatgctgagtctggaaaaggaggagacccttgggaggactccaggcagctgtgctcccagggctcatgttctctactggattagggataggcacctctgaaatckccaccctgatgattggaatgaaacggagtrracatgagcccagctgagagaggagcaggaatgtgtgaa

SEQ ID NO: 9282 - DNA, 457 bp, Homo sapiens
tttatgggctcagaataggggaggggcaggctgcaggtagtattggaaaaggcaacatttgattcattaaaaggcattgttcagaaagaatcaatcaggaaagggtgggcagacaggaacagaagttctcgctctggttcgtgggtttcatccgggaccagcagtccagtctttcagccttcaggctgtttttggctcgaaggtggggtttcaccggggacccgcccctatctgcccaggcgtttggctgcttcctatcactatcaatagtccctccccttcaatgacttgtaggaaggttgtttcgcttaccacattccatcgtgtcctggtggcatcatcaatgaatgaacatgttcttttccccatgtttcttgtacgtactgtgtattagaagttggactaaaggcttgatcaaatttgaggcaggaatgggtgargctacgtgcgactggag

SEQ ID NO: 9283 - DNA, 208 bp, Homo sapiens
gactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaraaaaaaaaaaaaaaaaaaaaaaaaaaaaaaaaaaaaaaaaaa

SEQ ID NO: 9284 - DNA, 417 bp, Homo sapiens
gtacactcaagatttaaaaagaactacaattccataagaaaaaggcaggccacagaataggaaaaagaataaaagacttgtttaggcatttcacaaaagaaagtatacaaatttaagtagttatttaaaccacaatgccattctactatatgggcaaccagaagggccaaaacaaaacgaacaaaagactaccaagtgttaacaaggatttaaggcaactgaaacttccagtcattgctggtgggggtatgaattggtacagtcgctttggaaagctactgagcagtatgtactaaagccagacatatgcgtatttctgaaccaggagtttcactcctaggtatgtactcaaaagaactgtgtacactatgttcaccaaaaaacaagaatgtttatagcaascctctttgcattagk

SEQ ID NO: 9285 - DNA, 347 bp, Homo sapiens
agtttcgctcttgttgcccaggctggagtgcaatggcgcgatctcggctcaccgcagcctccgcctcccaggttcaagcggttctcctgccgcagcctcccgagtagctgggrttacaggcatacaccaccacgcccggctaattttgtatttttagtagagacgggggtttctccatgttgaggctggtctcgaactccggacctcaggtgatccgcccacctcgaccttccaaaatgctgggrttacaggcgtgacaccgctcccggccaatcccaccattttcttccgcagcttctgcttacaggaaaatagcagctaccttgtcaccaaaaaaaaaaaaaaaa

SEQ ID NO: 9286 - DNA, 438 bp, Homo sapiens
ttatatgaaataaagacattccaggaaagacacaaactactagaacttactcaagaaatacaacttctgaatagacaagtaaagaaattgaactattgctactgttaccaccaccaccaccactacccacaggcctggtacggtggctcatgcctgcaatcccagcacttgggggggctgaggcagctggatcacttgaggtcaggagttcaggaacagcctggctaacatggtgaaacctcctgtctactaaagatacaaaaattagctgggcctggtgatgggcgcctgtaagcccagctacttgggatgctgaggcgggagaatcacttgaacccgggaggcggaggtttcagggagctgagatcatgccactgcactccagtctgggtgacagagggagactttctctcaaacaaaacaaaaaaaaaaaaaaaa

SEQ ID NO: 9287 - DNA, 126 bp, Homo sapiens
tttactaaakwaagattacttagaggaaataagamaaatcatgtttsctctcccggttcttccagtggtttsasacactggtttacactttatgccgsatgtgcttttctccaatatcagtgctcg

SEQ ID NO: 9288 - DNA, 495 bp, Homo sapiens
cattaaagggaataagtacgctgtgtgtaacaacagtgggatctcaaaattatgcttctgagagtgatggaagccagacacacaagaccatgaaccgcggttccctttctagaaagttctggaaaatgcacactaacctactaatgtgaagccaaccagtggtagcctggaagctgggatggcaagaagaatcgattgcaaagagacaatagaaaacttttgtgggtggtggaagtattccatattttaattgtgatcatttcactcatgtattacatatttcaaaattatcgggccaggcgcggtggctcacgcctgtaatcccaaaactttgggaggccgaggcaggtggatcacaaggtcaggagatcaagaccatcctggctaacacagtgaaaccccgtccttactaaaaatacaaaaaattagccaggagtggtggcgggcgcttgtagtcccagctactcgggaggctgaggtagaagaatggcgtga

SEQ ID NO: 9289 - DNA, 485 bp, Homo sapiens
gacttaggatttgagcatctttctgttatgctgttgccccactcctattgcaatactccccttcttaagaaagtttttctagactaatgtctagattaaacttcttttctttgacaataatgatgccatgacttggacaaaatgcccattgcctctgggtcctgctttcttcacccagtgctgccttattggactccttgtgcctctccttggctggggaaatcagaatacacagtggtaagtcatgatttctaatccagtgctccagacgtctgtctgttgtagcacagtgagaagttgacttatatttctctcatttttgtcattttcttctgtttttccatctttcccttctgccttttttgagtgtggtgaaagcccctcattctctcctgagaatcatacctgagttgaaatcccaaagcctctagcaccagcaggtgtcccttccattatcatgagaaaccgtcaatttggctgttgtt

SEQ ID NO: 9290 - DNA, 239 bp, Homo sapiens
tgaacttgagakakaggatttagggtatctggtggaggaaatttctaagtagcawaccattcaaaaggtgacagggccatgcgcagtggctcaygcctataatcctagcactttgggaggccgakgcaggtgaaccacttgaggtcaggagtttgagaccagcctggccaacatggcaaaaccctatctctactaaaaatacaataaaaattagccagacatggtggtgggcccctgta

SEQ ID NO: 9291 - DNA, 431 bp, Homo sapiens
cagatgtcttttatctttatgatggggccatcttgtcatatgcttasctgacttccaatttgcggaatattggcatgtwtcatagctctaaagatarrassaaatattctagaaaattcacatgaaatgaattatactgtgactttktcaaaatagcttsrttattgtkykrtaaaagggatgtatgctcaatgaatgaaaagaaagtcagttaataaaagtataaacaagctgggcatagtggctcacacctctaatcccagcactttgggaagccaaggcaggcagatcacctgaggtcacgagttcgagagcagcctggccaacatgacaaaactccgwttctacaamratacaaaaattagccaggcatgatggcacatgcctgtagtcctacctactctggaggctgaggcaagagaatcgcctga

SEQ ID NO: 9292 - DNA, 463 bp, Homo sapiens
tagcatatacataaaccagtaacacagtcgtttgttatcagtattatgtattgtacataatgagtatatgtgcaagactttatgctactggcagtgcagtaggtttgttttataccaacatcactgcaaacacatttgtaaagcattgcattacagtggttacaaagtcactgggtaatatgaatttttcagctccattataatcttatgggaccactgttgtatatgtaatctgtcgttgaccaaagttttactgtgtagcacatgactatgcttagaaggaaggatcaactatgtaaataatgaaggaggaggccgggtgcattggctcgcgcctgtaatcctagcactttggggggctgaggcgggcggatcgcttgaggccaggagtttgagaccggctgggccaacatggtgaaacctgtctctactggaaatgcaaaaaaaaaaaaaaaaaagytta

SEQ ID NO: 9293 - DNA, 426 bp, Homo sapiens
caaatatgctttaccttccatttaaggaggaccagggagttaggaacttcttgaggaaagtaaggcaccactactccacaggatttagctacaagtagtgtcctttttgggtctttgtgactcacctcttsccakcactgtggtaaatgttcggctkctgcatgtgttggtccgacatgatgtgtgaatgccgtarcaccagttagtatcacttgccttggctctttatctggcctcttgatcatactagaaagaatgtggagaagctgatttttcttkttagattcaagatgtaggcacgttgtatacaatctgagggcatcagtgtctctgtctttgccagcagcacgtcaagtsaatgtatagcaagcaatatccaagcatcagcagaaggtgtttttcactgcagtcagagacacttctgat

SEQ ID NO: 9294 - DNA, 444 bp, Homo sapiens
tactctgattcacagaaaagcagtgtaagtagtaaaacaaaaatattgctttcacttagtgcgtaggttttaccggggatttaatcctcgtgtgaagatttaatttgtcatgtgacccattaacatatatgtatgtaagcgctgaactgtgtatttagaaagcaattttagtaaattgaactattttttagacctggaaacttggcaaaattgagacttctagttcagcatgaaataaacactctaagagcccaggaaaaacatggccttcaacctgctctgcttgtacattgggcaaaataccttcagaaaacggtgagttttaaagtataagcatttttaatgaacattaccttaattttttaaaatcatgaactttttattgaaagtttttttgttctgaaaacagcagtttggtcatattatgacagatgtgttttttaw

SEQ ID NO: 9295 - DNA, 463 bp, Homo sapiens
  misc_feature 127,267..268: n=a, g, c or t
atgggtatatacccagcaatgggatggctgggtcaaatggtatttctagttctagatccctgaggaatcaccabwctgacttccacagtggttgaattagttttcagtcccaccaacactgtaaarnkgttcctatttctccacatcctctctagcacctgttgtttcctgactttttaatgattgccattctaactggtgtgagatggtatctcattgtggttttgatttgcatttctctgatggccagtgatgatgagcattttnncatgtgtcttttggctgcatagatgtcttcttttgagaagtgtctgttcatatccttcacccactttttgttggggttgtttttttcttgtgaatttgagttcattgtagattctggatattagccctttgtcagatgagtagattgcaaaaatttttcccgttctgtaggttgcctcttcactctggtggtagt

SEQ ID NO: 9296 - DNA, 342 bp, Homo sapiens
atgccaactgtatgcctttgagagtgaaatcagaataatgtctctccactaaagcaggacttagagcactagttttccaaatgttgtctacagatggaaacactagcatcacctgggtactcgttagaaagtgcagattctctggcggtaccttagacctcctgaattagaaactctgggggtagggttagacatttgtgttttaaacaagccctccaagtggtttcaatgcacattcaaagttgagramcavtcactgatagagaaaaagcagcttgggtagaaacagttgattatttgcaaatttatattttaaaaagataggattcttaacagtaagct

SEQ ID NO: 9297 - DNA, 448 bp, Homo sapiens
ctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcacgagacggggtgtcccctgcagggggctaaactgcaggggccygagattagctgtgaacatgtgggagcccgatgcatgtgggtcagggatctgggggcccccccagctkgcgggaaccccaaatggacacaaactgtacatttgccaatgggtttttttcagaccatggtttttacttgcaaataaacctgagttcttttctgca

SEQ ID NO: 9298 - DNA, 271 bp, Homo sapiens
ttgcscgggcgctgggttcaggggctttccgccccwctggywtcacagctggacgtcgggagtgctagtttggagtacgccatttgagagtaggcgtgagaagttgctctgtgtgctgagcgttctaaaggaagccgtccgttggccttcgtacccgtcttgattgagctctcacacttkggatacgctcctctaatcctgtctgaaagagctaagctgacccccaccaccgttggaggaaactcctggagcastgctggggttttcactg

SEQ ID NO: 9299 - DNA, 299 bp, Homo sapiens
agcatttccctgatgatgttcagcatctattcataaaccgattggccaatgtcaagaagaatttcccttgcagtcatcaagactccttgtccccaaatacttcagcaggcatctcctaagaacagtggtaatataccattactatatcccaaatatttattactgatatggtattataatattacctaatgtataagtacataatcaagttttcctaattgtacccaagatgtccttcatagctttttttcaaatctagagaccaattaaaaatcatatatggtaaaaaaaaaaaaaaa

SEQ ID NO: 9300 - DNA, 85 bp, Homo sapiens
caatactctccagctccaccgttaccgcwaatataagtvaagtttgtamaattcayacttaataaacaatttaggacagtcaaar

SEQ ID NO: 9301 - DNA, 433 bp, Homo sapiens
tcactcctggaatgcaccatctattagtagcaaaagacttctcatatattctaattgtatgagggtggagttagcattctccaccagctgcagctttctttctgttttgctttcgaggtagggtcttactctgtcccccaggctggagtgcagtggtgtgatcatagctcaatacagtctcgaagtcccaggctcaagcaattctcctgcatcagtctcccgagtagcatagtgtgccactatacccagctaattttttgtagagatggggtctctctatgctgcccaggctggcactggcaactttcttctttttagaataattaccgtacttaggatccaatattcttcccatctcacttgttttagaatgtgtgtcctcaggtttggattttaatcatgtcccaagggatcttgccttctaaataaagga

SEQ ID NO: 9302 - DNA, 293 bp, Homo sapiens
ctggctcgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccac

SEQ ID NO: 9303 - DNA, 385 bp, Homo sapiens
  misc_feature 229: n=a, g, c or t
agttctcaggtcggcgggctgtggaggtgatcagagtgggagtcaggcgggctaggccggacccggaggaggggctcgggctccgggaggcagctgcggctccgactgctcaggaacctcctcctgggcccggcagagagagaccccgagtcccccggagtccgactcgctacgcgggtcttgcgagatatctggccgcctctgccgcagctggaggtaggggaccagntcctggacgcctttcggggatggggtgaagtgtgacctccvtcttcgctgagactttgttttctaatctgtaaaatgggaatagtagtatccacttcatagggagagcctgacatctagccctgagaggagatgaactgggtaggagtcagtgttg

SEQ ID NO: 9304 - DNA, 451 bp, Homo sapiens
tcaagacttacactagaactgtgagaacagggtaataaataagcatatgtattaatatcacctttggtcaactcttgggtagccccaacggtagtgtaggaattaacgtaatttttcctactaaaagtattggatttgttttgagagaccacagttgaaaatcattgacatacaaagtttaaaaattgttaggttaaaaaattttaaatgcatttgaagtggttttatagaaaaataattatctaacttggtttatattgacaggttgttttcttggataagaactagacgaagagaaagggagattagtgataaatgtccaggttttcaagttgaaaagtaacaatcagtgtattacaacagatggatgtgatgtcaaattacaaatgctgaaaacgttatatgtaatcatgtagccagagtaatcatacaaggcaaagaacggaaaggc

SEQ ID NO: 9305 - DNA, 444 bp, Homo sapiens
atgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaattttgtattagatgaacagactcagcaagcacctcatcttatgcctcccccttttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagac

SEQ ID NO: 9306 - DNA, 510 bp, Homo sapiens
tattgtcattatgaatgttactccccatttagtccaaaatagtgagcttttaagttgtgccaggtacttaacaatagtaaaagctattgtatagattttwattcamygtgacctataatacatttctgattccttctgtatwgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgakatcagcctggccaacatggcrraatcacatskctactraaaatacaaaaattagccaggcgtggtggtgcatgcctgtagtcccagctamtcaggaggctgaggcaggagaatcgcttgaacccaggaggcggasgttgcagtgagccgagatcatgccattgcactccagcctgggagwcagagcaagactctatcgcaaaaaaaaaaaaaaa

SEQ ID NO: 9307 - DNA, 420 bp, Homo sapiens
aacaattaaatagaacaaccaagggctctgcattatagagtcatcctagaacccaaggctcattctgtcttcaacctgtggccttgggtcatcccagcatcatccagccagcaaatgaaaaaaagctggaatgcgggctgggtgcggtggctcacgcctgtaatcccagcactttgggaggctgaagcgggcggatcacagggtcagtagatcgagaccatcctggctgaaataatagaaacccggtctctactaaaaaatacaaaggattggctgggtgtggtggcgggtgcctgtagtcccagctactcgggaggctgaggcgggagaatggcgtgaacctgggaggcggaggagaccgcgccactgtactccagcctgggtgacagagagaccctgtctccaaaaaaaaaaaaaaaa

SEQ ID NO: 9308 - DNA, 414 bp, Homo sapiens
awaaaaawtcataactgggattagascttgagattccctattttcttacagtgaactgtcttgagctgtcacttaatgcattgaaaacataatagagcacaggccataggcattttcagaacatgaaacttgactgaaacaaaaactgactgtttgattgctttggtgttttaaatgtatccccaaatctcctttgctattgatagtcatttggtgccagtgacagggaagagcaraggggcttaggaggtttttgtagatcycagtatcactgkgtcttataacaccgacaagctcatctttgggactgggaccagattacaagtctttccaagtaagtactagaaaccaaggagccattttgaaaaggkgttttcttttkcttttycttttttttttaaatgaagttttgca

SEQ ID NO: 9309 - DNA, 535 bp, Homo sapiens
  misc_feature 128: n=a, g, c or t
cttggtgtccaggtggcaggttcataagacacctgtgatttgatgtgagccagtcacagaggaagccatttccagagaggaacaaccgtttagactgctttcctgggagtcaagttaaaacttctctnctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaagtaacactcgggagagtcccgtattctcagagtaaaagttgtttctggaattgatctcgccaaaaaggacatctttggagccagattggataaccgagccgtgactccacttgaacatctgagcagttggcccgcgtgggaaacagcaatggcagagaaagatgcttccctttggatcataccttgaggacaaaaaagggcagtcatataatctgtcatctaaactgggacgcttttgtctggr

SEQ ID NO: 9310 - DNA, 534 bp, Homo sapiens
tcaacatatttttattttgaaataattttgtatttttccctatatcctacattggatcagaatattactgttatgtatagccatgaggacatggtctcaaaagaatgagaaactttcttagacagtaaaattgttaacttgagatgtttgcttccatcttctagagccaagtaggatctaactttaatttgacttagccaataatctgaaactattatagtatctgtctttcacagatacatgcaatattcacttctaaatatttaatgataaatttgtaatcatacatgatagtcaattttaatgattatgttgtcaaaattcaggcgttttgtgtgaattgaagacttaaagaagaatttgtaaatatgactgtataagaaacaacagaaagatgaagatgaaccgaaatagaaatatcaagaggctacaaagtcttagcaaattataattgctaatggtacattatgtggtgtttagtatcacatttagaatgtagtcawttgttaagtttttcatggggtaaaagaaaga

SEQ ID NO: 9311 - DNA, 370 bp, Homo sapiens
  misc_feature 49..50,54: n=a, g, c or t
aactgcattgggtccatctgtacaactctctccgtttctccgtctctmnncctnsctccctccctccacccccccaatctttttstccccatctctccatctctctcttatctcttcaggaagagcctaraaggcggcrrsaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaasaatgtctgrsagatattkktaccagcgtttacaccacctgcgacatccctgr

SEQ ID NO: 9312 - DNA, 484 bp, Homo sapiens
tgggagttcctggctgcagagagctatgattgtgcctgtgaatagccaatgcactccagcctgagcaagatagggagaccctgtctctaaaaaatacctaaataattttaaaagtcagcctctctgactgcctatagagaatgctaactaactgaatgacagaagacctaatgtaatccaggtgcaaaatcagaactttccggccgggcgtggtggctcacacctgtaatcccaacactttgggaggcccaggcgggtggatcacgaggtcaggagttcaagaccggcctgcccaacatggcaaaaccccgtctctactaaaaatacaaaaaattagctgggcatggtggtggccacctataatctcagctactcaggaggctgaggcaggagaattgcttggacccgggaggcagaggttgcagtgagctgagatcgcgccactgcactccagcgtgggggacaaaagcgaaactctgtctca

SEQ ID NO: 9313 - DNA, 538 bp, Homo sapiens
acaatttggaggcttctggaaacccacactatgcacctctcgctgactgggtagatggggtgagcttactttggggtgagctcagagtcctcacactcctttatttcctgggtcctacaccctcctaagcgcctgcagaactgtgagtccctgtgtcttggtaccacacacagaaagacaggtggtggtgcccttctcccctgaatctatcactccccaagggbaccgcaaacagccatgttaggagaraaatggtgagttgaaaagggggaacttggtgagcaagcccccagcttttatatcttacagcttttataaagacagcatttttttttcctttttagtcacttacaggattatagctgcctggtgggtttgggaaagaggtagggagggaatgagagagattttattcaactaaaaataagcaagcttcctaggttgtatttatccaaagtggactttaattaaattttgtctttgggttttcagatgactaaatagttctacctggggagttcacactgtcttctaatag

SEQ ID NO: 9314 - DNA, 81 bp, Homo sapiens
taaattttgagcccattgttacaattaagtctttctgagagtattttttataccctgtatttttctttctttttttttttt

SEQ ID NO: 9315 - DNA, 443 bp, Homo sapiens
ctaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacaccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcagcttggtttaatgagtgtgttcatgaaataaataatggaggaattt

SEQ ID NO: 9316 - DNA, 440 bp, Homo sapiens
cattactgattagtgcacagttttaacccaccaggtatataaaagtagctcagtcattgttttttctgtgttactcagattaatacacttgacatatataatttattatatactatattctgtaaaatgaatgaagattaattataaggtgtttgttttcagctgtacaagaataagttttatgagagcagcataaaagtaatgaaattaagtaatgaaattgttacatattaagaagtattaagtattaaattattaagtattaagtaatgaaattattacatcgtgacccatatttttgtaaaattttagcgtttatatattataaacaatctgttgtaatttatgataatatgtattagtacttgtcatcctaaaaaggtattttattattatatcatttgtataatatacttaaaatttgggagatcctttgtagt

SEQ ID NO: 9317 - DNA, 441 bp, Homo sapiens
  misc_feature 112,279..280: n=a, g, c or t
atttctccaaagaaccatccagaacctgagcagcctgtcttcagacagagagaggcccacggctgtttcttgaaatctggcgctgggaatggccatgtggaacaggccatgncagaggctgcctcagcagcctctggtdkctgagcccactgcagagggggagccacacctgcccacgggccgggagctgactgaggccaaccgcttcgcctatgctgccctctgtggcatctccctgtcccagttatttcctgaacccgaacacagataaggaaactnnggcccagagaggtgaagtcacttgtccaagatcacacagctcatggtagagctgggatttgaaccagtctgtgctctttgcccctgcactctcgttaagagttgcttctccatatccaaaactttcttcgtggacagcaggaccaggccatgctgtagtcc

SEQ ID NO: 9318 - DNA, 51 bp, Homo sapiens
aattcaattgtgttcgcagccgccgccgcgccgccgtcgctctccaacgcc

SEQ ID NO: 9319 - DNA, 424 bp, Homo sapiens
ccataagaaaaatgcatgcataccaaatatccatcataaaatagggaactaagaattttgtgtgcactggattttctttttttaaaattattgtttgaaatctgttaaacaagggcttgaactcaaatgdaaagaactggcttttactttaagcttaagctcaccaatgcactcttagagttacttttgttcagggctctgtataaccaaatggaattagcctgaggaaggtacggttttttccacagcattttgtttgtgatgaggaggctaagatagtttaaactgtgtgagctggcactgttgtaaccataaagatttgaggtatttgggttttggttgtagccaagcctagcttgggarctgcgtgtgcaggagtacaggtgtctgaacagagtgtggctgctcagtgctggatgargct

SEQ ID NO: 9320 - DNA, 446 bp, Homo sapiens
agttgacttttgtataaggtgagagaagaggatccagtttcgttctcctacatgtggctagccaattagcccagcaccacttgttgaaagggttgtcctttctccactttatgtttttgtttgctttgttgaagatcagttggctgaatggggcttggccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagatcctgtgataaaacagaaaaaaa

SEQ ID NO: 9321 - DNA, 445 bp, Homo sapiens
tacttatttttgtgtggtgtttggtaagagttctggttcagtttttatcccatgtgtttagttccagcaccatttgttgaacagactatcccttccccattaaattaccttgatacttttgttttgtargttctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtga

SEQ ID NO: 9322 - DNA, 390 bp, Homo sapiens
cttcatgatttagtcatcatgtattcatgggttgtaagacttaatattcttaaaatgcccatattacccaaagtgatctatagattcatgcaatccccatcaaaaatcccagtggcatttttatttbcagaaatagaacaattctaaaattcatctgaagccacaaaagacaatgaataaacaaatcaatcttgaaaaagaagaacaaagctggaggcattatacttcctgatttcaaaatatcctgcaaaggtacagtaatcaaaacagtatgttaccagcataaagacaaacacacagaccaaaagaacagaatagagagctcagcaacaaatccgtgaatatacagtcaactgacatttggcaatggtgccaagcatactcagtggg

SEQ ID NO: 9323 - DNA, 217 bp, Homo sapiens
aggaggagctcgctgttacctgaagggatggactggtcggtggaatgtccggtgccgtsvagttacctgctcagccctgcagcaggggwcaaagctgrgcggastkgacagccrgtctcagcccksaggtactccagtgacaagcagcagcaccagtgctgatgagggtagcagggaaaactggtgaaatgtgccgaggtctctccagaggtggtar

SEQ ID NO: 9324 - DNA, 258 bp, Homo sapiens
tggtcttctagacagtaagatggccttcagtcaaaaggaaagtttaagatctcggttaagcatatgaaacaagtcaagatccttacaaaaagttaattaacaggaaaaacagcctttatcctacattttaagggctggcaatgaagaaaaaaaacagtggttggattaatccaaaactaacttctggttgcttttgaagtgttttctgcttttataattgattagagggctccctctatgtcattcacatcatttttt

SEQ ID NO: 9325 - DNA, 464 bp, Homo sapiens
agaaatatattgtatctctatcacgcaaatacaaatataagccactgtcatctcttaacactcttgctccattataatccattctccagactgcaaccagagtacatttttaaaaatgtgaatcagattatatcatgttcattgcacataatagaaaatctggactcctttcaatgttttatatatgtccctaaatgtagcaccctacccacttctctgaagagcctgtatcaggttaccagtgtgtatcatgtaactatttctacaaaaatgtcttgtaacaaactatccccaaatttgctggcttaaaatggagcagcaaactccacctgttttttgtgtgggctgtaatttaataatggcttttacgttttcaagtggtttttaaaaattaatgtttcacaacaacatgaaaattatatgaaattcatactctagtttcccttcggattgcataaatcttt

SEQ ID NO: 9326 - DNA, 369 bp, Homo sapiens
accagatgctttccaactaacagggaccaaatgggaccgttctaagatatcctaaaagatttgggagttagaggaggtaaactaagataattatattacaaagggtacaagaccacaagacaacaaccgactccggaattcttggacctccgccttccgtacaaggcccagccgccccgtccactgccaccaccaacgccgccgccatcttacactggccagcggcgccaccaccaccgcctccgctctctgcgcttgcscctgcgctgccacgctttccggccccgtttgcgacgatgtgctcgagaagactgagggaagagtggtcgcgcgastcacgctcgcaaccctcctcgaatgacgcacaag

SEQ ID NO: 9327 - DNA, 452 bp, Homo sapiens
caaaggaaaaatatatatacaattttgttagatattggcaaattccttcttcataggtatcatgccatttttgttatcccctcagaggtattttgaggactagatgagttcatgtatgtagagtgcctaacaaaatgaccactcaggctgggcgcagtggctcacacctgtaattccagcactttgggaggccaaggtgggcggatcacttgcggtcaggagttggaccagcctggccaatatggtgaagacccgtctctaccaagaatacaaaacttagcccgacttagtggtgcgcacctgtggtcccagctacttgggaggctgaggcaggagaatcgctcaaacccaggaagcaaagcggaggttgcagtgagccgatgtcgcgccattgcactccagcctgggtgtcacaacaagacttcgtcccaaaaaaaaaaaaaaaaagcttt

SEQ ID NO: 9328 - DNA, 336 bp, Homo sapiens
ctaattgggttgtaataaatcatgcattaaatgtagcaattgccacatttaatagcagtctaaaggcctggcgtggtggctcatgcctgtaatcccagcactttgggaggcctaggtgagaagatcacttgaggccaggagttcaagaccagccttggcaacaksgtgagtccccatctctacaaaaaaattttaaaattatgtaattagggcggggcacggtggcttatgcctgtaatcccagcactttgagaggccgaggcaggtggattacctgaggtcaggagtttgagactaacctggscaaatggtgaaacttcatctctactaaaaatw

SEQ ID NO: 9329 - DNA, 428 bp, Homo sapiens
  misc_feature 191..192: n=a, g, c or t
taaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttnnttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattckaattgctaactgtttatacttttctgaataaaatagttgtttctaattaaaaaaaaaaaaaaaa

SEQ ID NO: 9330 - DNA, 90 bp, Homo sapiens
cagatttgatgatttcctagcaggacttacagaaataaagagctatcatgctgtgaaaaaaaaaaaaaaaaaaaaaaaaaaaaaaaammm

SEQ ID NO: 9331 - DNA, 437 bp, Homo sapiens
aaggtaattaaaatacagtattttttaaaaaacttttgaaaaggttcagcttttaaattcttcaatgatatgtaaaagtttctacctatgaatttattttttgttactgataaatttgtattaaataattgatgcctaaaatatatatttagtagaataaagaaattagctataaaacaaaattagaagagccacaaactagacagggcactgtggctcatgtgtgtaattccagcactttgagaagccgaggcaggtggatcacctgaggtcaggagttcgaggccagcctggccaacatggcgaaaccctttctctactgaaaatacaaaaattacccaggcatggtggcaggcatctgtaattccagctacttgggaggctgaggcaggagaatcactagaacccgagargtggaggttgcagtgagctgagat

SEQ ID NO: 9332 - DNA, 425 bp, Homo sapiens
ttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccgtttgtagtaggagctgaaatccatgctgagctgtaccaggaacttgcatatctagagacagagactgagtcactggcccatctctttgctcttgtgccccaggccagaataaagaatagagtgtaaaaaaaaaaar

SEQ ID NO: 9333 - DNA, 234 bp, Homo sapiens
cagttaagaaccttgaaaagatctaagaaactatgcaaccttaaaataaacacctgacaaatttcaggatgtgaaaaagggcagagaacgcttttttttttctaaaggctaaaattttcrggatwawartatcagtaaacttsaggaatattggattggatcgtaagcaaggcttcaaggwmggaagaagctgaaggtattaaggatatgatatagaaggcatatacttcttca

SEQ ID NO: 9334 - DNA, 472 bp, Homo sapiens
  misc_feature 16: n=a, g, c or t
tttccgcggcaacggnstggaccctggcctgcgctggctggggaggaagcggttctaggggagcgtgcgggcgccggaggtccggcggcgaggaggccaccttctggccttgcgatgaatcctcggtttccccttctcagatgggggttttcgtgagggtacaacgtcggcattagacattccaggkgvcgcccgtacgcggtgggcggttcggggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcaactcggcccagacgcaattttcttctctgcaaaatcgtcataagaataatcacttgtcagggtagctgcgggcatcccattcgttcctttcatcagsgccgggcatatggggcgtcag

SEQ ID NO: 9335 - DNA, 166 bp, Homo sapiens
acagttggtggtaagtatttggctttatttctgggttctctattctgttccattctatgtgcctgtttttatgccagtaccatgctgttttggtaattacaggcttgtagtataattagaagtcaggtaatgtgatgcctacagatttggtttttttttttttttk

SEQ ID NO: 9336 - DNA, 381 bp, Homo sapiens
  misc_feature 191: n=a, g, c or t
aagttgtgtaaggaatctacactgtcaggcagaaccaggattcctgggtctccctctggcccaggctggagtgtagtagcacaattgccactcactgcaacctctacctcctggactcaagaggtcctccacctcagcttcccgagtagctgggaccacaggaagtagaactgggctgcttcataagtctnccttcatatgacagctagattcaaaaggatgaaatcagtagaggtgagacctcttgatgccttggcttggaagtcacatattctattgggaggctgaggcgggagaatcccttgagcaacagtgagccatgattactacactccagtctgggtgacatagtgagatcttgtcccaraaaaaaaaaaaaaa

SEQ ID NO: 9337 - DNA, 425 bp, Homo sapiens
cattagaaattcaagtcctctggggccctgttcccttgtgggcttgtgcaactgactttgtttcttgtctgcctttctggaaccaaatccaaggaaattcatgggtttggggagacagcgatgggaaccagcagggcacaggatgctaggataaagctgtggcgccccaaaagtggcctgctctgccaacatacataaatacatacagtctgagcttgacactgtataatttggcccagaacaatatgtattttgagctcatttaggtgaatgactttggcattccatgtacccactaggggaagctttatcaggctgcatttgccttatgcagaagtatgcctttgttctgagaaatggcctcagaacacactgttgagctgtctcctttagtgagtgtcatcctctcatccatttcaaaagat

SEQ ID NO: 9338 - DNA, 447 bp, Homo sapiens
ttcccggctgctttgtttacctaagcaagcctgggcaatggcgggcgcccctcccccagcctcgctgccgccttgcagtttgatctcagactgctgtgctagcaatcagcgagattccgtgggcgtaggasccctccgagccaggtgtgggatatagtcgcgtggtgcgccgttttttaagccggtctgaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcgcatggtgcsscacccactggcctgcgcccactgtctggcactccctagtgagatgaasccggtacctcagatggaaatggagaaatcaccggtcttctgcgtcgctcamtctgggagctgta

SEQ ID NO: 9339 - DNA, 483 bp, Homo sapiens
atcgaaataggcagatgctgcaaatcagggcttcccttgacccagagagccagttgttaaaacatttaccagcacaccactgtctgtattttccttttttcatttacattattattgtttgaatgactgtatatttggtaatttggatgtaccataatttatttaaacaatcccctattgttgacctgttatttctttagaatgttatttctcgaaatagaattgctaggttataccaatttaccaacagtgagggtgtttcccaatgccccacccagcacttatttttatatttagaatcttcatacgtatatttttttaaattctgggattttttattcttagaagtttttaatggttcgaggctgggcgcagtggctcacgcctgtaatcccagcactttgggaggctgaggcaggcggataacaaggtcaggagatcgagaccatcctggctaacacagtgaaaccccgtctctactaa

SEQ ID NO: 9340 - DNA, 446 bp, Homo sapiens
ctggagtttacctttggcatctttgcttgactgtgagctccctaagggtggggatcatgtctcttatttatgactatccttaggaccattatagtgtgcaatatatagtaggtgatatttgttggataaacaaaagaatttaaaacaaccgatcagttacaagtcaatgcactcctacttgtagcattggacacccatttccttaactctggatttctttaggtgaggacagtcagaggtggaggataatccccatgagctacgctatactcatctcccaatttatttctgtagcatcatctgagtcactctggtggggctgcctggaacttagcagcctgttactcagtgttcacattttcagagcatatttattcatttaactcagctaatttggatcattgccactaaatttttctagatggcttaaagaggaacatgctgac

SEQ ID NO: 9341 - DNA, 447 bp, Homo sapiens
  misc_feature 282: n=a, g, c or t
tagactgtaaatgtattctttcttgtgatttcttactttaactaatttttttcacccttcaactgaagcagtactcatagtgtcaaataagagagctctggagctccttatttcaatgatctctaatgggactcagtctaagaaaggaggggcatcagattttctgctgcacgaggctgttctgaagtcattattctagggtttgaagatacttacttttctggcccttacttgactcctccggccatagctccaaactgtctagccagattaccagggttngcttcagatgaacactttagtattttgatgctaaataccagtgataactataaatatttctcaacttatgatgtgtgttttgttttaataaatccactgtaagttggaaatactgtaagttgacaatgcatttaatatgcctaacctactgaacatcagcttggc

SEQ ID NO: 9342 - DNA, 399 bp, Homo sapiens
tctgttttttttctcacaaagtaaatggtgggcatccatgtttacattgcaccttcccgtgctgtaattggcttgacaaagacaagcaggcttctctgttgagacttattgtgtttttagttttcatagacacttatttaatctttttaaattgtacagcaaggkgctctaagtaatattcgataaaatatatttmatagaaatttgcgtttgatattcatgaacatgaatacatgtatttttttaagaaataagtattgtgtaacactatggcattgcttctatagccaaagtataaaaatttctggaatactgacatgtaaagactacagttaattctgacactgtatcttattaaaataggatgatttgcattttgtaaaattatcctgcacatca

SEQ ID NO: 9343 - DNA, 202 bp, Homo sapiens
ttgaagaggagctggctgcccttcagaaggaacgcagcgagagaataaagaacctattggaaaggcaagagcgagagattgaaacttttgacatggagagcctcagaatgggatttgggaatttggttacattagattttcctaaaggaggacctacagatgagattaaattttttgcatttacaaaaaaaaaaaaaaaaar

SEQ ID NO: 9344 - DNA, 432 bp, Homo sapiens
tattttctaagcatttaaagctacacacaagcaaaaggctatgaatttttctctgtgtggctttagccacattatcttttaaatcattcttaattctcattttaacttcatatttaaagcaaggatgatttataaggtttgtagtcagcagtgtgatcagcaaaagagaaggtgctatgaaagcaaatattgggaacatcaatccagatgtatgggatcagaaaactaggtgtggaggaaatgacttctaaactgaaaactagggagagagtatatatattagaaaatgatttcactggttaggctgggggattgaggtagcattccaagctgagaatacagcatgtgcaaagatgtggaggtaggacaaacatggcaagtttggggaactgaaattaggtcagtctgactagataacacagtgtaaggcaa

SEQ ID NO: 9345 - DNA, 138 bp, Homo sapiens
  misc_feature 33,41..42: n=a, g, c or t
acagttggtggtaagtatttggctttatttctnggttctcnnttctgttccattctatgtgcctgtttttatgccagtaccatgctgttttggtaattacaggcttgtagtataattagaagtcaggtaatgtgatgc

SEQ ID NO: 9346 - DNA, 420 bp, Homo sapiens
cttaagatttgtacacacgagtttgttttatctgtgtgactctaattaaagttaatcaaagtcacatggcttagcaaatcactgaagtttctttttggaggtttttattcattttagtaatttgatttgttgatttgctattaatcttttaaaagtaaaacatcaataacctaattttataaagtatcaggtgtcttttttttggcctactttacgttacttactctgtactttcaagcaggcacataaaggctcagtctgtttcagctctgtgcactgctgagcagtgtcttaccatgactgacctcctgattaagaggaagttagcacgtgagagccacattgagtctgctggccttagcttcatgtgctatgtgagagatgtgctcattttgtacacaggatgttataatgggatat

SEQ ID NO: 9347 - DNA, 422 bp, Homo sapiens
tcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaatgatagctatattcaaaatgtctatatgtttatttggacttttgaggttaaagacagtcatataaacgtcctgtttctgttttaattttatcatagaattttttaatgaaactaaattcaattgaaataaatgatagttttcatctccaaaaaaaaaaaaaaaa

SEQ ID NO: 9348 - DNA, 209 bp, Homo sapiens
tactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaaaaaaaaaaaaaa

SEQ ID NO: 9349 - DNA, 430 bp, Homo sapiens
tgwtastttgcttkktgtyktttgtttttttctagagrsagagtctcgttgcccaggctggtctccaattcctgrgtkcaagcaatcctcctgactcagcctcctaaatgctgggattacaggcatgaaccactgtgcccagtctatatakratagattttagaagaaatttctgccactcagtgactgctttaaattctagagacagaggctgagakdracttagtagcctgcctgcgcatactgcaagtacagactatataacaagttgaaagrgaatcaccckggtatataatattttaaaacatgrwaaaggcattactattgttctggtctaagtactctaacaggacgatgatttctaaccctagcatcatgacatgtatatagtgtgttgtaagacatttgscaactaatagttacagtactg

SEQ ID NO: 9350 - DNA, 513 bp, Homo sapiens
aacctgctcgggtcacgttccacacagtggaagctttgttctttcactctttgcaataaatcttgctaccgctcactctttaggtccatactgcttttatgagctgtaacactcacctcgaagatctgcagcttcactcctgagcccagcaagaccacgagcccaccgggaggaacgaacaactccagacgcgctaccttaagagctgtaacactcactgtgaaggtctgcggcttcactcctgagccagcgagaccacgaacccaccagaaggaagaaactccgaacacatctgaacatcagaagggacagactccagacgcgccaccttaagagctgtaacactcaccgcgagggtccgcggcttcattcttgaagtcagtgagaccaagaacccactaattccggacacagtattatacaaattctgtcagatttattcctaggtaccttatatttttgttgttgctattgcaaattataacattttaaaaatcaaaaaaaaaaaaaaaa

SEQ ID NO: 9351 - DNA, 470 bp, Homo sapiens
atttagaaattaaatcgaaataaaaccacaaataaaaagtccaaaccaccaaacttcacataatttaatgaaagaagggctttttctgaaaataaagagctaggtgcaatgcgaccccggagtgcgttgcttctttgtagagtttgggatgcctgttttttgtgtgtcgtgatgtgactcaattctttcactcctgtactcccagcactctgagaggctgaggcagcaggatggcttgagctcaggagtttgagacaggcctggacaacttagcaagaccttgtctttactaaaaataaaaaaattagccaggtgtggtagtgcatgcctgtggctccagtgacttggaagggtgagctgggaggatcatttcagctggagagtttgaggctgcagtgagctgtgatcatgccaccacactctagcctgggtgacagagtgagattctacctcaaaaataaataaacaaa

SEQ ID NO: 9352 - DNA, 477 bp, Homo sapiens
tttaaaggcccaaaatgctgaccactctaccactgatcctcagtagttcacacaagtaaaaaatatggcaagaccttgactcttatttcatataaggagaaagtgcagtatggaaagtgtaaatgacttaagtatgaaatcactgacaggtctgtgaatgtctgttagaacaagattgtgagaatggtgaaagattgaagagtttgattagatctatttaattctgttagtagaccacaatttttgtgaaaattttaagaactattacagagcttccgtgttttatttaaaacgattaataaaaatggaaagtggtacatgagaaaatttaaagccctttgcattttaagaaggttgtgtgcttgtagtaataacttacacttctgttgttgaattgatggcagttaaatgcttatttggatacattaagcagacataaagaaatacagacttttagcctggcatgttggcttgtgc

SEQ ID NO: 9353 - DNA, 490 bp, Homo sapiens
tgtacttcagtgtgttttgtagtggctggcagcggaaaggaaagtttttcctttccatatttagtgcttcttttgggagctctttcaagacaatgatgaataccctcagcatttgcttgtttgaaaagaatcttatttctcctttgcttattaagcttagtttggctggatasgaaattctgggttggaaattctttaagaatgttgaggccaggtgcggtggctcacgtctgtgatcccatcacttttggaggctgaggtgggtagatacctgaagtcaggagttcgagaccagcctagccaacatggcaaaaccccatctctactaaaaatacaaaaatcggctgggtgtggtggcatacacctgtagtcctggctacttgggaggctgaggcaggagaatcacttgaacccgggaggtggaggttgcaatgagctgggatcgcaccattgtactctatcctgggcaggaagagtgaaatgaagctcc

SEQ ID NO: 9354 - DNA, 475 bp, Homo sapiens
tatataacttatacacatatacataacttcaatgtacgagtggtaaaaagtacggcattagtcagtttgagttgctgtacaagatacccattcattaattcattgactcaagatgtatttactgagtgttcactaagcatcataggcattgaggatatcatgattgaggcagactggtttctactatcagagctttggttggtggagacaaaagacaaacaagcactttcaatatggtttgggatgttctaagggaacatgtaggggcaacaggctaagattcagaggcatttctctccgggtgggaggttttctaacacaaacacccaacttaagaacggggaggcaacctctcatccgggaacatctgcccctcacattgctttcaatatgcaataccttaagattccacagtgggtgttttcccaaaacaaagaatagaccctccacaggaaaactcaagtctcttccttag

SEQ ID NO: 9355 - DNA, 415 bp, Homo sapiens
tagaataattaggaatatgttaaattaagaataacaagaaaaaaagcaagccgtaaggaagtaactgattattttttcccttgggtcttcaaatctttgccttctttacaatgtccttaatttgcagaatgatactgtaaaatatattattgaaatagtataatagtgacttaagatcatgtgtgtggtatataacctaggattttgaaccaaaaagttgaatttctgctattctgagacaaagtgtcttcaaaagacttcaatatggcctggcccagtggctcacacctgcaatcccagcagtttgggaggtcaagcatgaggatcccccagcccaggagtttgcggctgcagtgagctatgattgtgcaatggcactccagcctgggtgacagagtgagaccctttctcagad

SEQ ID NO: 9356 - DNA, 443 bp, Homo sapiens
  misc_feature 246: n=a, g, c or t
gaaggcgggggacccgggacttccaagtgtgccccacacattgattttaattttcaacacttagcacctgacttagtgatctaagatcactgactcagaaaacaggaaaggtcagtctgcctaacacctcacccagcgtcctgggattagcatccaaaacaaacagatcagagatgggatgcagactcccaagagatgattcccacatgtgagaaagcccaggagaagcggatggcggatggcgtntctcaagctcgctgacgtcactcaagttcatgatccaaggcttcaccctactggggttggggggttgggttctactggaagagtgaagctggtggattaagaaaagtggtggtagggagagggagggaaaggagttctttctgctagtcaaaggagaaaccaaataaaatgaatgaagtccaaaaaaaaaaaaaaaa

SEQ ID NO: 9357 - DNA, 389 bp, Homo sapiens
gcctagcatcatagggaaaaacagctggagcaattgaagttagggttaaggatctcaagggcttggacttctcagaratgaagatctggatcactccatcaggcaagcaacgaagaccagatgaaatgctgcttgaagggctggcatatctagaattggtggtagaaatagaccatgaagactaagtaactgagaagatttaatgcagggtgcatatggattgarttcagggtgcgcttttmatccttttattactaatatcccagctgtccatcctccatccctcccccatgatttccgccaaggacaaagcaggaagggcccacagaaagtgcaactcaaaaagacaggaataaacactctgaagaagcgaaaaaaaaaaaaaaatg

SEQ ID NO: 9358 - DNA, 475 bp, Homo sapiens
ccacaccaagatgcataattggaaaatttcaaaataacagtaataaatagatgataatagaaagttcccgagagaaatataggcctcatacattggctcaagaaccagaatggtatctgatttcttaatgacaacattcaaagctagaagatgtggctttaaaattcagagagaaggccgggcacggtggctcacgcctgtaagtaatcccaacactttgggaggctgaggcaggtggatcacctgaggtcaggagctcgagaccagcctgaccaacatggtgaaacctcatctctaaaaaatttaaaactagctgggtgtgttggcacatgcctgtaatcctagctacttgggaggctgaggcaggagaatcacttgaacccgggaggcggaggttgcagtgagccaagattttgccattgcactccagcctgggaaacgagagcgaaattccgtctcaaaaaaaaaaaaaaaa

SEQ ID NO: 9359 - DNA, 385 bp, Homo sapiens
tttaagagtggtccaaggctgcacgcggtggctcatgcctgtaatctcagcactttgggaggccaagccgagtggattgcttgagttcaggagttcaagaccagcctggccaacatggtgaaaccccctctctactaaaaatacaaaaattagccaggcgtggtgatacgcacctgtaatcccagctgctcgggaggctgaggcaggagaatcgctcgaacccgggaagcagcggttacagtgagctgagattgtgccactacactccagcctgggcaacagagcaagactccatctcaaaaaaaaagagtggtccaaaagtgggaataaactagcaatggagatggcaacttagaagattaagtgggcgggtaccatggctcam

SEQ ID NO: 9360 - DNA, 538 bp, Homo sapiens
taaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaakctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctga

SEQ ID NO: 9361 - DNA, 447 bp, Homo sapiens
tatatttttagtagagacgggctttcaccatgttggctggggtggtcacaaactcctgacctcaagtgatccgcctgccttagcctcccaaagtgctgggattacaggtgtgagccatcgcacccggcctgtaacaagggacttcttatgagtgtggggatgtgtggctggggtgtttgcaggggtttaggaggaggatctgcttcaggacatgaatgggcttgtccccagcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgccgcgacattgtgcagtttgtac

SEQ ID NO: 9362 - DNA, 64 bp, Homo sapiens
cagacactgtgctaggagaatggaaaacaattttgaacaaaactgtctacctacatgatttttt

SEQ ID NO: 9363 - DNA, 415 bp, Homo sapiens
actttctttgctgcgtctactgcgagaatgaagaccatcctggctaacacggtgaaaccccgtctctactaaaaataaaaaataaaaaaaaaaagtagccgggaktggtggcgggcgcctgtggtcccagctgctcgggaggctgaggcaggaraatggtgtgaacccaggaggcggasttgcagtgasccgagttcgcgccactgcactccagcctggaccacagagcgagactccgtctcaaaaaacaaacaaacaaaaaaaactgtcaaccaagaatcttatatctggcaaattgtccttcaaaagtwtgggaaaggctgggcgggatggctcatgcctgtaatcccagcacttagggaggccgaggtgggtggatcacttgaggtcaggadttggagaccagtctggccgg

SEQ ID NO: 9364 - DNA, 413 bp, Homo sapiens
ctcttaaactaatgaaatgagtggcaggcagcgtgtgcagagcmcagcaaaggctcagagggatgcccacagagttccaccgcaaccgtgcacagaggaggaggagaatgctccctacaggtgaaaactaggctaatacacaatgattgaagactaaaggatgagaagagccaccagtggggcgcattcacagagaaacggtcacatgatgaggcagcaagaaggcaaaaattgcgagccaacaagagaggcctcagaagaatccaaccctggtgccgccttcattttaaacttccaacaaccccagaactgtggaaaaaaattctattttttgtctgtggtattttgttatggcaaccctagcaaactaatacactgagcaaactaatacattaaacagaatattaaaacga

SEQ ID NO: 9365 - DNA, 425 bp, Homo sapiens
tattttatggataaagtgactggggaatttagttaatgaatttgttctcatcaaacctaagaaaacttccctttagagagagtagatggcatctttcagaatataatctttgaagactgacttgaagcagtttgagtgttgtaagacattggttcaacaggtttgctttcagtgaacagaaaatctaatgcatagcctcagcttctcatatcaagcctttccatttttagaactgctttctgttgactgttgtagccagtagagagaaaatgttggtcaggggattacatttcttttaaaattcagtgtacttaatgaggagatagaaactgattaataaatatcaagttgaaaagggtaaatgatgaaaaggtagacaaaatatatagttcatttacatgcggataaaattttctggtatatgt

SEQ ID NO: 9366 - DNA, 456 bp, Homo sapiens
tgcaagatttaatagagtgaaaacagagctcccatacaaagggaggggacccagagagggcagccgttgccaggtttatatccctatcattgtccctcctgctgtgctctgaggagatagatgattggctattgtttacctcctgttttagcctaattagcattttagtgagctcgctttactacctgactggtcgggtgtgagctaagttgcaagccccctgcttaaaggtggatgtggtcaccttcccagctaggcttagggattcttagtcggcctaggaaatccagctagtcctgtctctcagatggacatttggatagtggacgtatgtcatggatatttggatagcagacgtgcgtgggtggacatttggagagtggacacacgtggttgtgtggctgcaggtactcactgtagtgtatttatccggaagatgtgcacgttgctcctgac

SEQ ID NO: 9367 - DNA, 498 bp, Homo sapiens
  misc_feature 264: n=a, g, c or t
tttggattgtttcttgctattaatactatgagcaaccctgcaattaataaactgaaatgtatctcctaggttacacgtgctagarattctctcagatttctagaagtagagctggcttgtaaagtgtacaagattttaagctatagtaagtactgctgaaatagctttcaagcatttatgttctcacaagcaatgggtaaaagtgccgcttggccaggtgcagtggtttcacgcctgtaatcccaacactttgggaggccaagntgggtggatcacgaggtcaggagtttgagaccattctggccaacatagtgaaaccctgtctctactaaaattacaaaaaattagccgggcgtggtgtcaggcacctgtaatcccagctactcgggaggctgaggcaggagaatcacgtgaacttgggaggcggaggttgcagtgagccgagatggcaccattgcactccagcctgggtgacagtgcgagactccatctcaaaaa

SEQ ID NO: 9368 - DNA, 373 bp, Homo sapiens
gtctctgccgcggcttcctcggctgccagctctccggcgagccgagtcctagtgccgtaccgtcagtccccggccgcgcggascggratgcactgttcctgctgtgggtcctcatcatggagaccaaacgggtggagattcccggcagcgtcctggacgatctctgcaggatatgtgaggattacttcatgaaaacaaggaagtgaattaaggaggatgaaaacaaaaagacaagacacatgacctctgtgggataaaggcacagggaactataggatgcttgtgaaagggcagtgtagagttgacagatgtgtaccaggtgtagaggacagctgatccagactagaacagatcagaagactagaagtcttaa

SEQ ID NO: 9369 - DNA, 390 bp, Homo sapiens
ctctcatttcctttataagaaatctttacatatatatatatatatatgactgttttgctttgttttgagtttcataaaaatagtatcatgggggccggtcacgtggctcacgcctgtagttccggcactttgggaggctgagacgggcagatcacamdgtgaggagatcgagaccatcctggctaacacgggggagccctgtctctactaaaaatacaaaaaaattagctgggcatggtggcaggcacctgtggccccggctgctggggaggctgaggcaggagaatgacgtgaacccgggaggcggacttgcagtgagccgagatcgcgccactgcactccagcctgggcgacagagggagactctgtctctcaaaaaaaaaaaaaaaa

SEQ ID NO: 9370 - DNA, 544 bp, Homo sapiens
acttagcatgttaggtgtattamctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatcvttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcag

SEQ ID NO: 9371 - DNA, 451 bp, Homo sapiens
gatattattagaagtgtatgacaaagggtctgtggagaatcattatctaagtgccgttaaagccgagacctgaaggagtggcaaagagtgagggaaagctgaccatagaagcagtagaaatgatgtgtgcagaggtttaagtgggaaggaatgtgacatatttagggtactcaaaaaaaggcaaatgttgctagagcagagggatggaatatgagtggtgaggaataaggcctgagaggtaaagaggaaacaaaatttatgaattaaacaaatatttaatgactctactctgtactaagcactgttctaagttttggggattcagtatgaacaaaccaggcataactttctgttctaatggaatgtacactctattgggaaaaacgtgataaacaaagtaaataaatcatatatgctatgttagtgataagtgccaaaaaaaaaaaaaaaa

SEQ ID NO: 9372 - DNA, 272 bp, Homo sapiens
taatattgttttatgattgatattaataggggaatctgcaggatgtgtaactttctaatcactggagagcacaagaaatagcaaaatgtggaaagtgctcattttttataaagactcatttttttcactaacaaattttagtgatttttttcccacatgtgtaaatattctttctgatgataccacagaacagaacatttatttatataactaccccctagggttttttcttttttctttttttttcttttctttttttttttttttttttt

SEQ ID NO: 9373 - DNA, 420 bp, Homo sapiens
taaaagcaaaaacagtatattttttaaatgacctgttttgtaaaggtatatgaaaaagatgtcggggtcacagtggataaaaagaggatacctctaaagcaaactctgcaggtaagaaaacaagtcagagggcctgaaaactagaaatattcatgatgattttggctttccaaaggagacaagattgttgcaagtagggtaataaagcgaagagctattttctcatttcaaaaaaacactgagggccgggcatgctggctcatgcctgtaatcccagcactttgggaggctgaagtgggcggatcacgaggtcaagagatcgagatcatcctggccaacagggtgaaacccgtctcgctaaaaacacaaaaaattatctgggcatggtggcgtctgcctgtaatcccagctactcgggar

SEQ ID NO: 9374 - DNA, 426 bp, Homo sapiens
tctgttaagatttcatatttattatgtagctaaagggaaaaaagtagttgcaaaacagtatgatctcatttctagactcatcagcatttggcacagttgcgtccttcctgaaactttcttcagttggactckcttggtttttctcccctctcattggactctgctccatctctttacctccttggtccctggttggagggccccagtgatgagcactcagctttgtggatgtcttcttctatagctacactccctaggcctaaatgagcttctgtcagtcttgtagcttgcacagtctacaaccaaagattcctggatttccatctccagcctggacctctttcctaaattctcaatttggttatccagctgtttactcaacaagtccatctacatggctgagtatctcaaaattaacatgtctaa

SEQ ID NO: 9375 - DNA, 237 bp, Homo sapiens
tttatagttgmaattraccttttgaagaaaaggtasattaaacgttcctaggtctaacccctgkttcttaagtttgactttgcaaccaractgaaatagaggaggaattkaksaacatggatgagttggwaagcatactctcaagtcattggatgttttaaaagwwraagatatctgaatttatttaaagggaagatttttctctatagcatgtarctagctagcatgtcttttagt

SEQ ID NO: 9376 - DNA, 438 bp, Homo sapiens
aatgataacaagtgtttgtgagggtgtagarwagagggtgcccttgtacactgttggtaggaatataaattggtatagccattttggaagagtgtggaggtccctcaacaattaaaaatagarstatcatatgatccaggacccctatttccgggtgtatatccaaaggaattgraatcaatacctcaaagaggtagctacacttccatattcattgcagcattatgaaccacctaagtgtctgtgatggataaatggattaaaaacatgtagtatatatatacaagggcatattattcagccataaaaataaggaactaggctgggcacggtggctcatgcctgtaattccagcactttgggaggccgargcgggcggatcacgaggtcaggagatcgagaccatcttggctaacatggtgaaacccgtctctactw

SEQ ID NO: 9377 - DNA, 480 bp, Homo sapiens
ttgagatggagtctcactctgtcgcccaggctggagtgcagtggcgcaatctcggcttactgcaagctcagcctcccgggttcacaccattcttctgcctcagcctccctagtagctgggactacaggcaccccgctaccatgcctggctaattttttgtatttttagtagagacagggtttcaccttgttggccaggatggtctcgatctcttgacctcgtgatccatccgcctcggcctcccaaagtgctgggattacaggtgtgaaccactgtgcccggcctgttggagacatttctaattgtcaataagaaaggcaaaaaaagaagagtgaaaaagtttagagtaagactatcatctatgcatgtgactgttaggagtagagtttaaggccacattccttgccacagagtctaattccagcttgttctttgtctccttttacctgtctttaagctttttttttkcctttggaggga

SEQ ID NO: 9378 - DNA, 444 bp, Homo sapiens
cattaaaatataagaataggtgaatttgtaataggtttatatttttcagcctttcaggtgccctttcaagcttgtgggtttaagtttgattatattgggaaaaccttgctaactagcacatcagggttagggagaggcttgctgaagtaacttcaggcacttgattgaactgagaatttattaagtaataagtctagcataattttatgggagctggagggtagagagttattcaagtgaaacaaatttcatgttaagaaatttggggccaggtatggtggctcacgcctgtaatttcagcacttcgggaggttgaggtggatggatcacttgagccaaggagttccagaccaacctgcgtaacacagtgagaatctgcctctacaaaaaataaaaaacttagccaggcatggtggtacgtgcctatagtccactacttgggar

SEQ ID NO: 9379 - DNA, 482 bp, Homo sapiens
cactttgagttaaccatatcctaaattgcactcacatgtaatttgcaagaggattagttagatttttgtgacatttctggtatgtgaccatctttttagaagtcaaaaacttaagcaagactttttgtcagtgttgcgacttagggacataaattattagtatctgaaaaaatactattcgtgtttgctgataattcataatcatatttttaaacacacacaacttaaaattatttttcataaaagcaactttttgttatttgacattcatcctgaaaattaggcttttataatcagtaccattaatgaaagtggaaaaactgaccattaagctaatttttgacaggagtgaataggagacagatgatctatcagagtgatacaatgctatgcaactgctgaagtagccatgcacatgcaggaaaaaaaatatgcaaaggttatttgcagtttaatattaagtgaaaaaagcagaatacagg

SEQ ID NO: 9380 - DNA, 250 bp, Homo sapiens
taatattgttttatgattgatattaataggggaatctgcaggatgtgtaactttctaatcactggagagcacaagaaatagcaaaatgtggaaagtgctcattttttataaagactcatttttttcactaacaaattttagtgatttttttcccacatgtgtdaatattctttctgatgataccacagaacagaacatttatttatataactaccccctagggttttttcttttttctttttttttcttt

SEQ ID NO: 9381 - DNA, 305 bp, Homo sapiens
  misc_feature 99..100: n=a, g, c or t
taactgtattcaccatgctgtacaatagatctccagaatgtattcattctgtctaactgaaacttaggatcctttgaccactatmhmcccatttatmannccctcccacttccccactaccagcccctcctgggaactgmcctctactctctgcttctgtgagtttgactgctttaaattccacacaaaaagtgagatcatagagtatttgtctttctgcgcctggcttattttacgataaattgattgcwtctcttcccattgtttatagatacccattctcgtaatgatggcactgtgtctgw

SEQ ID NO: 9382 - DNA, 325 bp, Homo sapiens
aacaagagttgcaaagtagaaaactgtcagtgaatgtcagctctctctattatccctcagcctcccgagtagctgggactacaggcgatggggccgatttttaatccactaacaggtaccttgagactagggctcactatactttggtcagagatgctctaggbatgaagattatatttgcatgaagctaacattttttcaagactacgtgattgcactgctcaaacttacattatggtttccagagacagctagagcttccttgttcattaactttgaaaggaagcattttccctgggaagaggtgcccaagcctcttttgtaa

SEQ ID NO: 9383 - DNA, 381 bp, Homo sapiens
cctcaatatccatcctttttcatagtaatagaaatttctataacagaagtaaagactatacatttaagggatagtcatatgactaggttctgtctactgggatgggagcagaactttatgtgatgttttgggccatgactttwaaaaggaaaagagcatgccttccttcttttcttctcttctttcttctggctggaaaataaatacaatggtatgggctggacctgccatttcagatcctgagattaaagctgcatgctgaggatgacagagtagcaagataaaaagcacctaggtcctcagtactgtgatggcaccatgtccgccctggatcctttagactcagattgtttcatgaaaaagaaataaggactgagcatg

SEQ ID NO: 9384 - DNA, 362 bp, Homo sapiens
tgtaccctcagtggagcccttctggtcttttcttccacttctgcagaatttcctctagcaaatacttctttctccttgcttgcctccaccatgatatttgaataagagatggccagaggataacacttgtctcttaaaaactaaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaa

SEQ ID NO: 9385 - DNA, 436 bp, Homo sapiens
tatagtgctatcaagcaatccctggtactttggacttccatggcttgttatataaaattacatttttacatgtaaaaataaactaaacaaatctaatgataaaatataatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgah

SEQ ID NO: 9386 - DNA, 127 bp, Homo sapiens
gccgccgcggtggcrcgtgcctgtaatcccagctactcgggaggctgagacaggagaattgcctgaacccgggargcagasgttgcagtgagctgagatctcaccattgcagtccaacatggacaac

SEQ ID NO: 9387 - DNA, 336 bp, Homo sapiens
catagacttttcaagacttggattatatrarcccattgttcagctagatgtttgttttaaatgttttttagccaccagaaaaaaagtgattatctagtctagacttgttcttctaccattcttcagccaagctgttcagaggcagttttgctgagatagggagtgagataatatgtttcagtgaaaaartaggcagtccactccttgctggcaggctatgaggttgattacttaakgcctgagccagagrgtgastccaaattacagtttcctckggaatgatgcaggcttcaaawttcastgggagtggggagtagagggtggagagaggagaaa

SEQ ID NO: 9388 - DNA, 88 bp, Homo sapiens
agtgtgtggcagcggcggcggcggcgcggcgaggctggggctcttgtttaccagcattaactccgctgagccaaaaaaaaaaaaaaaa

SEQ ID NO: 9389 - DNA, 510 bp, Homo sapiens
  misc_feature 439: n=a, g, c or t
agcaacctgctctggtccctttccacactgtggaagctttgttctttcactctttgcaataaatcttgctgctgctcactctttgggtccacactgcctttatgagctgtaacactcactgcgaaggtctgcagcttcactcctgaagccagcgagaccacaaacccaccgggaggaaggaacaactccagacgaacaactccagacgtgccgccttaagagctgtaacactcaccgcagaggtctgcagcttcgctcctgagccagcgagaccacaaacccaccagaaggaagaaactccaaacacatccgaacatcagagggaacaaactccagacacgctgcatttaagcactgtaacaccgcgarggtccgtcgcttcattcttgaagtcagtgagaccaagaacccaccaattccggacacactaggattgcanhgctacactcagtgtgggcaacagagtgagacctcctctcaaaaaataaataaataggcatggtggctcac

SEQ ID NO: 9390 - DNA, 447 bp, Homo sapiens
ctaattggtttccaagcactcacagctttatttcctaagtacctcaagcttatgtattcatcattcaggcttttaatataaatgcataatgagaatctaccttttgtatcagcaggatccaagacatgattcctgctctgaaggacctatgtcttactcatttttgagtcctttgcctgaaacacagtaggctttccataaatgatgaatgcacttctgtaacctagtactcttttttgattgtcttgattaggattaggtattgttctaggaaacactgtcatcttgtacacatttatttcatactgactttgatttgacagcgaagtatctagtaagtctcttgttcagaagatgtgaccatcatattgtatggtaagtttgtaggatcaagcacatataagaatagcatcccaaatataacagtgctgattctatgcagtatct

SEQ ID NO: 9391 - DNA, 433 bp, Homo sapiens
tgtgagacaaaaacttattaaggttaaatagaattgtttcttctgaataatctaacaaaggaaaatataagtsattgamtcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattat

SEQ ID NO: 9392 - DNA, 104 bp, Homo sapiens
attcgcctccaagtcgccgaagagcgaacaccccaaacaatcccgaagcgccaccaaaaaaaaaaaaaaaaaaaaaaaaaaaaaaaaaaaaaaaaaaaaaaaam

SEQ ID NO: 9393 - DNA, 435 bp, Homo sapiens
cccatatagtgtgcctggcacatagtaagaattattgaataaatacgaagcccttctagttagaaaattttgtctccgacattgaggatagtaatttagagctgcaaaagtttcactctgttgttagtcctacttctcctctacagataaggtatgactgactctttttgttccatattaatgcctattcccttttggcccaaagtctgtacctgtacatacaggtagatacaggtacctgtctgtacctatacagatttacataatttatcagatgttcccttctattcctatcctggttcatagaatgattatctttaggtttttgggtacaaatgtagaaatcaaaacattagttgtatctcctacctttggcagtagactaaaacccatactccaaaggactgtttactgctttcccagacttttctcttg

SEQ ID NO: 9394 - DNA, 414 bp, Homo sapiens
catccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatatdcatgtttatttaagaaatggaaaaaaaaatcaaaaatcttaaaaaaacaagcaaacagtccagcttcctgtcctcctaaagtggcccctgttcccatctcccgggccagamagctgtccccccgtcctcctccccagcccagcctgctcagagaagctggcaggactgggaggcgacar

SEQ ID NO: 9395 - DNA, 423 bp, Homo sapiens
  misc_feature 412: n=a, g, c or t
gcaccaaacttttctaaagagctttttactttcattctaaaatatctctgtacatataagcacattcctagcttttaaaaaatattttacttggccgggaatggtgactcacgcctgtggtcccagtactttgggaggcccaggcgggcagatcacttgaggtcgggagttcgagaccagcctggccagcatggtgaagccctgtctctactaaaaatacaaaaaattggctgggcgtggtggcgggcacctttaatcccagctactcgggaggctgagacaggagaattgcttgaatccgggaggctgagacaggagaattgcttgaatccgggaggcagaggttgcagcgagccgagatcgcgccactgcactccagcctgagcgacagagcaagactctgtctcaaaanaaaaaaaaaaa

SEQ ID NO: 9396 - DNA, 485 bp, Homo sapiens
agagctgaaagggatcatctagtccaacccattcatttcatgggtagagaactgaaacccagaakaaaatagaaatgccaccacctcggtgccagatctcctagatgcccacctacagawwccyttkakaawtgaaatgtgtcaacctttctggcaatacgaccagcccacaataagttactgtgggggtgcatcatgaacttctctcccataaagtcctttgaaacgaaatgcacaggaagatacgatggaaacacaccttagaagacttgagcttggacctgagcacaatcacaacagctgggccgaatcasgtgaccataaacaggcagctagcttaactgagatcattggtagccagggggttgctaccaaactttggtaacctcaaggacaaaatgaggaagatgtgttcattgtggactctaaaaacaaaaacaaaacacaaaatcccctgttcaaataaacaaaaaatccaagattga

SEQ ID NO: 9397 - DNA, 471 bp, Homo sapiens
ttccggcgccgtaactgctgccatcttctccgcgctatggctgcgttcggccgtcagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggaagtaccaccaaga

SEQ ID NO: 9398 - DNA, 445 bp, Homo sapiens
actctccaaaagtgaaatgttgtcactgtccattcaactgatgaaaatcttccttttcaacagaaaaactatcatgatgttgtctgttgggcttcagtttcttacagcagtcatcttaagaattaaactggtatggataatctgactatgaactccttgagggcagggaccatattatataatacttctgtgtcctctgctatttcttagcagaattttgaaaatgtgccaagtgttgacttggttcgatcacttgtgagaatggagggacccataatgttaataatcaatgaaggttgttggagttacttacccaaaaccttatgaacttagccttccctagcagattgattttcctaatttgtccggtataagcaaacactaaagagggattggggaaagttgtgagttgagtagttgggaaaaaggtagtttgcagttttaw

SEQ ID NO: 9399 - DNA, 420 bp, Homo sapiens
  misc_feature 420: n=a, g, c or t
ttccattgtgtgtgttttcatgccagtattataaccgtaataggtccgttgccccatgagcacagcatgtcaatacagcaggttgcagcaaagaaagacggtttactgtaaggctgcagaacaaggaggtaggatgaaaatgaaaatccgtcctcccagggagtttggagctagggtttttaagggttttaaagtgtggaaatcactgcttaaagagtgcagtgtggagtcatgagacaggaagatgaagaaactattctcatgctgattctgttcctctgtggttgtcttcagactgcttggcatcagctatttcactggaatttgggacctgagaaacatcttgtgcaattcttaaaagcctcatgattctaacattagaaatcctatgtatgggaacagtggggactctgtccaaan

SEQ ID NO: 9400 - DNA, 411 bp, Homo sapiens
gattattaaggacaatttttttttttaactaaaaaagttggtggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgtkgttttttttctcaactagttaagtcaactgcttctgaaa

SEQ ID NO: 9401 - DNA, 407 bp, Homo sapiens
atttctgtagtgtctagcacagtacctggtgtaaagtaagtactccgtaaatatttgtccaagcagtgattgaatcacaacagaaattctaacacacagtaaagaaactgaatggaaaaggggaatggaatgatgtcattgtttactaagaagaccaattcaagcaaggactatttatgagagaattagttagcacagccttccaggacaatggcagcttatgtcaagagctttaaaaatattgtttggttcaggagtccgagcttgtagtcatcgtaaggaaatcaacagtcaaagatgtacataataaggacactcatcaaagcatctgttgcagcaaaaaattattgaaacaaactggcaatatgggaatgattaaataatagtacatctatacagtcaaatat

SEQ ID NO: 9402 - DNA, 263 bp, Homo sapiens
ccaagagaataacaacagaaaacccagacaaaaagaattgagtaaaacggcagaataaraaaattagcaacaaaacccaatactttttatatatacaataatttagtttgaaaatatagtggaagagggctgggcgtggtggctcatgcctgtatcccagcactttgggaggctgaggtgggcggatcacgaggtcaggagatcaagaccatcctggctaacacggtggggccctgtctctactaaaaatacaaaaaaaaaar

SEQ ID NO: 9403 - DNA, 176 bp, Homo sapiens
agagctgaaagggatcatctagtccaacccattcatttcatgggtagagaactgaaacccagagaaaatagaaatgccaccacctcggtgccagatctcctagatgcccacctacaggtaaggcatctttaccagttctttatgcacttgcaaatggccacttagagataaatgaa

SEQ ID NO: 9404 - DNA, 317 bp, Homo sapiens
  misc_feature 288: n=a, g, c or t
gcacaacatttggctcattttatttttctcattgttattttttgtttttattttttgagatggattctcacactgttactcgggctggagtgcagtggcgtgatctcggctcactgcaacctccacctcctgggtttacacaattctcctgcctcagcctcccgagtagctgggattacaggcgcccgtcaccacacctggctaatttttgtatttttggtagagatgcagcttcaccatgttggccaggctggtcttgaaatcctgacctcaggtgatctgcctgcnttggcctcccaaagtgctgggattacagg

SEQ ID NO: 9405 - DNA, 455 bp, Homo sapiens
aaatgtaagaccccaaattataaaactactagaagaaaatgaggggaggatgcttctcgactttagtctaggcaaagatcttatggctaagacttcaaaagcataggcaacaaaacaaaaatagacaaatggggctagattaaactgttaggttggtgcaaaagtaattgtggcttttgcctwwttttcttttaaacagcaaaaatctctcttttgcaccaatctaataaaaggcttctacacagcaaaggaaacaagcagcagagtgaagagacaacctgtagaatgggaggaaatatttatggatattttacctgtatgttttgcaactatttaacctgtacaaggggagagaatatttgcaaatattgcaaattcagttagragacaatacagtagaaaaatggvcagragaaaaataatttcaccagcctgggcaacgtaagtgagactct

SEQ ID NO: 9406 - DNA, 255 bp, Homo sapiens
tagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaaaaaaaaaaaaaaaaaaaaaaaaaaaaaaaaaaaaaaaaaaaaaaaaaaaaaah

SEQ ID NO: 9407 - DNA, 276 bp, Homo sapiens
aaatcattcttaaatttagtttaaaaaggaatatgatctgtttactatatgaaagcacctaatgtacaacctataatgcttttctgaagtgactgtagtacaaataccaaccatatttgcagcaacactgagagacagaaaaactgatgacaatgtcttgttttgattaaacatccagagccatataagtaatactgttttttaagcacccttgttctgggcatgtcagtatctgtatttcgtagacccccttttttttttttttttttttttttd

SEQ ID NO: 9408 - DNA, 454 bp, Homo sapiens
cagccagatatgtgaataattgcaggaaaaacattccaggtagaagaacagaaagtgtaaaggctaggaggtaagaaagagctcgatatttcacaggatcggaaaggagcttgttgtggctcgaatgttgtgamctaggaagagagatgcacaacaaggggttagacaggcaggcaggagccaaatcatttggggatttgtaggccatagtaaagatgaagtttgaattttattttgagaaaataagaaatactttagaaagagtttaagcagagtaatttcataatctaattttcatttttcaaagaccactctggtttatcggtagagaagaattagaggggaggcataggaaaaacaagaagactggttaggcagatgtgctagtcaagatggccaagggtagtggcaggttggattttttcctctagtactgtcaagtagcattttggga

SEQ ID NO: 9409 - DNA, 444 bp, Homo sapiens
aaaaatatgtatacttccaaatctcattcagttgaacatttccaaaacgtctggtacataatgtctgagaatgcccaggtcctcctggaggctgggtatagctatggtgaggtgttgcagtcatgaagarggaktkgggtccttgcctgcctgccctacagtgagcaatccctagaagcgctgttattcaggttgtcttgctttttgtcttttgaaatgtttggatttgggatgttttggaaatttccccatccaaaatttttggaagatagggatggggatgggaatgatccctgttccttattttyyatttkyatttttttgatacagggtctcgctttgttgcctagactggagtgcagtggtgctatcatggcttactgcagtctccacctcccaggctcaagcaatcctcccacctcagctactcgggagactgagaca

SEQ ID NO: 9410 - DNA, 137 bp, Homo sapiens
atttttactggttcttctgaattgacagtaaacctgtccattatgaatggcctactgttctattatttgttttgacttgaatttatccaccaaagacttcatttgtgtatcatcaataaagttgtatgtttcaactg

SEQ ID NO: 9411 - DNA, 553 bp, Homo sapiens
agagctgaaagggatcatctagtccaacccattcatttcatgggtagagaactgaaacccagagaaaatatgaaatgccaccagcctcggtgccagatctcctagatgcccacctacagatamcttttataaatgaaatgtgtcaacctcttctggcaatacgaccagccccacaataagttactgtgggggtgcatcatgaacttctctscccataagtccytttgaaacgaaatgcacagggaagatacgatggaaacacaccttagaagacttgagcttggacctgagcacaatcacaacagctggcccgaatcasgtgaccataaacaggcagctagcttwamctgagattcattggtagcccaggggtttgctaccaaactttggtaacctcaagggacaaaatgaggaakgatgtgttcattgtggactctaaaaaacaaaacaaaaacacaaaatccccctgtttcaaataaacaaaaaattccaagattgattcatgaaaataaagaagacatgaattgtcaaaaaaaaaaaaaattgcgaaagc

SEQ ID NO: 9412 - DNA, 451 bp, Homo sapiens
ttttatttttatttgttttattattattgttgttgtttcttttgtgttttggggttttgtttttgttctttttaagaaacgagatcttgctgtttgctaaggctggttctccaactcccttggcctcccacattgctkagattacaggtgtgagccactgtctcctcaagtcctgtttaactacccatggttcccttcatgtgtaccccacagaatttttgcctcttatgtatggctcaggcttcatcccagcccctgacatgtatacacacaagtacacatacacacacgcaacacacctggctgatttgattgtccttattgagatgtaactagttgtgacttcgktttagtaatcytctgatcagggatagcttgcyamccccaaaattccctaaagccatasccacatctccactgtgtkattaatagcctttgtatactcgacttc

SEQ ID NO: 9413 - DNA, 407 bp, Homo sapiens
tcagacttccagaaggaaatcaggtatttggcataaaccatgttatttgcacagtctagcataggaractacccttatcagtcagggaaaggtaagctcacttccaaaaccctagttcccaaatgctastccaaggccaaccttgcagacaggcccttcttaagatagcagcctcagactgcacaaagataagtacttggcttcaaggatttcagtggataggcaacatgtaaaaataggctcaggagcctggacagttgctgcctgttttcatacatgagagataaatacttttgtgcttgcattcgtacatataactcactattagtaatctaagggaacttcattacttggaaattaaattcaggagattttggkgccctgctcttttgtttgagaatcactgc

SEQ ID NO: 9414 - DNA, 308 bp, Homo sapiens
ggggcaagctggcaacgcggtttgtcttgacggctgcttagggcggtaataakggatcgaagaggatagcattcttgaatgggaaacattggtggcgccacagctggctggtggcgacttcaagacccactggaaggctgggattggmagccatgactcataagggcggaataccacggggatcggtttgtctggcgaacttgagtgaagggtcaagatctcggatttcacctttcctctgagcttcctgataacccggacgttccgtaaacccggrtccggagccgaaagtggtgcccagatcccgk

SEQ ID NO: 9415 - DNA, 408 bp, Homo sapiens
tcatctatgtttatcacattttaataccacagcacttataatgatgtcactacatatagaagctcaaagttaagggatttgctgaagactgtaaagttaatggaagaattgagacaaaaatccagtgtagctggccacttatcccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctct

SEQ ID NO: 9416 - DNA, 305 bp, Homo sapiens
caaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaatttttttttttccctgrgtaaaagcaagaaatttcttcctttggaaaaaatatatatattaaaaaaccacttttagatggttttttttaaaaaaaar

SEQ ID NO: 9417 - DNA, 439 bp, Homo sapiens
cacaacaatttggcttaaacagcactttggttgaaaatgaatatcccctagttatgtgtttttcaagtattggtcattttggtatatcatgagttgttttgcaaacttttgtgccaaagttttcaggaaaactttctaatatttgcttttgtgtttctaactgattttcagagaagttgtaattttgatgttttttccttttagtgagcatgctttaacaaaaaacaataacagaaactgtgtcaaagaaaaggacctgtaatcttcagggtttgtagtctttttcctcttaaaaaacccttttcctaattaatggcagttacatctgcatggctggtttgggtaagtcttcattttgttgtattgctgagtaacagtcaacaaaggtttatcaactcttggttaagggttcctttcatgttgtgagtaacatgaacaa

SEQ ID NO: 9418 - DNA, 464 bp, Homo sapiens
ccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaa

SEQ ID NO: 9419 - DNA, 430 bp, Homo sapiens
tacatttcagtctttaatccatcttgagttaatttttgtttatggtaaaacataggggtccagtttcattcttctgcatatggctagccagttatcctagcaccatttattgaatagagagtcctttccccattgcttatttttgtcagctttgttgaagatcagatgcctgtaggtgtgcggctttatttctaggttctctgttctattccattggtctatttgtctgtttttataccacaaccatgctgtcttggttactgtagccttatagtatagtttgaagtcaggtaatgtgattcctcaggctttgttcttttgcttagtattgctttggctattcagtctcttttttgtttctttatgaattttagaatagttttttctaattctgtgaaaaatgacattggtagtttgatagaaatagcat

SEQ ID NO: 9420 - DNA, 368 bp, Homo sapiens
agagctgaaagggatcatctagtccaacccattcatttcatgggtagagaactgaaacccagagaaaatagaaatgccaccacctcggtgccagatctcctagatgcccacctacaggtaaggcatcttaccagttcttatgcactgcaatggccactagagataatgaagctgaggtagaagagataatttaatccagaatatcagaaaagtaccggtcagatgcggtggctcacgcctgtgatcccagcactttgggaggccgagcacaccatggaatctgaagtgattcagaatggctggcttttgaaattcctttgaactaaataaagcaccttcatttttacttgaaaaaaaaaaaaaaaaaa

SEQ ID NO: 9421 - DNA, 413 bp, Homo sapiens
tacataaacatgttcataaagttamatgaagtaggatataaaattssscctartstttatmmaagyvratatatttacatgmmaggagaaaactcacctcccactcttacagcctctgccagtttaccatagctagtttcttgagcagmtaatctatatgtcttcagcttttttcattgaattcattataatctggattctgccttcatcattgcactaaaatttatctcctagttgccaaatccagtgtctcctctcttagtccccaaattgacccctctgcagtattttgatactgttgaywgtkcccttgttgaaacattcctccattctgaatgtccaccaataaacagttggttaaataaaaattatagtgtatagttttayaatagagtattctgttgtagaccaar

SEQ ID NO: 9422 - DNA, 422 bp, Homo sapiens
  misc_feature 409: n=a, g, c or t
ccattataatctatatacattwaaagaccgtgttacataatctcttctgggtagaaaatggaaaatacttaacctttgcattggtcctttcaggcttgaacaacagtggctgtatctgcatcgtggggttgctggtggtagaacactttggtgttaggaaagtttggaaaagaggatatcctgtattaggccattatgattagagataagcagcctgggagaaacatacaagacctgtggctactggtagagaattggaataagcttccaacaatggactgtagagattaatggagattgtttagtgggcccatggctaggtggggtattaatacagttgaagttatgttgcccttggcacagatctttgagaatctcatacatctgtgaaaaagataatgtgaaatanaaaaaaaaaaaaa

SEQ ID NO: 9423 - DNA, 454 bp, Homo sapiens
  misc_feature 20,386: n=a, g, c or t
ttagaaagtaaagtacggangaataagggctcaggaatcacagcctcactaattactgtatgtcctttcgtaatattcttaacctaagtttcttttgttttgttttgttttgagacagtctcatcctgttgctcacgttggagtgcagtggtgtgatcatggcccactgcagtcttgacctcctgggctcaagtgatcctcccacctcagcctcctgagtagctgggactacaggtgcatgctaccatgcctggcaaaaaattttttgtagagacgggtcttcctgtgttgcccaggctggtgtcaatctcctgggctcaagtgatccaatcaccttgacctcccaaagtgctgggattacaggtgtgagccaccatgcctaggbncaagttttatcttcataaacgtggatattttctaccttgtagaactgttgtgaaaaaaaaaaaaaaaa

SEQ ID NO: 9424 - DNA, 435 bp, Homo sapiens
atagttccctgcggsctctgccttggggagtatgtttgtaccgagatccgcgctaccagattgcaccggggctgatttgggggctgggaatttgccattctgctgtacagacactgatttttttttcttctttttaaaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcaggtaagaaatggtttttacgtgtaatagttatacaactgatgtataatatttaaaattaaatgctaatcaaaaaaaaaaaaaaaa

SEQ ID NO: 9425 - DNA, 426 bp, Homo sapiens
tttttcaacaaaacaaggtcctagaagagawaaacataaagaccttttacctatgcctacaacttggatatctacttttaattaagctgagtgttctttaagaaaatccttttaaatcccctattacctgactttagccatcccaagtggccaatatttctggctttcaaactttactaaaggctcaaagaaagtaaaatccaaggcatttcgtggaggggaagagaatcaacaaatagcaaaggttgcacaggtatcaaaccaaaaaggactcattccctaagccaggatcgaaccccgggccacaaatgtaaaatggcagaggctagaacaaaacattgtcatgtggttacaggtctggctctgaaggacgtaaaacaagatggaggcctgcagcaaagtttgctacttaccatacagaaagtt

SEQ ID NO: 9426 - DNA, 490 bp, Homo sapiens
aaactgtaagacttttcaaaataagagtagttcttataaatgcttacttagtgcctggttgcgctaagcagtcactaggtattatctcatctaattcctgtaacaaccctctagggtagatactagcatttatcaccagatctgagatatcttgtaagatactccattttcttgcatacctctaagcaagaaaagvatgcgtctaggcgcagtggctcactcctgtaaacccagcactttgggaggctgaggcgggtggatcacctgaggtcaggagttcgagactaccctggccaacatggtgaaaccccgtctctactaaaaatacaaaaattatccaggtgtgatggtgcacacctgtaatcctagctactcgggaggctgatggaggagaatcgcttgaacccgggaggcaggggttgcagtgagcttbaaatcacgtcactgaactccagtctgggtgacagagcaagactctgtctcaaaaaac

SEQ ID NO: 9427 - DNA, 302 bp, Homo sapiens
  misc_feature 151: n=a, g, c or t
cgraaaaatctaatatcagagctgtttattctctagccataatggattaaactagaaatcagtaacagaggtatccagaaaatcctcaaatgttcagaaattaaataacttcatacttacaaataatccacaggtcagagaggaagtttcnmgggaaataaaaacattttgggccgggcgcagtggctcacgcctgtaatcccagcactttagggggccgaggtgggcagatcacaagataaggagatcgagaccatcctggctaacacggtgaaactctgtctcgactaaaaatgcaaaaw

SEQ ID NO: 9428 - DNA, 234 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataaagtcctttgaaacgaatgcacaggaagatacgatggaaacacacctagagactga

SEQ ID NO: 9429 - DNA, 440 bp, Homo sapiens
atatctcgcgataractgtttaaaatggcggcttcaaggcgtttcacgggtgtcccggacaggcgtggaggtggggcgcaggcgaggatgaagcttgagttggccaggagtcggaaaacgattgcaggcgggaccgcgtccgtcggggctgaggaaacttagcgtggcagaccctaaactgggataactttagggatatggccttcttttcccagttgcctcaaacttagagcagcgtcgtctttagccgaagattcattttcccagcattttccttctccaggcggagtagttggagacagagggcaagccagaaactgaccttcccatctcctcattcccttccatcaagaacttttcatcgttctttccccaccctggattgtaaatggtatttggcttcataaaaacgtttgtccacagcaaaaaaaaaaaaaaaa

SEQ ID NO: 9430 - DNA, 560 bp, Homo sapiens
  misc_feature 154: n=a, g, c or t
ctattctggaatcagaatcgtgtagcagaatgcagtcacatactgctagtctgccccaaatgcattaacagggagtcatgaattaaaaggcagccatgaaaaaacattgaaaggaaaaaagtgtgggttagcattgtctaaaatgaatgtccanaagcaaataaatttggccatatagagagtcttccgaagagtcagatgaaaagaatatattttataaccaaatttaactttagaaatgttatatcagcatttcccatggtgtgttaatgaagctctgcaagatgtttaataggtgtcagatgaataaaatggctccacagtcaaatacacttcgaaaaaaaatttttttttaagtttcatcactgcagaatttcttagatgctaaagtgcattaggaaatcaactggaagagaacttgcattctgaaggtttttctcatatttttgaccatagaaatatttttttccatgtgaaccccttggaaccagtgtttcatagattgcattctcagatacagagttctagataaatcatctttaactaaaaaaaaaaaaaaa

SEQ ID NO: 9431 - DNA, 442 bp, Homo sapiens
attgagacgtacagtaagagawataaagatatctctgattgattggctcagtagtcaagtggagatgacaagatagaatcagtgaccttaacagatcaatagtacgattggtgaacaggacagaacaagagaatttacccaatctgtgccgagtgtgatggctcacgcatgtagtcctagcactttaggaggccgaggcgggtggatcacctgaggtcaggagttcaagacgagcctggccaacatggtgaaacccatctccactaaaaatacaaaaatcagctgggtgtgctgacgcacactgtgatcccagctacttgggaggctgaggtaggagaattgcttgaacccaggaggtggaggttgcagtgaaccaagatcataccaccgcacttcagcctgggtgacagagctagactctgtttcaaaaaaaaaaaaaaaa

SEQ ID NO: 9432 - DNA, 61 bp, Homo sapiens
catcctggatcatggcatttaaataaaagattgaaagattaaaaaaaaaaaaaaaaaaaad

SEQ ID NO: 9433 - DNA, 398 bp, Homo sapiens
acacacacagacacacacacgcacacgcacacacgggcgcgcacacacacgcgcgtacacactgggtctccaggcagcggccgtcgccgatccccggcagcagctccaggcaaagtgacagaggacagtgctgctgtgagtttgacgaakggacatcacctgcagtcagtccagagctgcccagtgggaaagggcagcttgctgaggactgaagactaaaataaaccctcccaggagaggaaccggccggtgaccttggctgcaaccaccttgcagatcagctgcttcattcctttccatattttgtggcctgtggggggaatcaagtgtcacaaaagcaggaagagagcagtttgaggaagactccagaggcactgctggtaaaagtgctgacgtga

SEQ ID NO: 9434 - DNA, 119 bp, Homo sapiens
ctttcggagggtggtgagagtctgcggacgctgtataccctcctccacttcccgctgcagccaataaaggccgttcctaccataaaaaaaaaaaaaaaaaaaaaaaaaaaaaaaaaaav

SEQ ID NO: 9435 - DNA, 436 bp, Homo sapiens
  misc_feature 436: n=a, g, c or t
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatcaagattn

SEQ ID NO: 9436 - DNA, 147 bp, Homo sapiens
tgaccaaggaagagctttgaaggcctgaggtctgcggaaggtgggaggaggcagacgccctgcgtggcccatggtcggggcgtccacgccgaggccggcaacaaacgacagtatctcggattcctttttttttttttwaaatttttw

SEQ ID NO: 9437 - DNA, 212 bp, Homo sapiens
agaggcagccagggcgccggaagaggcctggaaatccacgcggcttccbaaagacggcgcctctgttctgcgggttcgtgacgaggatttatttccacccactgcgcctgggcggktyctgcgggtccgcgcccactgcgtgcggcscacggaccatgtcggtgactgatcaggcttttgtcacactggccacagatgacatctactgccag

SEQ ID NO: 9438 - DNA, 253 bp, Homo sapiens
tcagatctcatagatgaccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcct

SEQ ID NO: 9439 - DNA, 263 bp, Homo sapiens
ttctttgtgctgctgtgctatcctttcttaagcctttgattttgatttttcgtyaatattttttaaagaggcacaacttagccaraattcttaggaggacaagattcaaaactcatgtgttagtattttgatagctgtgtctttagaaacctactcaacacttttattttatagaagaagcaactggcctacagaggttaaaagatttgattgggcatattgctgagaagagtcctagaatcccagcacttttggaggctgag

SEQ ID NO: 9440 - DNA, 299 bp, Homo sapiens
tttctgagagaaaaagtgtaaagcaaaataatatcttttaacaaatgtttgtatttgactaaaaaggaagcaagcacttaatttatgaatttgctaatkgctcttctgagctgagaatatctgtgttgaatattagtcattatccgtatttggcacagaataatcccgagggktaaatgacattgktcctacagtgggcacctgaagactggctataaaagcaatcctggccargggcggtggctcacgcctgtaatcccagcactttgggaggccarggtkggtggatcacgaggtca

SEQ ID NO: 9441 - DNA, 444 bp, Homo sapiens
ctcttctcgtctgcacatgtgaggcatgactttctttcaccttctgccatgattgtkagacctgccccagccacatgcaactwagaacagtaaaacagacttgttattggcagcccattagtgctcaggagaggcggtctccagcatgacatcagccggcggtcgacccaaatctagtatttcaccagagagcctaacgctgctggctttccaactgtgtggaagacgatacaggcgtaacaaagacaaggatgaaataagtcctgtgatggagagacaagcaaaattctacctgacttcacaggaggaagaagtgtgctgtgccagggggawcaggagaaagcttcatggaagagcttccaacggagccattttacttttaccaactcgaatttgatgaccaaccaaagagagaaagaagtaaatgactactactaggaatct

SEQ ID NO: 9442 - DNA, 418 bp, Homo sapiens
attttggaactattatgakactatgtaaaggataggtttaaggggcagaacgtcccaggcagataccagtgaagaaactgttgcaggagtttaattaagagataaatagaggcttttggcaccagctatgacagaatgactggtgcaabwtgggccctcccactgtaaacaacawwaaaataggacaccaccccctcactatctgtctatctgtctgtccatctatcgatcaatcgaaagagagcatgggtgtgcaacacaactattttcaggcattggacaataggcagccactgtgttggtcaccattgcccaggtgtctgctgcatactattttccaactgtggtgctgtaatctggaggccaggcctgccagagtacaatagactcactgagctgaggaggcacagaacagaat

SEQ ID NO: 9443 - DNA, 448 bp, Homo sapiens
atagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagatcccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcacaaaaaaaaaaaaaaaa

SEQ ID NO: 9444 - DNA, 238 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctgg

SEQ ID NO: 9445 - DNA, 467 bp, Homo sapiens
  misc_feature 257: n=a, g, c or t
ttaamctttatcctccaattcttacagtgcccagttctcctgtgctatctttgctttvvwacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacarntttttaaatatatcttaacagtctgactaacttaaaataatttattcttcccttaaaacatttttctgkgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccaw

SEQ ID NO: 9446 - DNA, 295 bp, Homo sapiens
  misc_feature 295: n=a, g, c or t
agtttcttgattcagcagcttcctgactagagatagagccagagcagaagatgggcagagtctgcatgtggctgcaggacctctgtcagagaatgaaacactcatcgcatggtaaggctggtctgagagcaaggtcaagataaagagccatatcctaaaaaaaaagagaagcagccaaaagctgtttgggtgtacgggaggtgagcttgggaatacctcagtggcgaagggatgtcagaggtagtatgaggtgaaaasvagctgttggaatacataacagtgctaaattgctggn

SEQ ID NO: 9447 - DNA, 405 bp, Homo sapiens
cacgaatggtctcaatttagtttttcaaattgtcaagtataatggtatggcatttcgtctttgcagctagaagctaagcatttaactttggtgccttttgtgtgacctaaatgtacaacttgcagattttaaaagtagtagatattgtctggattttaaggcttgttttccctagtattgaaataagaagtgggcagaagggtatatttcggggtgctttgctaacaatacatatgtctgtgaatgagctcgtgtgttgtcttgcagtcactttattttgaacataaaaatgtatgtttccaagagggatctgtggattaattgctatatttctaaaaatgctctacccttaaaatttttgccacttaataaaacagctatgtgaaatcaaaaaaaaaaaaaaaa

SEQ ID NO: 9448 - DNA, 191 bp, Homo sapiens
cctaacatactatgtaatttgcttgtttattatatcgtttctgtctttccctatatggtttcctttgttcactgatgtgcccaagtgccctgttcctgacacatagtaggcactcaataaatattcattaaaggaatgaatgaatgaaaaaaaaaaaaaaaaaaaaaaaaaaaaaaaaaaaaaaaaaaaar

SEQ ID NO: 9449 - DNA, 416 bp, Homo sapiens
ttttattttggtaaaaatatataacattagatttgccattttcaccattttttaagtgtacagttcagtgtcattaagcatattcacattgttgcacagtcattatcactatccatcctcagagcttttttgttaccccaagctggaagtttctacctattaagtagtaattccctattcccccctccttctgacccctggcaaccactttgttactttctgtctctattaatgtgacttaattaatttgtttctgtaatctttacctcaaaagcacttatccttcaaggaagatttggtttatgggtatcagatttaatttatttaatttattgcacctaaggcacaataaaaaggtaagtaaccttacctgccttgtgtacttttgattatttttaatgtgcaggatttgaaca

SEQ ID NO: 9450 - DNA, 415 bp, Homo sapiens
agaaaaaaagtaagcagaaagataaaggaatccaattaaattgggtttgacttttatctttgtttttactgttctcaaatgaagaattgatttgcatgtctttcttgcctgtagaagcatttgatttccttctgtgaactaatctgtagtcttcatttctcttgaaatatatgcccactggtataaaaaaggctaatgtaaacatgttggccatttaaaaaattttctgctaaaaaacctatcagtgtagtttgcagatgcagttagaaagagcagaagtaggctgggcacggtggctcatgcatgtaatcccagcactttgggaggccgaggcggatggatcgcctgagtccaggagttcgagaccagcctgggcaacatggtgaaacctgtctctacaaaaaaaaaaaaaaaa

SEQ ID NO: 9451 - DNA, 427 bp, Homo sapiens
tcaacattcacatatacctagtgttacataggagagacgcattttaatttatattctaggtaaacttcatctcctaagaaactagactcacaacgctatttgctatgaggaactcttcatctagttctccatatgcattcaagagaatttcatcctgaatgtgaacatgatgtcaacaaattttcagagaatcgtttaggttaaaaattgaactagttttttttccamgaaattaccagattaactgtggatctttctcatgctaagaccaaagaaatgttagcattaggtgtttataaaggtagcatcaggcacctgtagtcccagctattcgagcagctgaggcaggcggattgcttgtgaccaggagtttgaggctgtagtgtgctatgattgcacctgtggctagccactgcactcaacctgg

SEQ ID NO: 9452 - DNA, 279 bp, Homo sapiens
catatatctatgctgtattttgtgtgtttgttttgtgtgtttcttgacaattccacctgttcttaaaggaaggtgtggcaattttatttttatagtttttagttttatagtttttttagttttaatttttatagtatgctgaaagtggttaagcacctcagctgtaggtcttttacagctttctaaaatagcatcaagttggtaatgagggatgtcagctagtcctgttttcaaaacttgggagcagtggtaataaggcccaccaaaatcttttttttk

SEQ ID NO: 9453 - DNA, 328 bp, Homo sapiens
  misc_feature 317: n=a, g, c or t
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccangggttgctacc

SEQ ID NO: 9454 - DNA, 392 bp, Homo sapiens
tatttattttgtgttcttttaaaatttatttttccatataatctctgtgagggcagggatcatacagctctcaaggtacacatcacagtatgcagataggcccaaaataaacaaacatctttatttttaaagttttttaattataaaaagtaatacgaggccaggcacagtggctcatacctgatacctgtaatcccagcactttgggaggctgaggcgggtggatcacctgaggtcgggagtttgaggccaatctggccaacatggtgataccccatctctatgaaaaatacarcawgcaaysaacagsaactracwwcatcaacacatymscywkgccatgghggtgtgtgcctgtagttccagctactcggaagggtgaggcaggagar

SEQ ID NO: 9455 - DNA, 235 bp, Homo sapiens
agtccctccaagcttccttccttatccctttagagccctgcagccctcaggcagtgtagcccagaggttcaagggcattcgctctggtatcagaagggtctgggttcaaatcccttgtgcactgcttgctggctgtgtgactttgggcaagttgcctaatctctctggtcctcagtttttgaaaaaaaaaaaaaaaaaaaaaaaaaaaaaaaaaaaaaaaaaaaaaaaaaaaaah

SEQ ID NO: 9456 - DNA, 537 bp, Homo sapiens
ttgaccacagacttgttggctccacccttgaattcctgacgccctaggtctgggatggggcttgacaatttgcatttgtaaaaagttcctgaatgctgctctgctgctggtcagggaaccctgctttaagacctcctggtttatgcaatttcaaacattgtaagaaatagtcactcatgtgattggtttgtgtgcttggtgtagactgtacgaggatttttcaaaagtaagtatcttcattctaaaggaaggaaatgtatgttatgagatagaattatataataaacagaaccattaaatgccatctgaaaagtggtgttttcaatggcaggaagtagcattgctgcgtattttgtgtgtgtgcgcaactcagctttgtgtcattgtgtaactttaatttgaaagaacatcacgtgactgctgttttcatttctgccttttaaaaagcagacagctattcagaacagcaagaagcagacccaaactttgtttgtatgcccctagtcataggcaaaaatggaaagggtaatttaccaa

SEQ ID NO: 9457 - DNA, 375 bp, Homo sapiens
agataggttggagacaattgattgctcgatgatataaaatgttaagtaccatgaatgatgctgttaggctggaatgcgccaagcataaaggtggggcatggcatcaaaaggtaggtcaacatattaaataattccatgtattgaaatatccagaaaatatatagacagatctatagagatagaaactggtctgcccaggactaggggttgtctaaggataaggagcttcttttttggatggtgaaataacctaaaatatattgtgccattgtttgcacaactttgtgaatatattaaaaacctgttaattgtactcactaaatgtcctccttctaaattaagctgttcttgacaagaaaaggaaagaaacaaaaw

SEQ ID NO: 9458 - DNA, 103 bp, Homo sapiens; identical to SEQ ID NO: 8028

SEQ ID NO: 9459 - DNA, 76 bp, Homo sapiens
tttttcgcaacgggtttgccgccagaacacaggtgtcgtgaaaactacccctaaaagccaaaaaaaaaaaaaaaaa

SEQ ID NO: 9460 - DNA, 71 bp, Homo sapiens; identical to SEQ ID NO: 8867

SEQ ID NO: 9461 - DNA, 59 bp, Homo sapiens
cttttgcgttctctttccctctcccaacatggcggcctcagcaaaaaaaaaaaaaaaaa

SEQ ID NO: 9462 - DNA, 441 bp, Homo sapiens
ctcatctagccccgccccagggagggcgccgcacccacaccgcgctgcgcagttttgttctgctccagctgttcgaaggtgatccagacgcaagatggctgtcctctctaaggaatatggttttgtgcttctaactggtgctgcctatcatgtacagcacggaccctgaaaatgggcacatcttcaactgcattcagcvagcccaccagaacacgttggctagctgttggaggtgtttaccacccgcgtatagcttctggcctgggcttggctggattgttggacgagttctttatgcttatggctattacacgggagaacccagcaagcgtagtcgaggagccctggggtccatcgccctcmtgggcttggtgggcacaactgtgtgctctgctttccagcatcttggttgggttaaaagtggcttgggcagtggaccca

SEQ ID NO: 9463 - DNA, 328 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctacc

SEQ ID NO: 9464 - DNA, 91 bp, Homo sapiens
gaggttgagacaagagaatcacttgaacctgagaggcagaggttgcagtgcagcctgggtgacagagggagactccggccccctcccaaaa

SEQ ID NO: 9465 - DNA, 50 bp, Homo sapiens
acagttaactttaggaccatagccaaaagatagaaacagcataaacgcca

SEQ ID NO: 9466 - DNA, 341 bp, Homo sapiens
cacacctacaaataccacaccacacctacacacaaagccttcataaaaataagagccgggccgggcgtggtggctcacacctgtaattccagcactttgggaggccgaggsgggcggatcacctgaggttggcagttcaagaccagcctgatcaacatggagaaaccccgtctctactaaaaatacaaaattggccaggcatggtggcgcatgctgtagtcccagctactcgggaggctgaggcaggagaatggcatggactcgggaggcggasttgcagtgagccgagattgtgccactgcactccagcctgggtgacagagcgagactccgtcccaaaa

SEQ ID NO: 9467 - DNA, 165 bp, Homo sapiens
ctggacaaatgacttgaatagacagttctccaaagaagatatgcaaatggctcaacattattaatcattagggaacattgttaataattagtggtatctccacagtgagatatcacttcttacccattaggatggctataataaaaaacaaaaaaaaaaaaaaaa

SEQ ID NO: 9468 - DNA, 104 bp, Homo sapiens; identical to SEQ ID NO: 8046

SEQ ID NO: 9469 - DNA, 107 bp, Homo sapiens
  misc_feature 102,105: n=a, g, c or t
gaggttgagacaagagaatcacttgaacctgagaggcagaggttgcagtgcagcctgggtgacagagggagactccggccccctcccaaaaaaaaaaaaaanaangc

SEQ ID NO: 9470 - DNA, 358 bp, Homo sapiens
tgtctgatttctttcactggtattttgtagttctcctcatagagatagttcacaaccttggttagacatactcctagtcattttttggggggtgtggctatttttaataggattgcattcttgatgatgtgtttctcagcttgaacattattggcgtttaagagtactgctgactgggccgggcacggtggctcacgcctgtaatcccagcgctttgggaggccaaggcgggcggatcacctgaggtcgggagttcgggagcagcctgaccaacatggagaaacccagtctctattaaaaatgcaaaattagccgggcgtggtggtgcgtgcctgtagtccggctacttaggagggct

SEQ ID NO: 9471 - DNA, 308 bp, Homo sapiens
  misc_feature 192,265: n=a, g, c or t
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaanagaattaagtggccgggcacagtggctcatgcctgtaatcccagstacgtgggaggctgaggcaggagaatcncttgaacctgggaggtggaggttgcagtgaactgmgattgcgc

SEQ ID NO: 9472 - DNA, 104 bp, Homo sapiens; identical to SEQ ID NO: 8046

SEQ ID NO: 9473 - DNA, 101 bp, Homo sapiens
gaggttgagacaagagaatcacttgaacctgagaggcagaggttgcagtgcagcctgggtgacagagggagactccggccccctcccaaaaaaaaaaaaaa

SEQ ID NO: 9474 - DNA, 381 bp, Homo sapiens
agagctgaaagggatcatctagtccaacccattcatttcatgggtagagaactgaaacccagagaaaatagaaatgccaccacctcggtgccagatctcctagatgcccacctacaggtaaggcatcdtaccagttcttatgcactgcaatggccactagagataatgaagctgaggtagaagagataatttaatccagaatatcagaaaagtaccggtcagatgcggtggctcacgcctgtgatcccagcactttgggaggccgagcacaccatggaatctgaagtgattcagaatggctggcttttgaaattcctttgaactaaataaagcaccttcatttttacttgaaaaaaaaaaaraaaaaaaaaaaaaaaaaar

SEQ ID NO: 9475 - DNA, 107 bp, Homo sapiens
  misc_feature 105: n=a, g, c or t
gaggttgagacaagagaatcacttgaacctgagaggcagaggttgcagtgcagcctgggtgacagagggagactccggccccctcccaaaawaaaaaaaaaaaangs

SEQ ID NO: 9476 - DNA, 104 bp, Homo sapiens; identical to SEQ ID NO: 8046

SEQ ID NO: 9477 - DNA, 97 bp, Homo sapiens
acagttaactttaggaccatagccaaaagatagaaacagcataaacgccaaaataaaaagaagccaataaagataaacacaaaaaaaaaaaaaaaaa

SEQ ID NO: 9478 - DNA, 60 bp, Homo sapiens
cttttgcgttctctttccctctcccaacatggcggcctcagcaaaaaaaaaaaaaaaaaa

SEQ ID NO: 9479 - DNA, 84 bp, Homo sapiens
acagttaactttaggaccatagccaaaagatagaaacagcataaacgccaaaataaaaagaagccaataaagataaacacaaaa

SEQ ID NO: 9480 - DNA, 52 bp, Homo sapiens
gaggttgagacaagagaatcacttgaacctgagaggcagaggttgcagtgca

SEQ ID NO: 9481 - DNA, 323 bp, Homo sapiens
aacctaatcaagcctgggcaatggcgggcgcccctcccgcagcctcgctscgccttgcaggttgatctcagactgctgtgctagcaatcagtgagactccgtgggcgtaggactctccaagccagtgagatgaactcggtacctcagatggaaatgcagaaatcaccgtcttctccatcgctcacgctgggagctgtagacsggagctgttcctattcggccatctttgctcctccctgcaactaastccattsttaattgggtctsactctgtsacctaggstggagtgcagtggcgtgatgggcgtgatctcggctcattg

SEQ ID NO: 9482 - DNA, 96 bp, Homo sapiens
gaggttgagacaagagaatcacttgaacctgagaggcagaggttgcagtgcagcctgggtgacagagggagactccggccccctcccaaaaaaaaa

SEQ ID NO: 9483 - DNA, 59 bp, Homo sapiens; identical to SEQ ID NO: 9461

SEQ ID NO: 9484 - DNA, 399 bp, Homo sapiens
agagctgaaagggatcatctagtccaacccattcatttcatgggtagagaactgaaacccagagaaaatagaaatgccaccacctcggtgccagatctcctagatgcccacctacaggtaaggcatcttaccagttcttatgcactgcaatggccactagagataatgaagctgaggtagaagagataatttaatccagaatatcagaaaagtaccggtcagatgcggtggctcacgcctgtgatcccagcactttgggaggccgagcacaccatggaatctgaagtgattcagaatggctggcttttgaaattcctttgaactaaataaagcaccttcatttttacttgaaaaaaaaaaaaaaaaaaaaaaaaaaaaaaaaaaaaaaaaaaaaaaaar

SEQ ID NO: 9485 - DNA, 103 bp, Homo sapiens; identical to SEQ ID NO: 8028

SEQ ID NO: 9486 - DNA, 61 bp, Homo sapiens
caaatataaaaaattagccgggcgtggtggcgggcacctgtagtcaaaaaaaaaaaaaaaa

SEQ ID NO: 9487 - DNA, 107 bp, Homo sapiens
gaggttgagacaagagaatcacttgaacctgagaggcagaggttgcagtgcagcctgggtgacagagggagactccggccccctcccaaaaaaaaaaaaaaaaaagc

SEQ ID NO: 9488 - DNA, 76 bp, Homo sapiens; identical to SEQ ID NO: 9459

SEQ ID NO: 9489 - DNA, 96 bp, Homo sapiens; identical to SEQ ID NO: 9482

SEQ ID NO: 9490 - DNA, 80 bp, Homo sapiens
  misc_feature 78: n=a, g, c or t
ctttttcgcaacgggtttgccgccagaacacaggtgtcgtgaaaactacccctaaaagccaaaaaaaaaaaaaaaaangc

SEQ ID NO: 9491 - DNA, 88 bp, Homo sapiens
cattggtagcttgatggggatggcattgaatctgtaaattaccttgggcagtatggccattttcacgatattgattcttcctacccgc

SEQ ID NO: 9492 - DNA, 107 bp, Homo sapiens
gaggttgagacaagagaatcacttgaacctgagaggcagaggttgcagtgcagcctgggtgacagagggagactccggccccctcccacaaaaaaaaaaaaaaaagc

SEQ ID NO: 9493 - DNA, 240 bp, Homo sapiens
attgaaaaaaatcaaagatcatctaaataagttgaaagacaatgttcatggatcagaatacttaatattgttaagatggcaatactctcaaactgctctacagattcaatatgatttccatcaaaatctcadctagctttttagtagaaattgacagcagatcttacaatgtatatagaaatgcaagggatagccaaaaacctaaaatagccaaaaacaatctcaaaaaaaaaaaaaaaa

SEQ ID NO: 9494 - DNA, 83 bp, Homo sapiens
gaggttgagacaagagaatcacttgaacctgagaggcagaggttgcagtgcagcctgggtgacagagggagactccggccccc

SEQ ID NO: 9495 - DNA, 88 bp, Homo sapiens
  misc_feature 86: n=a, g, c or t
aataatagctactaaaaagtaacaaggttgagaccagcctgggcaacataaggagaccccttcttcacaaaaaaaaaaaaaaaaangy

SEQ ID NO: 9496 - DNA, 102 bp, Homo sapiens; identical to SEQ ID NO: 8082

SEQ ID NO: 9497 - DNA, 100 bp, Homo sapiens
  misc_feature 97..98: n=a, g, c or t
acagttaactttaggaccatagccaaaagatagaaacagcataaacgccaaaataaaaagaagccaataaagataaacacaaaaaaaaaaaaaaaanngc

SEQ ID NO: 9498 - DNA, 350 bp, Homo sapiens
caaacagaattaccagataagccaaaaatactgcttctaggtatacgccctaaagaactaaaaacaggtgttcaaataaaaactcgtatacaaatgtttatagcaacattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcmaaaa

SEQ ID NO: 9499 - DNA, 107 bp, Homo sapiens; identical to SEQ ID NO: 9487

SEQ ID NO: 9500 - DNA, 58 bp, Homo sapiens
cttttgckttctctttccctctcccaacatggcggcctcagcaaaaaaaaaaaaaaaa

SEQ ID NO: 9501 - DNA, 96 bp, Homo sapiens
tttctttttacattgtgcctttatcagtttatggtatcagggtgatactagcttcatagtatgagttaggcaggagcccatcctcctccatttttt

SEQ ID NO: 9502 - DNA, 112 bp, Homo sapiens
tttctttttacattgtgcctttatcagtttatggtatcagggtgatactagcttcatagtatgagttaggcaggagcccatcctcctccattttttgaaatagtttcaatag

SEQ ID NO: 9503 - DNA, 54 bp, Homo sapiens
aaaaaaaactttaaacagattgaaataaaacagaaaagtaaatgtttttaaaaa

SEQ ID NO: 9504 - DNA, 105 bp, Homo sapiens
gaggttgagacaagagaatcacttgaacctgagaggcagaggttgcagtgcagcctgggtgacagagggagactccggccccctcccaaaaaaaaaaaaaaaaaa

SEQ ID NO: 9505 - DNA, 107 bp, Homo sapiens; identical to SEQ ID NO: 9487

SEQ ID NO: 9506 - DNA, 76 bp, Homo sapiens; identical to SEQ ID NO: 9459

SEQ ID NO: 9507 - DNA, 104 bp, Homo sapiens; identical to SEQ ID NO: 8046

SEQ ID NO: 9508 - DNA, 101 bp, Homo sapiens; identical to SEQ ID NO: 9473

SEQ ID NO: 9509 - DNA, 84 bp, Homo sapiens; identical to SEQ ID NO: 9479

SEQ ID NO: 9510 - DNA, 316 bp, Homo sapiens
caagaaatatttagatagatagatagactatacaaatgtattttcaatacttatkkrtataatatggcttctctaaaattgcaatagcatttcctttacaggacaggtcttgattctwcaacctctgaggaagatatcactaatatcttctaatctttggcgagtttaaaaggagcatatgttcaccaagggcacttgctgataaaaataataggaaaaaaaactcattccatcaccagagtcttaaatccaaactctataattwctgtccccagatatratgtaaccattttttcataraatataattacattgk

SEQ ID NO: 9511 - DNA, 421 bp, Homo sapiens
taaacattaatgttttcagggtactttaaattttagataattactcattgtattcatgtgaaatttgtttttactgcatgtgtgggttggaggacggttttcacttctgattcatctttactcttatctcatcagagctcatacctcttgtagttgggggattgcactttataattccaataaatggggcaaattcaataataacataatacaaatgagtttgaatgcaggacaggtcttcaaagcatacacaacatgggcctacatatgtacaacaataataatttataagttactgtttggatggaaagtaaaagtacagaaaatttgttaaaggaaattaaaatggagatcatgtctcaataatctctgagcagacaaaattagttaggtctcataagtgatctcaacctcgcttgaw

SEQ ID NO: 9512 - DNA, 167 bp, Homo sapiens
acttcagaactagttctgsatctactatgcaaagatcatgattaactgtcaagacactggtagaacagaacaagcaaaagattaagagttcaaaagtagaatgcraccaatttaacatgtagtgktaktaaaaaattacaaaggcctagaccagcctgggcaacatd

SEQ ID NO: 9513 - DNA, 351 bp, Homo sapiens
tgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgktttttaa

SEQ ID NO: 9514 - DNA, 352 bp, Homo sapiens
agtgctagtgtgacaggtctgagcagaaaagtgtccccatgacttacttgtttttcctgaactgccaggtatttaccataaattttatcatattcaatggaacacaaatggcttcccggggggcagcattatgttaataactttggatcttgcaaaagttgcttatctgtatgagcttgaacttactcatttttaacacaaaataagagaatctaattcagagggctgttgtgagcattgaagtcattcacatgatatagtgatttagggcatggtagagtgactggtagataaatcttttcttggtggggtacttaggtcaatttttataataaaattttgtaagtttcts

SEQ ID NO: 9515 - DNA, 377 bp, Homo sapiens
caggacctgaactcaacattggatcaaatggatctgatagacctttacagaactctgcactcaaaaacaacagaatatgcattcctcacatcatcatatgccacatactctaaaatcaaccacataattggacataaagcaatcctcagcaaatgcaaaacaactgaaatcataccaaatacatactgagatcacagtgcagtaaaaatagaagactaagaaaattgctgaaaatcatgcaattacatggaaatcaatcaacatgctcctgaatgactttttaataaataatgaaattaaggcagaaatcaagaagctctttgaaaataatgagaacaaagttacaacatactagagcctctggacacagctaagac

SEQ ID NO: 9516 - DNA, 297 bp, Homo sapiens
tctccctttcccttgacctggatcaccgggggtgcaaatgagtagatacaagggtaatgcaagtcttaatgctaatttcacattattccaggagatgactacacactctaatcccttatctcttggccttcatctattttgcaggtggtgaaggcatttgtgatcctggcctcgsagttcctatcccatgacccagaacagctcamcaaggrgctgcagcagcatgtgaagtcagtgacagccccatacaagtacccaagaaagatagartttgtcttgaacctgcccaagamtgty

SEQ ID NO: 9517 - DNA, 361 bp, Homo sapiens
tggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccamtgs

SEQ ID NO: 9518 - DNA, 240 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggac

SEQ ID NO: 9519 - DNA, 521 bp, Homo sapiens
aagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggkattataccatgattgtatacagtttgtgaaattgttgcaagggcaaagataactcttaaaaaaccgtcgagattacaatgctctagaatcagcatakaagaaaataratgatatctgcatgttgaattggggtrgatggggggarcaagcataattkttwagtgtraagctttgcatcaagaaattattaaa

SEQ ID NO: 9520 - DNA, 295 bp, Homo sapiens
atccaacaggcagtcagagctctcccggtctgaaagttgcattgccactgctaactttgggattgcatcagagaggccctgagtggggttgagatgaggaatgctgatacctgattctagttatggatatrgaggcaaggagaagttgttaggttaaccagcrcagtcctccgtrcrtcccgcccgccgctgccctcactcccggccaggatggcatcctgtctrgmcctgcgcatggcgctgctgctggtctmmrgggttctrgcccctrcrgtgctcacagacgatgttccac

SEQ ID NO: 9521 - DNA, 579 bp, Homo sapiens
taaatgagaaggatatatctatctcttcctgtagattatttattatgtctgtcacagtttttaaaaagcctatctgctaattccaatatcaagattatctataagtctatttatattgatggatttttctcttgactctaggttacattttcctgtttattcacacatctggccagtcatttgtttgttgcagcatcactgattatcatgttatagagattatgaactcttaattttgtcagacgattgttgagttttgtctagcaggtagtcagattactggaggataactctgttgtatacagtgattttctagggagatagggttaggggagagggagaatgtagtttggaataaacgatgctgactccttccaaggaaaatcactggtaaaccagtgactactctgctaaattgcctctcttgacattgtcaacttgaagtaatcaaaaggatcagattctggaattaatgcaagcagaaagctgaccaatccgggagaacagacttcagaaaatggggtcagtgttccaaagttaaaagttcagttcttgcaggccaggcacagtagctcacac

SEQ ID NO: 9522 - DNA, 83 bp, Homo sapiens
atcaaactacttgcttccacttccccgcmcgggatgaggagtctccacgacggggaaaggtcgcactgacagagaaggaagtt

SEQ ID NO: 9523 - DNA, 383 bp, Homo sapiens
  misc_feature 84: n=a, g, c or t
cctgaagcagctgcccaaccaccgggtgctgatcatgaagggggcggggcacccctgttacctggacaaaccagaggagtggcntacagggctgstggamhttcskgcagggggctccagtgaagcccagcactgctgcagggggtgggctgcctgcctgctctgagctctctcttgcacgctctctcttctctcccaggctctggctcatgcacatgcaacaggtgcgtctgtctatatgtctgggtkcttgtctkttgtggtctgtttgtcttttctacctctktctcttgcagtgatagactgagggggtaaaatcaagagaaaaaactctcaggaatcaaggaacataatcctgtggagrrtaatccattacatgagct

SEQ ID NO: 9524 - DNA, 312 bp, Homo sapiens
  misc_feature 189: n=a, g, c or t
tgagaataaagtgtgcaatcgctatgagtttctgaatggaagagtccaatccaccgaactctgtgctgggcatttggccggagvactgacagttggcarggttgacaktggagggccttckggtttgcttcgagaaggacaratacatttkacaaggagtcacttcttggggtcttggctgtgcacgcnscaataagcctggtgtctatgttcgtgtttcaaggtttgtkacttggattgagggagtgatgagaaataattaatkggacgggagacagagtgacgcactgactcacctagaggctgggacgt

SEQ ID NO: 9525 - DNA, 328 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccatwaacagcagctagcttaactgagatcattggtagccaggggttgctacc

SEQ ID NO: 9526 - DNA, 160 bp, Homo sapiens
  misc_feature 118: n=a, g, c or t
aaaaggacttgaattctgatcgggctgcagacgctctgcaccccgcccaagcttctatggtactttggtgtcctctctagcactggcaagtcgccttcctcttcgcccggcgccagdntcccctctctatgatcgccgagttcccggcgccgtctcgttk

SEQ ID NO: 9527 - DNA, 245 bp, Homo sapiens
cagctaaggagagaagacttaaagatattgacagaagcccccagtgaaacagatagtggtacagagcccaatcaatgaacaggttccacctacatccctgaacaactcccaaatagccatttagtgcatcactcttaaatatgaacagaagtatttgctactgttaagaaaggaccaccagacgtgtgaggaaatctaacatgaaaggcagagaccaaaaaaaaaaaaaaaaaaaaaaaaaaaar

SEQ ID NO: 9528 - DNA, 505 bp, Homo sapiens
tacctggagaatatctagggttccagtagtgacagctggacaggaccctaaagataacattctttccataaatttgatacatttgtgtattcatttgacatcgtgtatcaggtgcatctgtgaaagaattagtgatatgttactctgggtttcgacgatggaaacgtgaatgcagtgtggtctctgcttgcaagaggtcacataaatcatcaagacagtatgtagaagtatatgcaaaaaatacctgaaggggctaggtgcagtagctcacattgtaatcccggtactttgggaggccgaggcaggaggatcacttgaggcccggagttcaagaccatcctgggtaatatagcaagatcccatctctaaaaaaataaaaataaaaaaattagccagtgtggtagtgcatgcctatagtcctagctgctcaagaggctgaggcgggaggatccsttgagctccagaatttgaggctgcagtgagctatgatcataccactgcactc

SEQ ID NO: 9529 - DNA, 55 bp, Homo sapiens
aagatgaagtgggtgtgggcgctcttgctgttggcggcgctgggcagcggccgcg

SEQ ID NO: 9530 - DNA, 335 bp, Homo sapiens
acttccggtcggcggcggctcagcaggtgttacctgttactcgcctcggacccgccgggtctctggaaggctgagtggccccccggccttgatattgggaggagtcaccttcatgtttcgtggcagatgaaagcttaaggcctccttaggagttgggtattgacctgtgctctttgaggcggtttttaacctttgatctttcttctggccgttcccccggaccggcctattccaacccagtttctgtttggaaagaggctgtcgcctctggtggagaggaagagaaaagcagccagcgtcgaggaatctctcagggctctcggttgtagcagagc

SEQ ID NO: 9531 - DNA, 453 bp, Homo sapiens
aagaaaaaaaagtggagacaggggtcttgctatgttgcccaggctggtcttgaacttctgggctcaggccatcctccctgcctcagcttcccaaggtgctgaggtcacaggtgtgagccactgagcccggcctgattttgggtgtttattgagtatctgcccagcaccaggcatggcagactctggggacaccgaggaccctgggctgacccaactgtattaaccggagtttgcgctcatggagggagggaggtggaagtgacaccagtgatcagttatcaagtgggtgcattgtcaccatgcatgcttggttgggggcaggagccaaactctgggggagcacccagccaagaaacctgacaaggggtcacgtatgctttgtccaaggaggaggtgaccctgaagggagagctgtcggatgtgcgggatgatggcaggcagccttccagacag

SEQ ID NO: 9532 - DNA, 434 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaaatccaag

SEQ ID NO: 9533 - DNA, 429 bp, Homo sapiens
atgtacctgactggggtcattgtgtaagacttwttattttatcctgaaaccttaaatatcaaacctctgcatctctgatcccttccttgttaaaagttaccacggttggccaggcgcggtggttcatgcctgtaatcccagcactatgggaggccgagacgggcggatcacgaggtcaggagactgagaccatcctggctaacacggtgaaaccccatctctactaaaaatacaaaaaccaaaaaaaattagccaggcgcattggctcgtgtctgtaatcccagcactttgggaggtcgggggggtgggggaggatcacggggtcaggagatcgagaccatcctggccaacatgatgaaaccctatctctactaaaaatacaaaaattagccgggcatggtggtgcacgcctatagtcccagctactcg

SEQ ID NO: 9534 - DNA, 427 bp, Homo sapiens
ttgtctcatagctgtcctttaaaagagatgttattaaattcccattttaggctggggcagtggctgacgcctgtaaccccagtactttgggaggctgaggtgggcggatcactgaggtcgggagttcgagaccagcctggacaacgtggtgaagccccatctctactcaaaaaatacaaaattcctatcagccgggcgtgatggttcatgcctgtaatcccagctactcgggaggctgaggcagaagaattgcttgaacctgggaggcggcacctgcagtgagccgagatcgcgacactgcactccagcctgggcaacatagtgagattctgtctcaaaaataaataaaaataaattcccattttagcaatgaggaaactgggattcagagaagttgagggccgagtgtggtggctgacgcctgtaa

SEQ ID NO: 9535 - DNA, 493 bp, Homo sapiens
gataattgttttattggccttattcttaacttagtgtgatttaggaaaagacaaggacatctagagtcatgttgtaatcacagttctgtgatatttcatgtttttctaactcataaaaatacagtgaggaaatcaacagcttggactgtgggaaaagaagtaaagctgaaactctgatacgcacaggcctgagtatgttgtttacagaatgaaaagcgagttccacataagctgagacttggcttcagtcatgcctgggaatctacaaactcaatgccctctcactggcagaacataaaagctaaagattacccctaatcccgtggcattttaaaatccatggaatgggctttggtgctcagcaattttcacttaaagtcacacactcttttggaggtacaaatgtttcagttcccccagtagtatctctggtaagacttaccagaatgaatattgatgcagatgaagacacgattgttctttccagaagtgg

SEQ ID NO: 9536 - DNA, 348 bp, Homo sapiens
cacaattcagaggctgctgcctgcttaggaggttgtagaaagctctgtaggttctctctgtgtgtcctacaggagtcttcaggccagctccctgtcggatggcttktatgaaaaaatatctcctccccattctggggctcttcatggcctactactactattctgcaaacgaggaattcagaccagagatgctccaatgaaagaaagtgattgtcacaggggccagcaaagggatcggaagagagatggcttatcatctggcgaagatgggagcccatgtsgtggtgacagcgaggtcaaaagaaactctacagaaggkggtatcccactgcctggagcttggagcag

SEQ ID NO: 9537 - DNA, 680 bp, Homo sapiens
attctgcactaatagcggcaaaaagccttctggttcctggggcgacgcgccggcggccgtactattcacttccccagaacgccacagcccaggctttcttcttagtgggcttcccagaccaagaagggaaacctttcatccgaagtactgaggggaggaaggtggcctgaagttatctcagtgccgctttgtttcccaccccagtcggtcagcccttcctcagcgccctttaacccttgcagatcggatggagaaagctgccagcacgttctagggatgggggcagattgaggagcgggagggagtagtctttgtctaactttataccagtaccaaactatgttaatttaatgtagttttataataaatctttaagtcctgtaacttattctcccaagattgttttggcttattctacggcctttgtattkctaggtgaattttggaattagcttgttaaaaaggggggggattttttattgggctcgcattgaatctatagrtctgtttgggaaaaactagtatcttaacaacaagtccttcaatccatgaatatcattctttcccccaccatttatttaagcggtcttwaawtttctcctgggcaatattttgwagattgcacatatatckatatttttaatgcagctgtgcttggatagatgcagtatagagatcag

SEQ ID NO: 9538 - DNA, 535 bp, Homo sapiens
ttgtttggcacattgagtcataagcatttgagtcttccacggtggcactgtcaccatacatgtgacccacagattagatacgagataggtggagtggagaaagcagagtagctgagagagtacttgatgaggctgtttgcttcattggggctcacagtgctaagaaaaaccatttgcagaatcatgggagcagaatgatcatttctcctataatctggggtcccagcctttaggatgtatccctattcaatgtaaaacactaggttttattcagtgaatggcagtctagcatggttatgctagctgaatggtcttatagggaaagattatagcagatatatgtatatatatgtatatctatctatctaactatatatctctatataattggtatagttggctaagtgacagctgaggagccagctggatcagagttcaaaataaggtgacagtctacaaatccctggaagactggagcaacaaaagagggaatcgttatttggacacagtggggaaagtaaaaaaaaaaaaaaag

SEQ ID NO: 9539 - DNA, 239 bp, Homo sapiens
attcatttcatgggtagagaactgaaacccagagaaaatagaaatgccaccacctcggtgccagatctcctagatgcccacctacagatacctttataaatgaatgtgtcaacctttctggcatacgaccagcccacaataagttactgtggggtgcatcatgaacttctctcccataagtcctttgaaacgaatgcacaggaagatacgatggaaacacacctagagactgagggggg

SEQ ID NO: 9540 - DNA, 438 bp, Homo sapiens
gtttttctccacgtctactccaacacagactcatcttcagaccacttcacattaagcaaaaaatagagattgaggaggaaaggcatgctattgatcacatggcctctctgaacttcggtgtttccaacataataaaaagagatggagtctccctgtattgcccaggctggagtgcagtggcaccatctcagctcactgcaagctctgcctcctgggttcacgccattttcctgcctcagcctcccaagtagctgggactacagagtgctggaagccaggtctgagattaatgtgccagcagggccaggctccctccagagggtctaagggagttctctgttcaccgtcacaggtcactaaactacactaaactgtagtccatgggccgaatccagtccaccasctatttttgtaaataaaggtgaattttgtaaataa

SEQ ID NO: 9541 - DNA, 498 bp, Homo sapiens
gaaaggtgctgtgaccgccctccgggttgtggctggtggccttcggtgtttcgggtttggcagttcactcaccaaggtgatctgatggagtgcacttcgcacgattccaagtacttgcctaatgttcatcctttcctctagacggggtagggctggttctggatctttttccgcggtastggagagacgtaggacctgatgatggctactagatgcctggtaaatgatccttcaagaagtgaatgaaccgggggccgtggctcacatgaagtcagcagttcgagagcagcctgaccaatatggtgaaacccgtttctactaaaagtacaaaaatttgttgggcgtggtggcgtgcgactgtagccccaactacttgggaggctgagacagaagaattgcctgaacccgggaggcggaggttgcagtgagtcgagatcgcccccgctgcactccagccagggcgacagagcgagactctctctcaaaaaaaaaaaaaar

SEQ ID NO: 9542 - DNA, 274 bp, Homo sapiens
amcgcccagcgacgccgcckyygccgccgccgccgcgtacctagccaggtccctgaggggcgggcagatgaggcctaggggtgccgatccctagtdtcgactatgcsagatctgattccggagctgccatgattgaagtggtagcagagctcagccggggtcstgtatttttggctggggaggcgctggagtgtgtagtgaccgtcaccaacccccttccccccacggccasttctgsatccagtgaggccctggctgggccagtgcccaaatc

SEQ ID NO: 9543 - DNA, 429 bp, Homo sapiens
ttttttcccttggtttctrsttatcttttaaaaaaaaaaatgaaaaaacactcatgagataactgcatttcacccaacaaaagcagggtatawtgcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagrcttcattgataa

SEQ ID NO: 9544 - DNA, 410 bp, Homo sapiens
tggtgggggcggtgttgctcggggctgcgatgccccttaggttgcgggcaaccagaggcctcactcgtgggcaggaagcaagggcggaccccgagagatgactgattgtgggggtggggaccgtctgctcctcctaatggctggggaccgtgcacgtctgcgcgggccggacctgctcttctcgggaacttgcgcgggaggaggcccggagctgcgccgctttaccctctgctccccggtgcctaaaacgcacacgcatcaaagtcacaggacgagttagaggagaaaggcagagggagatttgaaacacagaggaggtgatgagaagacacagcagaagatatctgaagactggaaagaatgctgcaaccaacaggagaaggaaaagacagaaatgtgttttccatttg

SEQ ID NO: 9545 - DNA, 371 bp, Homo sapiens
arattgaatgttccagataatcrctttcccagtcctgcctgacatctgggtaggrggtttgtccctggaattctgggacactggctggggtttraggagagaagccagtacctacctggctgcaggatgaagctggccagtggcttctwggtttawrtrgctcagccttgggggtggcctggctcagagcgacacgagccctgacacggaggagtcctattcagactggrgccttcgrmacctccggggaagctttgaatccgtcaatagctacwtcgattctdtwctggagctgctgggtagggaagaatggagtctgtmagtacaggtgccgatatggaaaggcaccaatgcccagacctggctacaag

SEQ ID NO: 9546 - DNA, 511 bp, Homo sapiens
agaagtccttagggtgaggcccacaaatgccccagaaatagcatatacattgcgccctaagtccagtctcgcccaggtgtggcaggagcttttacctgctcttyggcagtagccggctgccactcaaccccatgcctgactgagctgtggtagaaggattgaggccagcacagaggaggatcagcaggaaatgtaagggttgtcctcatctaatccgtcagtaccagacagtgaacatctctcccccaggatgctgagggagggtcctggagggaaggatgtggaactacagcctctgctctcaagaagctcagatctgggcagggaacatcacataccagggctgtctgtcgggggggtggagggctgggggagggatagcattaggggaaatacctaatgtaaatgacaagttgatgggtgcagcaaaccaacatggcacatgtatacctatgtaacaaatctgcatgttgtgcacgtgtaccctagaacttaaagtatawttaaaaaa

SEQ ID NO: 9547 - DNA, 297 bp, Homo sapiens
cacacacacacagggtaagagattgtggataaaaagagaaaatttggcgacagggtagatggaagagagtattgagattataggacagatttaaagttgaaaatccgctgcatactcaccagtctgatgaatgaacttcctttaccggccaatgcaccaaaatgataatggttctgatgagtgaaggaacaccagggttcttggtactcatgctggtttagataaaacgacatggacacacatggaggggttttaaggagcggagagttgaataggccaaaaaaaaaaaaaaagggb

SEQ ID NO: 9548 - DNA, 73 bp, Homo sapiens
attttttttgagctggtgactgtggccggctgggagtaggcggcagtgagtttccctgggagggcagcgcgck

SEQ ID NO: 9549 - DNA, 527 bp, Homo sapiens
  misc_feature 262..263,265: n=a, g, c or t
gtttaagaagcgtggactcttgtcctgagtgcaccgaggctttcagcctgcgggacagtggtgcgatttgcattagaggagatggaaggtgaaggtctctgcccccgattgtggatgttcagaaggagaaagcatcatgactcccagccttggccacctggcagcttacctgagatggagaagagataggaaagggagatgccatgtgctggcccagcactccaacaggggcctgacctctaggaacgggacactggavsmnnkntagacatttgaacaaatcaagtcatccagatccacggtcagctcctgccccgacttggccttcctcctgctgggctggccacggacctcgggaacctgccctggctgtggggacctgcaggtactggtcagcgctgctgttctgctggtcactgctggatgctgccgacacggagtcagattccgtgaggatggctcgaacctgggcttcctctggcttcagagggggctgtgggtattggaaattccgggatcgtggcttt

SEQ ID NO: 9550 - DNA, 487 bp, Homo sapiens
ccaaggcatcctggcctatgtaatgggttgttctgcctgccagcagcaggaacagcagcaggcacctttagaagaacccttgaaagaagtgtgggcagtgaagcactcccccagctactttgaacaaataaaatttaattaaaaatacggacagccttcagccactgctgccaaacttggaaggacatcagttgttctctttgacccttgacaaaatgggaactttacaaagggggaaaaattactttttgtggctgggcacagtggcttactcctataatcccagcactttgggaggcagaggcgggaagatcacttaaagccagcagtttgagaccagcctggggaacaaagcgagaccctgtatctacaaaaaagtttaaaaattagccaggcatggcatgtgcctatagtcagagctagtcagggggctgaggtgggaggatcacttgagcccagaggttgagggtgcagtgagcatgatcat

SEQ ID NO: 9551 - DNA, 401 bp, Homo sapiens
  misc_feature 231,350: n=a, g, c or t
atgctcggcgcgtcggcgaggtttccgcagctgagggggcagctccgcgwcggcgtccggggtctccagtagggctgacgctccggtgctcgcacaatcccccgcctcggctggcaacgggcgtccctccactccccgagtccccggcagccgccgcyaccccagcgcgccccgatctggccccctgccccgcgaagatggctgccgtacgccgggcccgcagttattgcngctgcctggtgcgcttctccgaccgagaactctgctaagctccgctgcagagacaggcaggagtagacacccggacacccagcacccctcctccggggggcggtgcagaagggggcacnragagcccctcgagcgcasaggccgccccgccagcatgatgtgtgctttas

SEQ ID NO: 9552 - DNA, 355 bp, Homo sapiens
  misc_feature 2,111: n=a, g, c or t
angttatcactaggcgccgaggaggggagcgggaagcscagtgccagcgccacagcccttcaatcattttggttgctatccagcttctccacatcaagtccaacttcaganaccccaagcctgtagagaaaagttgacctgtgctgactctggtgatgagtctccgggaccattatggcagtcaagtggacgggtgggcattcttctcctgtcctctgcctgaatgcaagtaaagmmgggctgctggcttctggagcagagggcggagatctcacggcttggggtgaagatggaactccattaggacacacgcggttccaaggggctgatgatgttaccagtgtcttattttctc

SEQ ID NO: 9553 - DNA, 409 bp, Homo sapiens
aattaaaaattaaaaactagcccagcgcagtggctcacgcctgtaatcctagcactttgggaggccaaggcgggcggatcacctgaggttgggagttcgagaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatatattaaaaaaaaaaaaaaaa

SEQ ID NO: 9554 - DNA, 227 bp, Homo sapiens
acaccggtacaaaaagctccagggtattatggtatgaaatgctgcctgcagaactttatggattcagggactaaagtcaaagcctgcttggtctacggcctcagaactctgacccatgggcacagtggtagaagtgcaacaagattaaaatcgatatgactcctgactctatggtttctaattctataatgctagtactctatactattaggcctttaaagtaaaaa

SEQ ID NO: 9555 - DNA, 380 bp, Homo sapiens
gaaaatactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaaga

SEQ ID NO: 9556 - DNA, 405 bp, Homo sapiens
catttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaa

SEQ ID NO: 9557 - DNA, 372 bp, Homo sapiens
ttgattactctccctatcctctactcccagcctcctttttgtaggaagtaatttttattcagcagataaatgtatagtgtgtggctgggtgcgatggctcacgcttgtgatctcaacactttgggagtccagggcgggtggatcacttgaggtcaggaattcgagaccagcctgggcaacatgctgaaaccctgtctctattgaaaatgcaaaaattagcctggagtggtggtgcacacctataatctcagctattctggaggctgaggtagaaaaatcgcttgaacctgggaagcagaggttgcagcgagcctagatcatgccactgcactcccacctgggtgacagagcaagaccccgtctggaaaaaaa

SEQ ID NO: 9558 - DNA, 281 bp, Homo sapiens
aaaactgcccagacggttggacaggacgtagacacacagaagaaaagaagacaaagaacgggtaggaaaattaaaaaggtaggaggctgaggcgggtggatcacctgaggtcaggagcttgagaccagcctgaccaacatggtgaaaccaaatctctaccaaaaatacaaaaattagccaggcgtagtggtgcatgcctgtaatcccagctacttgggaggctgaggcaggagaatcgcttgaatctgggaggcagaggttgcagtgagccgagatcacac

SEQ ID NO: 9559 - DNA, 488 bp, Homo sapiens
catagtggtttttaaaatgtgatatttataacaagaaatcagaattggtatttagatgatttcctttaggtttaatcatgtttgttcctcctcatttatctggtagttgcacatatgttggtggcatcaaccctcagatgggtctttgcaatcagtggaagcccattaatcatgatgcttgccccagattttgaaaatttccagctctacctgccaatttgaaaattaccctgtggagtattggttgaatctacctttcatgttcaccatcttcatttatgtcgttcacatcctgaattgttaaaagaggtatcattgttaaatgttgctaggtgaacaaggaatgtacttcttttcatccgtaattgttgctatttcatgcattattatttaactcattgaatttttaatgtttacgaaataagttttagtgcaactgacttcctgacttaagatttatgtgtagggctggacacagtggctcacgc

SEQ ID NO: 9560 - DNA, 306 bp, Homo sapiens
gtagaggcagaaggcaaatcttgatgtacttgagttctctcagttgacatcctctaaaattacgtttcatttctgtgtttgtgtgattgctcagattttttctgttactagggcttagttactttgtagagaagttttttcaaggggtagttaacattaaaatagtttgttagtcaccataattttttggatattttgagaaataactcacattgcatatttattttacagctatccaggcagaattgctgaaagtcaaacaaaagataaaggcacagaaagataaagagaaggcagtatatgcaa

SEQ ID NO: 9561 - DNA, 369 bp, Homo sapiens
ttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagabgcacgatggaattgkgttttgcgttttttggtaaaaggrgcaaagcgaggacctggagataaacgct

SEQ ID NO: 9562 - DNA, 274 bp, Homo sapiens
catttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggatttt

SEQ ID NO: 9563 - DNA, 363 bp, Homo sapiens
  misc_feature 137,139,151..153: n=a, g, c or t
aacatccaggataattctcctttccaagcccgggagttccggggcaggcgaaaaaggggggatgggagacccacagtccctttaaccctccccccttggcytgccaaccttttccgaacccccatgtcacasaacdncntsatcatggmvnnntcsactgggttcggcgctgaggatgccaaactccatttcacaaggaacatgtcaacagctgggcttggggtttgaggaacagagccgctgcgattggaacagagcccggccaccctgttccaccactgtccactccgtagctcccagcctgccgccgsgcgktgcccgaacacgagagggcacctcctcccagatccggggcgcagaagc

SEQ ID NO: 9564 - DNA, 361 bp, Homo sapiens
ttggggttttgcacattgtcctgggagcaatgggaaattattgaggcatttttggcagaggcaggacagatcagttctgtctttttagaaggcttctgtgacagctgcatggagaatggatggsagggggctctkgtgagttggagaaaatggtagtgtgaaactgcgtggtggcagtgaagctggggagaagcagccagaacttagrggtcaaacaakaggattttgcactgaattggcagtgaggggttgggagaaagaggtcaagcattcattcatttaccagtcacaaaacagctcctgggtgcccaccacacgccakwgacagtcaggagctagywaagtcccatcctcctgaagt

SEQ ID NO: 9565 - DNA, 395 bp, Homo sapiens
  misc_feature 16: n=a, g, c or t
actcgcttaccggagncttcagtccccggcggcgcggcgacastagggttcacggccactggggcagaggagccgcgagaagatgtgggtttttggttacgggtcctgatctggaaggtggatttcccctatcaggacaagctggtcggatacatcaccaactacagcaggcgcttctggcagggcagcacggaccaccgcggggtccccggcaagcctggaagagttgtgactcttgttgaagatcctgcgggatgtgtatggggtgttgcttacagattgccagtaggaaaggaagaagaagtaaaagcataccttgacttcagagaaaaaggaggctacagaaccacaacagtcattttttatccaaaagatccacaacaaaaccattcagt

SEQ ID NO: 9566 - DNA, 444 bp, Homo sapiens
catcatttaccctaggtaagaactttgatcactgcttactaggtaaagaatgtttgtactgttccaaaacccaggcttctttattccttkaccactatccatgtgagcattgacaaatcatggcttagaggtgctcactgactcgctaagacgactttggccctgttgatgactggtgctgtgctccagccttatcggttaggrdacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggcagtgccggaggaggcatgctcctctttctatgccacagaacaaacactactctagcagagcctttcttgcactttaaagtgagattaat

SEQ ID NO: 9567 - DNA, 464 bp, Homo sapiens
gttatctawaggaactgrttcacaactttctcagagatggatakkgataactaaacttcatttcagtttactttgttatgccttaatattctgkgtchtttgcaadttaaatkgtcagtcacttcttcaaaaccttacagtccttcctaagttactcktcatgagaktkcatccatttactaatactgddttttggtggactaggcttgcctatgtgcttatgtgtagctttttactttttatggtgctgattaatggtgatcaaggtaggaaaagttgctgttctattttctgaactctttckatactttaagatactckatttttaaaacactatctgcaaactcaggacactttaacagggcagaatactctaaaaacttgataaaattaaatatagatttaatttatgaaccttccatcatgatgkttgtgtattgcttckttttggatctcattctcac

SEQ ID NO: 9568 - DNA, 485 bp, Homo sapiens
  misc_feature 331: n=a, g, c or t
aaggtcttggaagtttgaaattggcggttacgcaggatgctgcgtttgaggacgcgactgttaatctaggatccctgaggaggtcgccagggcgctgtcccctgctctcggccacctgcaaggaggaaggcagccaggctgctctgcctggtcttctttctctctcatgtgggctaaggaagaagtacttgttacctggggaagcccagtggtcctctgctacagctgaggcagcgaatgttttgagcttgacttcaacctaccttgattactctatctccgggctgactgccctgcaaggagttggtgacagtcattgagactgtctganaggacactttaaaataaattatagacgagatacttaaacaggcacttcaccaaaaaggaaatccagatgaccaacaaatgtgtgaaagttgtcaacctcgttcataatcagaaaatatgaaaaataaagtcacagtgagaaagaataacactca

SEQ ID NO: 9569 - DNA, 332 bp, Homo sapiens
atactctttccctcctccagctttgtgctgatgaacatggtcaccttgaaaggtgtgttgaatatggcagagcagaaaatgcaaggagcttcttctctggatcaccacttgaagaagagccacttgctcctcaggaaccctattttggactgacgttgcaagaaagctcaagtagcctatggrgaggatgcaaggcttccagctgatgccctcagccaggctcagtagcagccagaactagcctaccaacgaacctgctgatcatgtgcataagccaccttgaacgtcgatcctcctgcctggtggagccatcccagctgatgccacatgaa

SEQ ID NO: 9570 - DNA, 428 bp, Homo sapiens
  misc_feature 166,336: n=a, g, c or t
aattcctcattaagcgaggtttctatgaacagctgagttccgtccttaagatgaaggctggcaactaacagctttgatggcagagaggattggaagggagtgagaaatccaccttcactgtattttccaaatggctagccagtcatcctaacaacatgtattgaanggggtcttgctcggtcatccaggctggagaggagagcagttgcaacatcaggactcactgcaacgtcaacaccatctgtggttacaaaattcttttttattttgtagattgtagcaaaatttaagccatttcaggcaaaaaaaaaaaactgrrtttattttgaaaaatanwwagctgtatgycattgdattgaatacatatatccatttcyccaccyctkgdayctttccccaatttgaaaatctttgckgakgtataaaca

SEQ ID NO: 9571 - DNA, 501 bp, Homo sapiens
  misc_feature 480: n=a, g, c or t
aacatgtagatgttgtwattcttgagcctttgtctccataatggggtaagatgtcagahaagagtcagaaagcccaggtgatagaataagtgccaagaacatatacaccatggaatactgtgcagccataaaaaggaatgagttcatgtcctttgcagggacatggatgaagctggaaaccatcattctcagcaaactaacacagcaacagaaaaccaaacaccgcatgttctcactcataagtgggagttgaacaatgagaacacatggacacagattggtaaaacttcagcggttggatgacaccctcttttggtgatgccgtgggggaacgcaacatgattcaaccccaatgaaagagaagttgcaataaccgctaagactgcagatgcatttgactcagcaaacccccttcaagaaatgcatatgaaaaaaactcatgtttcaggttattcattacaacattgtttgtaatagcanaatgtggattagaaatagtcc

SEQ ID NO: 9572 - DNA, 511 bp, Homo sapiens
  misc_feature 278: n=a, g, c or t
aatacaaaggatcaaggttggggagcagggaggaggtaagggaggaggtggtagtaaagaaacctttagactgaaaaatgtaaagatacaatatgaaaggagaaaaaaaacaacaaaagaacccaccatggaagtttcaacccaccaccaccacatggtgccaaaamcttcaaaatggaacatttcttatattggcacatatttttgtgagaacaaacatatggttgtgagcatattcttaccttcattgtgatctgcatatttcctctctgcagganaatttaaatgcactgttgacatcgttttatagtcacataagaagaaagcaggcaaagaaatgttatgttatgattggacttattcatgagataccacagtctctaatatatgaagtttttcatatttacactactggtgaatctctagttgtatacctgcctctgtggtctcattgttggtccctaggatagcttataaatraaaacagatgatactgtctactggccagaac

SEQ ID NO: 9573 - DNA, 76 bp, Homo sapiens
aaaagatgagttcagcccctttcctttctctctcgcacacatatttgctcgcctttttgtctgccaacatgggata

SEQ ID NO: 9574 - DNA, 454 bp, Homo sapiens
cagtaaggaaatctagctaagcaagcaacatgtacaaataaaagattattataattggaccaaagttaagtttaaatccattcacatgtatataattaagatatataggaattataattacagaaaagaatgttacaaaccttcacaaagtaaaaatatttttatatcagatagattcttctgtttcaatccataaaaccagggtttggatcattttaaaaaaacaaacaaaaataatttattggaatcattagggaggacctgatagaataaaatgacaagctgaccaaataggccttagaagggagaggtgcctgggcagttacaaggacctaggtagcaggggtgacttggccacagtcattttctttacttgatttaaggaggtaaatttacagtgagagagttgcacttatttagtttgcataccgtactcaactcttagctagcatag

SEQ ID NO: 9575 - DNA, 179 bp, Homo sapiens
aatcagttcccaagttctaggcggaagaggcccaagagacaccactttctcgctttcagacgtgtctacataagaccacaaaagaaaccgaggcaaaaacaaaaaaaaaaaaaaaaaaaaaaaaaaaaaaaaaaaaaaaaaaaaaaaaaaaaaaaaaaaaaaaaaaaaaaaaaaaaaam

SEQ ID NO: 9576 - DNA, 318 bp, Homo sapiens
  misc_feature 177: n=a, g, c or t
ctccttacctgcgtcctcgggggcgtgcgcaccaccccccctcccgcctaggaggggggagggccccctcttggccaccgccttcgcggcctttaaactcccctggagactgcggctactgccaccgccttgcctccactgcctcttcgcgcagacacagatgcggacggtgggtgngaaaaagggcagacgctactcccagcgaaccgccgctgccgctcccgaggcctcaccaaaatggccgccgccgtctcggccgccaccaccaccactaccaccaccactcgctcggaatcgctatcgccggcgcgsccgtct

SEQ ID NO: 9577 - DNA, 264 bp, Homo sapiens
  misc_feature 114: n=a, g, c or t
ctcagcatctggagtagctgggattacaggcacatgccaccacgtctggataatttttgtatttttagtagagacggggtttcaccatgctggtcaagctggtctccaactccnhrcctcaagtcatctgcccgtgtcggtctccggaagtgctgggattacaggcctgagccaccacactccacccctaatcaccccttctaataaagacacagctcatgtaggatgagagctaaaaaaaaaaaaaaaaaaaaaaaaaaaaaa

SEQ ID NO: 9578 - DNA, 448 bp, Homo sapiens
atttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttcacttaaagtgctaacatcagaatcaaacttaaagcttccactatttatgtctttgagaagtatgtagtacctcggtattaacagacctgctgtgatgcagttacactttcacgtatttttgaagtatgtcaagctacacg

SEQ ID NO: 9579 - DNA, 455 bp, Homo sapiens
atcagcctatttctacatactttatatctgttttggattatttggattccagttgtaagcctccatttagaaagggagcatgagaagcactgaaaagtaaggcactgtgatctacacggaaaccatatattgggctcacagctactgaatgagaccgactggtgggagacagtttagtgaacctggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctac

SEQ ID NO: 9580 - DNA, 474 bp, Homo sapiens
tgactagaacatggttgtaggaagacttcaacagcattaacaaatggctttttaatgaatttaactttaaataaatagtttctaaaatgatttgctcgaagcacattattgaggcactggaggaaaataaggttgtgggttcacatggctgctgccggtcaacttcacacttttgtgtgaattacaaataagcttcccttcctgcaggcagatgcaactgcacaccaagtcttacagcttagtaagcagtgtatacctgccccagtcttcctcttgggaatagatttggtgtgagataaaacctgtacgcatttatgggatgtctctgagtgttcaaaaatgttttgctgatgagtaattattttctagccttgagcaaatattgacaattttcaaagtaattctggattactacaattbaaactgtataattctcctccaagactaaggatgttctctgacagcagctgcatc

SEQ ID NO: 9581 - DNA, 468 bp, Homo sapiens
  misc_feature 233,376..377: n=a, g, c or t
gatgggatgactccaggaagtctatgggggagtaccacaaaatgtggaggaagatggcactagacacctgaggagggaccacatgacctccatccaggtagaagaccttccctcggaacacccggtcatcagagagtgttcctgatttcgcttttgcagacsaagaggtagtccagcttggaagaacatccagcgccttccctgaaattcatctgttctccactttccactcntgactgtcataacaaaggacagttgtaggtggtgcccagtgacccaactcagtcagctttatctattggcaataaggaacattcaaatgattcccttctcgctattttgaaatgcacagtagatgagtgtatgctgcagccwnnctgctgatctatcgaacgctagtgtgcagctgagggtgagaaccgccgggtggagattggaggagacctgagtctttaataaccactgagc

SEQ ID NO: 9582 - DNA, 426 bp, Homo sapiens
  misc_feature 280: n=a, g, c or t
atttgttgaactaccatttatttagtaggtctttttatttttcatttatttatttatttttgagacggagtcttgctgtgtcgctcaggttggagtgcagtggcgtgatctcggctcactgcagactccgcctcctgggttcaagcaattctcctgtctcagscccctgagtagctgggattacaggcgcgtgccaccatgcccagctaatttttttttgtatttttagtagatacggggtttcaccatgttggccaggatggtctcgatctcttgaccntgtgatccacccacctcgdcctcccaaagtgctgggattacaggcgtgacaccgggccccgcctagtaggtctttttattaagattataacccaggcatccactggggtcccccaggcctttgaaatcaagataagacagtgtcat

SEQ ID NO: 9583 - DNA, 141 bp, Homo sapiens
aaccttctgggaatgcagcccgcaaaggccccatggaatatctgcaataccctgaagabcatgatgttcagcagcaacaaggaagtgccacaagaragcataaccattgatcattgacaaaatgacttggctctatctgga

SEQ ID NO: 9584 - DNA, 192 bp, Homo sapiens
actcaagactgctctgcctacagagaagccattcttttagtttcttctttkkaaaaaaattagagacagggtctctctatgttggccagtgtagtcttgaactcctggcctcaaccaatcctcccgccttggcctcccaaagtgctgggaggtatgaggccaccatacctgacattctttggaatcctttww

SEQ ID NO: 9585 - DNA, 359 bp, Homo sapiens
gccattcttgagggagtaaggtggtatcatattgtggttttaatttgcakskscctaatcattagtcatgttgagtactttwwcatgtttttrgccatcttctagacattggcttaggcaaagatttcatgaccaagaacccaaaagcaaatgcaacmaaaamcaaagataaataggtgagacttaattaaactaaagagcttttgcatggcaaaaggaatagtcagcagagtaaacagacaacccacagagtggaagaaaatcttcacaatccatacatccgtcaaaggactaatatccagaatctacaaggaacgcaaacaaattagcaagaaaaacaaacaarcaaacaaacagta

SEQ ID NO: 9586 - DNA, 115 bp, Homo sapiens
aatttttataaacttttgttctttcttgtaactttttatcagtcagctattccaatgaagcaaaatctgataatatattgcttttatactaaaaaaaaaaaaaaaaaaaaaaaaa

SEQ ID NO: 9587 - DNA, 138 bp, Homo sapiens
agggatgggtccctgagacttggcgaagtgggagccctgtgtgatcgtgcgtcagagtcggggctgagaccagccccggssbgggtagttaccgggrcgtctccggagccgggattcgcggagggtccaccagcaggr

SEQ ID NO: 9588 - DNA, 63 bp, Homo sapiens
agtgagcggagatcgcgccactgcactccagcctaggcgacagagggagactccgtctcaaab

SEQ ID NO: 9589 - DNA, 72 bp, Homo sapiens
attccttttagttattaggtattcgtagtatggtccagcaatttgacccctgatctctgcttttttttttty

SEQ ID NO: 9590 - DNA, 73 bp, Homo sapiens
attttccaaagccatggtgaaacatctctgtgctaatttcttttgttttgtttcctaattttttttttttttk

SEQ ID NO: 9591 - DNA, 135 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaaa

SEQ ID NO: 9592 - DNA, 78 bp, Homo sapiens
tttcctttatgccattttttgtttttgttatttgcaaaagatcttgtattcctttttttttttttttttttttttttt

SEQ ID NO: 9593 - DNA, 420 bp, Homo sapiens
aacgagcgacggcctgacgtcggcggagggaagccggcccaggctcggtgaggaggcaaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggccgaggagaggccctgggctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactam

SEQ ID NO: 9594 - DNA, 331 bp, Homo sapiens
  misc_feature 294..295: n=a, g, c or t
taataccaatctcttgacactgaaaaatactgttaagttttagactcaaatctcattcatatgtttaaagttagaaatctaaacattatgaactgtttgacatttaatgaaactggcttttaatatacatatcttataaaactaatgaaacctcacttcatcttgtaaaagaagatttttttttaagattctttttgctttacggacttacctttggctggatcacccagagtggtaacagcactgctgccaacacggagtccacactgacataccaattttgcctttaaacannbagattactttgcttcagtctttgaagcaatgaaat

SEQ ID NO: 9595 - DNA, 138 bp, Homo sapiens
aaaactgtgctgggtgtgcctatcagacaccaggtcttgcaaaaccatgattaaaagtctcattttcgctgttaaaaaaaaaaaaaaaaaaaaaaaaaaaaaaaaaaaaaaaaaaaaaaaaaaaaaaaaaaaaaaaav

SEQ ID NO: 9596 - DNA, 194 bp, Homo sapiens
aatttttataaacttttgttctttcttgtaactttttatcagtcagctattccaatgaagcaaaatctgataatatattgcttttatactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaam

SEQ ID NO: 9597 - DNA, 456 bp, Homo sapiens
cgtaggtttaagtgttcagatggacatgtgaattgctcccagaaggattcgcatagatccctggtatatacactgggaaatatgcattcagttaaccttaatgagaagggggacagatgatacttacttgttatagttttgagtactaccaaggtcatgtttttagggttttctttggtgcttttctaaatacacaatttaatgttaactttatggatgctgtggtttctcacccagataaaatattatgctgccatacactttgactccaagcatctccttcctccatcctcttccaagtgcaccacatcagtttgttcccaccctgtagtgtaggagctcagcatagtacatgtggctctgcagagcsggatatctactttgtatcataacattcaaaccagaccactttgtgaataattgaagcaagaactttgttactggacatctggattt

SEQ ID NO: 9598 - DNA, 403 bp, Homo sapiens
  misc_feature 287: n=a, g, c or t
caaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctamwttctaaagactgaacaaagtgctagctgcaaattatcttgaaatcatttggctcttttctagcatgtgtgtaatcatgttttcttcandttcctgaatgaccatggtagcattagtgtttagaaattgttcaggggaaaattgagctattttccatagtggctagcaattgctacacatccttagatactcctctctcccatag

SEQ ID NO: 9599 - DNA, 480 bp, Homo sapiens
taaaatatgctacaagaatggaattatccaataagaaaaaaattttttgttaaggaaattaacaaagcgataagggtaaaagtgaaagttgatgatgttatagtatttttattcaaatgtttgtagacggctcttcttgagattgtttatagtgaccactacttcaatcatcctaaaacctagctttctatgcatctgaacaatagagaggtccccatttgccacgttctctaagtctgtacagatcaacctaggtaagacccaatgggtattaatttacatcaccctcaagtggcttaaggaacagacatcaccatttggcagggtgtggtggctcacacctgtcatcctttcactttggaggccgaggcgggcggatggcctgacctcaggagtttgagaccagtctggccaacatggcaaaatccagtctgtactaaaaatacaaaaaaattagccaggtgtgtaggtgcgtggctg

SEQ ID NO: 9600 - DNA, 402 bp, Homo sapiens
atataaatcaaagctgttacacgggtctgccattccaaacaagtcaggaaagcctgcacaggactggataaataattaagaacagagtgttctgaacatcaacacaaagtggaagaaccttaagctgaaggtacagtatattatttacactgaaggggcttgtgtgtggacaagaaagcgctgacagctcaaatgtatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacac

SEQ ID NO: 9601 - DNA, 423 bp, Homo sapiens
atccggaggatgtggggacgcggastgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggaggaatccgacacgtgacggtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcggg

SEQ ID NO: 9602 - DNA, 114 bp, Homo sapiens
tttaaattttccagattttatagcttgcctgtatggatgctcstcaatttatgatggggttacatcccaataaacttattttatttgcaaaaaaaaaaaaaaaaaaaaaaaaar

SEQ ID NO: 9603 - DNA, 366 bp, Homo sapiens
acatcaaccagtctaaggttgctcccaccagactaggaggactggagagtagggttggggtcaaagggtagcctcctgcaggtcgcctcctcctgtggctttcccggacgtcgcgctgggacttcctgccgacaccgcacttcttcccagactcccacctgcgccgctggggccttgggtccagtcttgctctgccacccaaccctggagtgcaatggcgcaatcttggctcactgcaacctctgcttcccaagttgaagtgattctcctacctcagcctcccgagtagctgggattacaggcatgtgccaccacacctggctgatctttcttttagtagagatggggtttcaccatgttgtccag

SEQ ID NO: 9604 - DNA, 78 bp, Homo sapiens; identical to SEQ ID NO: 9592

SEQ ID NO: 9605 - DNA, 423 bp, Homo sapiens
  misc_feature 12: n=a, g, c or t
agagcggcgcgnatggatccaacatggcggcgccgagcctgagccgagagaagagacctgggaaattaagtttcttgcggagtacggtggggattgcagctgctgagcagggattctggaaagcattgcgtacctgagcccccagcatggcsgggcctaaagcggcgggcaagccaggtgtggccagaagagcatggtgagcaggaacatgggctgtacagcctgcaccgcatgtttgacatcgtgggcactcatcacacacagagatgtgcgcgtgctttctttcctctttgttgatgtcattgatgaccacgagcgtggactcatccgaaatggacgtgacttcttattggcactggagcgccagggccgctgtgatgaaagtaactttcgccargtgctgcagctgctgcgcatcatcas

SEQ ID NO: 9606 - DNA, 435 bp, Homo sapiens
  misc_feature 348: n=a, g, c or t
aacacttaatggagacacaatggagagccattttctcttcaatttcttagtccctctgccctctgtaaatgtgttgagtgatatagctatcagatgtattgaaggcaaagttctcgcagaggtctctgttccagctctgtaaaggtcacaggaatcgtgaaggagctgagaaatcttcctctccggcccactgtctgtggcccattgtcattgtttcctcatgaaacattgcagagtttgaatcctcagtaactctcattvactggattagaggtgatggccacagcaaatgggagagcaaaatgttggcctacagagaatgacacaattttattcgcctttggtghnagttgccatagtgctgtatttgaaaatcgatgctttagccaaaagctgaatgaccamcgtttccgtagtttccactgttttgtctgs

SEQ ID NO: 9607 - DNA, 423 bp, Homo sapiens
  misc_feature 298,301..302: n=a, g, c or t
aggaaaagaatatccttgctgtgccaagawagahaagaccatggatctactagttgcagatttcagcagtaatgccahgggggcaagaagtgaccagcagaacaattaggccatggcaacagaagccaactacaacccatgttccaatctatgacctccctctcctgctggtacaaggatatgggcaagagctgataatcaactgactaatgaggattgacttctacaattgatgagcatggaattggatgtgcctaaatcaacagaagagggattttgatgtcatcacactgtagcnaynntagacagaacgctcaaaggtgtcaatgggcagaatttgtagatgacatwcagcatccaatggattactcctattcagtattccttagagcaaaggatgcaatgtcaagcaagttgtgatac

SEQ ID NO: 9608 - DNA, 163 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaaaaaaaaaaaaaaaaaaaaaaaaaaaaaaaaaaaaaaaaaaad

SEQ ID NO: 9609 - DNA, 397 bp, Homo sapiens
  misc_feature 325: n=a, g, c or t
tgagtctctgtctctctctgtctcctcacagtctgttactacttaatacagtgcttattggcctgagattggacattatttaaaagcaatttggagagttttctccatttcaggcaagaaaacatgcactatttttctgatatggcatgggacatcgaaaaatagttttgaacaaaattttgaaatttttggcccaaagaaagcaaataccccctgcaacaaacaagatgtgtcacaataagtcatgatttacaatccctttcaagactgcctgttgcccttagcaatccctaaagcaaaaacaaacaawwabaatcktkksaknatatcttcatgaaactgtctgggatgtgacaaaactttgagaaacagttttgtgataatggttttgcacttt

SEQ ID NO: 9610 - DNA, 502 bp, Homo sapiens
  misc_feature 290: n=a, g, c or t
atttttggaagtggcccaccaccatcttgggagctctgggagcaaggaccacctggtaacaataggccaaatactgtgctgataagttattgctcaatgttcagactcttgcttcaagatcaactgaagtgctttcttgaaagcctgccctgaatcctcatctattgatggagatggtgtcatcttgccttgattgtatccagaagcttcatccccaagataaaggatggacatctctccgatgaccagcttcttttgctcgactctagagaaggttgctttctgcattnbrgcaactgccctctgtctacatgattagactcgttggttgcagtgctttctggagtaatgaagggatccagtgcacagggtttaacttactgggcacaatctctaagccaactctgcctgaatgggtcccctgttttttctcttctgctcttgttgaaccatatctctgttccttgtgctcctgggaatttcttgctctgtaagggtaaat

SEQ ID NO: 9611 - DNA, 431 bp, Homo sapiens
ctacttaatgtcttttatttgaaattacattgtaatacagccctctcttgaatgttagaattgggttttgatgctttgtcaaaaaggggagcagatgaccaccagaggctttgggtagctaaggcaccataaaaagcaggttaactatctatgagtacaggaagtggattattaatctgattattctggttgttactattaccaggaatactacagggtgttgtaattcttagcatattcatttattctaccacggaaaagcaatgtgaatcaaattttaaaatttactattttagaacaaagtgctaaaggagtatttcctaattgatatttttgtgcctaataaagggggttttcctgtaagtcgtattaataattctctaaggggacccatgtcattccccaataaagcaacaaaaacaaaaaaccaa

SEQ ID NO: 9612 - DNA, 420 bp, Homo sapiens
attcttgaagtcggtgagaccgagaaccctccaattgcagacacaatattacatgagatgccgtttgaagctttcacctggagttggcacatctctgaaactccaaacacataacaataatagactcctgacgagatgaggaagtgtgcactcaagtaacagtgctgtctgaaagacttagagcaacaaggtggatctgacaagcagttgaccatgaacaaagaagttttgcaacctccttggacccctgatgacagccagatgtctgtggcctccagtcacctccagaccttcaccccctgcatggtccctcttcctctaatatgaaagaagcctaaaaaaatctatcaatctaagttggttctggctgggcacggtggctcatgcccgtaatcccatcactttgggaggctaaggcag

SEQ ID NO: 9613 - DNA, 459 bp, Homo sapiens
  misc_feature 191..192: n=a, g, c or t
cactgacatgttctcattcaaactatgttataagagcaaggagaaagaagtaagaaaaatttgctatcatgtagaaaattctggggaacctcaaataactcactttatatttagcaggagtttatgcttcagagatcatctgtccctgcaatagacattttatcatggtaagggtgtggtcagcaatagannvctatgatctcagcagaagtccctctaccaccccatagcttagtaattttcttaccaacagctagctgaggtagtgtgcatcccagacgctccgcaattggggaaaggtcttttagcttgttttgctgttttctcccttcttcacttacaattctttctttcaaccactggtagcactggggaaaagcataacattgaaatgttaatgtctggtaaagatctgatgtcaaagaatggtaattcaataaaatatgtgaacctcaaaaa

SEQ ID NO: 9614 - DNA, 478 bp, Homo sapiens
aaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagagagaaataacaaagaaaatattcagaaaacatagtagaggtgagctgacatcatcaaaccttgaagttcttgcacttaagttttccactgtgtcctgaatcaggtgatattggggaatcattaaccaatggcaacaggaatccaaggataaagtgatttccctcctgttaactcatctgccttttgctgaagccag

SEQ ID NO: 9615 - DNA, 336 bp, Homo sapiens
tgcactatagaacaactggacctaatagatatttacagaacatttcatccaacagctgcagaatacatattcttctcctctgcacatggattattctcaaagatagaccatgtgttaggtaacaaaacaagtcataaaatatccaaaaattggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatatac

SEQ ID NO: 9616 - DNA, 386 bp, Homo sapiens
agaaatgtaattctgaggccaagccaagggcagagttcccagaatttgcttggggcactggcccgcagttctcatttagagagagtggcctgatgtggattctaaagacaggagggtccttggargtcaacgggacgbacatccctccttgtactgtattgttattctttgaaggaggttgctgacctgagcaactggattagggacagttgggagggcctcggactcaagtaaattaagttcctgagttctgtgatggtagggttcagtcctaggtgagttgggaagtagaaaaactttgttttcttttttaaattcctcattttgcacccccaaactcctttttactcagataaaatatctttccagctaaaaaaaaaaaaaaa

SEQ ID NO: 9617 - DNA, 86 bp, Homo sapiens
tagtagagacggggtttctccacgttggtcaggctggtcttgaactcctgacctcagttgatccgcctgccttggcctcccaaagt

SEQ ID NO: 9618 - DNA, 117 bp, Homo sapiens
taactcctagtgtatccccacccccaccccattgtctaatctgtagaagctaataaataatcatccctccttgcctagcaaaaaaaaaaaaaaaaaaaaaaaaaaaaaaaaaaaaaa

SEQ ID NO: 9619 - DNA, 357 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaaccccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcag

SEQ ID NO: 9620 - DNA, 422 bp, Homo sapiens
  misc_feature 286: n=a, g, c or t
amtgttcaaaaaaggawgscaatgaagaamcatttacagaggactgtgggtaaagcaaagtcttcaagggaagataacaaaggatgaaacaatggtgttgtgtgacttcctagtgtgaatcatggcaatacagtgaaagacagtgatttactgcttttgagggcgtgcatgtatatgattaacggatggaagtgcaggactccaagatttacttccttccctttccagcggaattacctgagacgagtaaaatctactggtggagtcactccattattcttatvvngtggagatctagatcttgatttgaaagtttctgagaaaatcttcagctcagacttgagggtcaactttaccagctgaagtgactacatcctgcctgctttcagctccagtggaaaatgcattaatcccagagtctc

SEQ ID NO: 9621 - DNA, 80 bp, Homo sapiens
agtgagcggagatcgcgccactgcactccagcctaggcgacagagggagactccgtctcaaaaaaaaaaaaaaaaaaaar

SEQ ID NO: 9622 - DNA, 511 bp, Homo sapiens
ggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatcagccacttcgttagaraccgtattcttta

SEQ ID NO: 9623 - DNA, 389 bp, Homo sapiens
  misc_feature 237,331,335..336: n=a, g, c or t
acagtgactcgtccccaaacattagtcctaacggtcaaccaactgccaactcaattcaactcgtgttctccagcgattctgctggaagtgaagacccagaaaccacccggcctgcacagggcttgtcctctagtccttaggcgtttgctttctcaatctctgtacccatatttccagctgtccttgggtttgaggccctggaggttttcctgtggcagcccgaggtccatgtcactntaaggaggggctcgagggaggcttttcaaggccagagaaggacgagggtaaaaggacaacctagccctccagcacaggcctgctctgggggcanavgnntttaggaaagagcgtacgtctgaagactgactccyttgactatctgtgtctam

SEQ ID NO: 9624 - DNA, 268 bp, Homo sapiens
agtgtgtaccttagtctagaaccttcaagtgggttgagtgccaattggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcaty

SEQ ID NO: 9625 - DNA, 327 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaar

SEQ ID NO: 9626 - DNA, 86 bp, Homo sapiens
  misc_feature 60: n=a, g, c or t
tagtagagacggggtttctccacgttggtcaggctggtcttgaactcctgacctcagttnatccgcctgccttggcctcccaaagt

SEQ ID NO: 9627 - DNA, 452 bp, Homo sapiens
  misc_feature 238,253: n=a, g, c or t
atttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctncctcaaccaatatanagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcat

SEQ ID NO: 9628 - DNA, 102 bp, Homo sapiens
aactaccaattaacgagcrasraaacagggccagagaattggaacaaaatacaaggctgcctctgaaaggtcatgttcaagctaaaaaaaaaaaaaaaaaaw

SEQ ID NO: 9629 - DNA, 233 bp, Homo sapiens
tttaattatttgttcatcagttgatggacattttggtgttttcacttttggctatttttgagtaatactgctgtgaacattcatgtacaagttttttgtgtggacataggtttttatgtttataaaacatgttttatgtttatgtttttatgttttatgtttatatttctcttgggtacattccacctagaagtggcactgctgggtcatatggtaacttttttttttttttk

SEQ ID NO: 9630 - DNA, 321 bp, Homo sapiens
actcacaggaggggctgcaccaccctggggcgttttcaggaacattggctcaccctctatcagtgtcagtgataacgctgggataaaacaccacaggttggtaacaaccatcttctttcgtattctcacttgctcttctcttttctcttcttctcctctcctccccatctccttctctgtctctgcatctctctctgtttttctctttatctctgtctcwgtgtctttgcctttttctctctctgactctgtctctttctgtctctgctctctctgtctctatgcctttctatgtctgcctctttctgtctttgtcyctga

SEQ ID NO: 9631 - DNA, 308 bp, Homo sapiens
taagaagtgcaaataaagaaggaaactaaaattttagattaaacaagttaatgtgtttgtagggaaatggagagtactaaatttctttttcttacatgttttagactcatgatagtaaagagcacctggcaatgatggaacgaatattaggacccataccacaacacatgattcagaaaacaaggtatgttttaagattcaagacttttgttggatatgtgcaatagcatatattcaaactacagaaaacccaacgttgttgtaatactgattccaaggactatagattttgactttttttttttttc

SEQ ID NO: 9632 - DNA, 391 bp, Homo sapiens
  misc_feature 298: n=a, g, c or t
atttttcagcttccttttgttcacattgctacagatcttcagaacataaaatcccatgaaggaataacggacaaagggaagaaggattttgtgacttggggatatttaatgttaaatggttttccaaaagagctgaaccagtttacacagctgctgaaacaggtgacatgagagcctttggaaatgaagacccaaagaaatgaagaaatctgtatatttgtaagcccctttcctcggaaaagcccagaagtgtttcaagtggtgaccagcagagggcagcagtatccaccgcttccbncagagcacggcgtgcggaggtagactgtcttccggtcccacccggagatggggaattctaggccagtggctccaagtgctccttacccccagc

SEQ ID NO: 9633 - DNA, 455 bp, Homo sapiens
agtttttggtgttttagagtcggtgaaggctttaaaggaagtaggcagctggaacccggctgtggcgggttgaaaagcccgggcgtttgagagctgagacttgccagttcccacaggccaagccaggcgtctgcaccccattctcttggctccgacgatggagtcttgctctgtcacccagactggagtacagtggtgtgatctcagctcactgcaacctccacttcccaggttcaagcgattttcctgccccagcttcccgagcagctgggactacagaatatgctctccatgagggtgttcttcagggcctaccacaatggctggcactagagaagggcacaaaattgaagaacagtgaagacaaaagcaataagatgattaaggccatgtgagacagcaacaatatcaggttcctgaacacacaacaacataaaagcagtaaagaagctgag

SEQ ID NO: 9634 - DNA, 433 bp, Homo sapiens
  misc_feature 141..142: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcnnggcaggccaacattcaaattcaggarrtacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagct

SEQ ID NO: 9635 - DNA, 292 bp, Homo sapiens
acaaaaaataaataaataaataaaaggraaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaaccccatctctactaaaaatacaaaatttagctgggcatggtggtggggagcctgtaatcccagttacttgggaggctaaggtagcagaattacttgaatctgggaggcagag

SEQ ID NO: 9636 - DNA, 274 bp, Homo sapiens
  misc_feature 132: n=a, g, c or t
arctctgtttgggtctcagccctttggatgttaatcgactgggtccgtgcacctaaataattaaataattcctcctcaatcccacggtctctctgattccttaattatcccactgcacactctgtcacccangctggtgtgcagtggcgtgatctcagctcactgcagcctcaacctccagggctcaagggatccttctacctcagcctcctkaatagctggactkcagatatgcatcactacacccagatgttgaagtgctgttttttaaagc

SEQ ID NO: 9637 - DNA, 297 bp, Homo sapiens
  misc_feature 216: n=a, g, c or t
agagtcgacggctggagagaagccgggagcgagcccaggcgcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatganggccgcgtgtctgtggaaaacatcaagcagctgttgcratctgcccacaaagaatccagctttgacattattttgtcaggt

SEQ ID NO: 9638 - DNA, 369 bp, Homo sapiens
attcactgcattctccctcccgcaagcacacagatcctctcttctctccatgtagtcactacttggggaaggggaatgggtggtatcagcaattcaagactgatttcttttccatcttcagcgcccctttccttgatatgatgttaaaaccaggtattaacaagaaacagatcgaggaagaggcagagtaacaacagccgggaagaagatacagttttagaaattgtggagactgggcaagatgtgggggacaaaagtcaagcaattatcaaaattttgtaagagaagggtgatgtctgcaaacaaaatgcccaattctgtcaatacttagccataattattgttcatcaatgggaaactctcctcccc

SEQ ID NO: 9639 - DNA, 473 bp, Homo sapiens
taagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctckcagtgagagcagtctttttggtgtaatagtgggatgtct

SEQ ID NO: 9640 - DNA, 292 bp, Homo sapiens
  misc_feature 291: n=a, g, c or t
agttgggactcagggccccaggctccggggctgcggggccgcctcttccaaacgcgccttaagcggttttgcagtggctttccgccggaggctgggaggcgccccggccctgagtcagtcaccctttggccggacaggcggttcccgggcgcggaggatggaaacctggcggtaacctctgcaggtcgtgccactcggtgtgcgcaaggtctccagaggcatcttttcatttttagggggcactttccacgaattcatttgagctacacagcagtcctgggcattggggant

SEQ ID NO: 9641 - DNA, 452 bp, Homo sapiens
tgtatgttgcagatgtaaatttcttcctattttctgtctaatctcatattatttaccatgcagctaatgccgtttaccaagtctagctcagagagataagatacaatataaatcagactgtttcagtagaaaccagtattaacgtatggtgatttcttaaaaaaattaatgtcaaccactcaccttttgcattgagaatgtttttaccttttcacaactgcaggggttactgaaaggtttttcattccaagttttatttatttattaattttaaatcatccacagtgactcagctcatggtctcgttgttggaaacactaggagttttcaggacagtctcttcatgtgggtgttttcattacagttcatttacactgttgtaaaataaggtactgaagcaaaaggaggactgatctcctttactgattggtctaaattcaaaagtgaattgg

SEQ ID NO: 9642 - DNA, 211 bp, Homo sapiens
acaaaccccgacgcggagacgttggcgacagtggccgctgggggagctgctgagtgccgcccagcactgggctccctttcccttcactctcggcagtttcttgcctccgtgggtggttggcgcgtctgcggascagagtcgttgtgtggatcgtgggactgcagccccagccaaagggctgtcacgtctggtcggttccgtcacccacggt

SEQ ID NO: 9643 - DNA, 468 bp, Homo sapiens
ctttgccctcgcgasgccgccacctccggaacaagccatggtggcggcgacggtggcagcggcgtggctgctcctgtgggctgcggcctgcgcgcmsaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccacttcaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccaccttgaacttc

SEQ ID NO: 9644 - DNA, 93 bp, Homo sapiens
gagttgcattctggttccgtcgtgtgtctggcgtgtggagctagtgctcccgcttattcgccactgtcgccaccgctgtcatgaaccgcgaga

SEQ ID NO: 9645 - DNA, 501 bp, Homo sapiens
atatctgagatctttcttctaggagagtgagttatttttgagcagatttttctattgctaataaatatgtgttagtacgatggaaaaaaccttggatgaagactagtgactgtttctagccccactttcaccaagtggcctcttgaccttggctggtcactagaccctctggagccctagttcctcatctgtagagaagggactgatctctgtgagtcagccaaggaccaggagtcttgaattgtgaattttgatagatagatccaccaaacaaaattgtgatccatggagattaaattcaagtaagaacaagaggcagttctcttctggagaagaaattaggttcagataaaaagctatgcctctctctggttctggaagcttggctgggcctgacctgctgcsaacctcgggagactcctcaatctattcacacabcaggagagcaaaagctctctcctgggaagctgtttgcatgaagcaaagcagtgcaatcctcct

SEQ ID NO: 9646 - DNA, 134 bp, Homo sapiens
attcctgtaatcccaacactctgggaggctgaggtgggagggtcacttaaggtatttgttattttttgcgtacaaatatttaactaacttaaagtcaaaataaagattaaccgcacacaccaaaaaaaaaaaaa

SEQ ID NO: 9647 - DNA, 364 bp, Homo sapiens
aaaaatggaaaaataatcaccaacccccatcccgacacacacacacagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtktttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttat

SEQ ID NO: 9648 - DNA, 347 bp, Homo sapiens
  misc_feature 281,329: n=a, g, c or t
ataaaaaaaataagccaagtatagaaggacaaatactgcatgatgtcatttgaatgtggaatctaggagctgaactcacagaagcagagagtacgatggtggctaggggtaaggggtcaggagtacagactgaagagatgttggtcaaaagatacaaaatttcagttagatgtgaagaataagttcaagagatctattgtacaacatagtgactatagttaataacaatgtattataatcctgaaaattgcccagagtagattttaagtattttcaccacnaaaatgataaatatgtgaggttatacatatgttattagcttgagttantcatttcacaatgtatac

SEQ ID NO: 9649 - DNA, 157 bp, Homo sapiens
cttaaaaaaacatctggtaaagactgggtgtggcagctcacgcctgtgatcccagcactttgggaggccgaggstggatggatgattgcttgagcgcaggagttctagaccagcctgggcaatacagggagaccctgtctctatttcaaaaataaat

SEQ ID NO: 9650 - DNA, 171 bp, Homo sapiens
  misc_feature 83: n=a, g, c or t
tcgtgtttcaaattktcatcatttcartgaacatacttccacgttacattaagtgtgcctagcagtctgttgcattttataanctcacaattttttgttttgagatggaatctcactctgtcacccaggctggagtgcagtagtgcaatcttggctcactgcaagctccac

SEQ ID NO: 9651 - DNA, 430 bp, Homo sapiens
  misc_feature 348,417: n=a, g, c or t
aaattctaaggaacactagcccaggaaagaagtgtctgacaaaacaaagaaacaaaacctcagtgaaaaatgtgcgcaagaaacatttcacaggatattctcatcttacagatgcacagtgctcattggcatatcaattaactgagtgcagtgcagctsagtttcatactatgtcggaaaaactctcctcaagccgtattttccgtctgctctcacaccaccacaacaatcatcaagaagacttctgcgasttctggaaaaactcccacacaccaagcagtggacaccagctgagagtcctccagttcaattccggcactatctatgcagagataacatcaaatcccncaggttgagggctcagtcccacaagaccactccccctaccagtgttactagtgccatgtacaataaganactttcagtctat

SEQ ID NO: 9652 - DNA, 569 bp, Homo sapiens
attgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatag

SEQ ID NO: 9653 - DNA, 306 bp, Homo sapiens
  misc_feature 27: n=a, g, c or t
tccatattctgtattaggagaaaattnscctcccagcaccagcccccctctcaaacccccaacccaaaaccaagcattttggaatgagtctcctttagtttcagagtgtggattgtataacccatatastcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttgaaaaaaaaaaaaaaa

SEQ ID NO: 9654 - DNA, 206 bp, Homo sapiens
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctcc

SEQ ID NO: 9655 - DNA, 137 bp, Homo sapiens
attcctgtaatcccaacactctgggaggctgaggtgggagggtcacttaaggtatttgttattttttgcgtacaaatatttaactaacttaaaagtaaaataaagattaaccgcacacaccaaaaaaaaaaaaaatt

SEQ ID NO: 9656 - DNA, 111 bp, Homo sapiens
aatttttataaacttttgttctttcttgtaactttttatcagtcagctattccaatgaagcaaaatctgataatatattgcttttatactaaaaaaaaaaaaaaaaaaaaa

SEQ ID NO: 9657 - DNA, 244 bp, Homo sapiens
  misc_feature 96: n=a, g, c or t
ccttaattagactcaggaaacaatgggtttttgttgtcgttgttgttgttgatgttgtttttttatatgcagtcttgctctgtcacccaggctggngtgcaatggtgtcatctcgattcactgcaacctccgcctcccaggttcaggcgattctcctgccttagcctcccaagtatctgaactacaggcatgtgccaccaagcctggctaacttttgtattgttggccgggctggtctsaagst

SEQ ID NO: 9658 - DNA, 332 bp, Homo sapiens
  misc_feature 256: n=a, g, c or t
gccattcttgagggagtaaggtggtatcatattgtggttttaatttgcatctccctaatcattagtcatgttgagtactttttcatgtttttggccatcttctagacattggcttaggcaaagatttcatgaccaagaacccaaaagcaaatgcaacaaaaacaaagataaataggtgagacttaattaaactaaagagcttttgcatggcaaaaggaatagtcagcagagtaaacagacaacccacagagtgaanaaaatcttcacaatccatacatccgtcaaaggactaatatccagaatctacaaggaacgcaaacaaattagcaaga

SEQ ID NO: 9659 - DNA, 80 bp, Homo sapiens
aaaagatgagttcagcccctttcctttctctctcgcacacatatttgctcgcctttttgtctgccaacatgggataaagc

SEQ ID NO: 9660 - DNA, 389 bp, Homo sapiens
atgcataggacttgctgcttgtacttatatcacagcacttaacacagtaggttataatgatttgtttatttctctccctaactaggctttgtgtatctcaaggatagcaaccacattccagttttttgctgtaggcttagtactacctagtagagacttaatttttttttaaatgaatgtttatagtaatagtcaacatttactaaaccgtttggtaaatacttcagataacagtgaccaaaaagtgaatgagtgccaacacttttaaaagttaaaagtttttctcaaccaggcacacataatgctgatggtattcttagagccattgattgagaaaaatacatgatgataaaratctatcatgaattttgtaatattaaagtatattt

SEQ ID NO: 9661 - DNA, 76 bp, Homo sapiens
tttcctttatgccattttttgtttttgttatttgcaaaagatcttgtattcctttttttttttttttttttttttt

SEQ ID NO: 9662 - DNA, 446 bp, Homo sapiens
agaacgtgctgtgtggatgcggcgaaacgctgaggcgcggccttcgctgtgtggtggggactcacaagaccgacgtcaagatgatgctttcaagggccaaacctgctgtaggcaaggcgtacagcacactgacaaaagaaagaagaaaggtaggaagattccaaaactagaggagctactttcaaaragagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcrcctacttctttcttgggatgtataaacaagctgaagcagctggatttaaagcttcaaggagccgactcc

SEQ ID NO: 9663 - DNA, 204 bp, Homo sapiens
gccattcttgagggagtaaggtggtatcatattgtggttttaatttgcatctccctaatcattagtcatgttgagtactttttcatgtttttggccatcttctagacattggcttaggcaaagatttcatgaccaagaacccaaaaggmaatgsaacaaaaacaaagataaataggtgagacttaattaaactaaagagctttt

SEQ ID NO: 9664 - DNA, 456 bp, Homo sapiens
tgcactatagaacaactggacctaatagatatttacagaacatttcatccaacagctgcagaatacatattcttctcctctgcacatggattattctcaaagatagaccatgtgttaggtaacaaaacaagtcataaaatatccaaaaattggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccaaaacctataggatacaatgaaagcagtaggagagaaattgtagcaatatgtgcctacatgaaataaaaacaaaaacaaaataacttcaaataaataaaacctgtatcttaaagaacca

SEQ ID NO: 9665 - DNA, 469 bp, Homo sapiens
tacagttcactattgctatgaaaatgttgactgagcttgggtccctattgagaaacacagaactaataggcatttgggcctacaataaatacagacaggagttcaagccacaatgagaattggcagtcagaatttaaacagaaccctgactgatcagcattgctaatttttctttcctgctgagtccattagcttatctttggtctaatttttgtaacatatgcgccagtcttagaaaagcattttcccatggttaggataaagactgctcctgatatttcacaagttacacagaaagtttctgagcacttaatagtacaagaaataagatctgagagattggtccttattttgcaacataatggaagaagtacagaaatgactgccacatgttgaaaatcacctctcatatttcaaacacctttttaaaaaggtgctgaaaattaattatatattaatagtagtaatg

SEQ ID NO: 9666 - DNA, 452 bp, Homo sapiens
catttagttctgctctgatctttgttatttcttttcttcttctgggtttgggtttggattgttcttgtttctccagttccatgaggcatgaccctagattgcctatatgtgctctttcagactttttgatttagacattttaggctatgaacttttcctcctagtactgcttttgctgtgtctcacaggttttgataagttgtgtcactattatcattaagttcaaataatttttaaatttccttgaaatttaaattccaatgaagttccaatgaaatcttgatatcattgttgatccaaccattacttagaagcaggttatttaattttcatatatttgcatagttttgagggttccttttggagttgattttcaattttattttactgtggtctaagagattacttgatataaccctgattttcttaaattyactgaacttgttttgtgs

SEQ ID NO: 9667 - DNA, 216 bp, Homo sapiens
agggtgagctactgtcgagatacataacatgtaaatgttgaatctgcatctcacttgaaatggttgggtttggagaaacggataktcaagcttattggaattattgttaaaagtgttctttcttggaaccatctgccaagctgtgaggaagctccagagccatatgacaakacctgatggaggataactgaggactttggccaacaacccccagct

SEQ ID NO: 9668 - DNA, 474 bp, Homo sapiens
attgatggaacagatgtaaactcataaatttagtttactgaggttttcggtgagtgtggcttcccgtccgcgtgcttttcctatacaaccagcggcgtcctggcggaggagtcactgtggacttccccggagcgttgtcactgccatccctcccgcggtgaatcacagataccaaaaggaaactcggcactgggcatgttcggatgtgaatggttttgctgataasaacagcctccggaaccaaagcctcaaaatagtcgtctcccccgcccctcgcagaagcggcgagtggtatctgccaaacagatgacaaagtacctccgactgaatcccacagacagcgctttgagcagaacgcacggctcaactcattcatatggccttgaacccacagtgaattgaagagagaaagaaatggatatgtctgaccccaatttttggactgtgctctcaaactttactttgcctcatttg

SEQ ID NO: 9669 - DNA, 285 bp, Homo sapiens
  misc_feature 191,253: n=a, g, c or t
aatctcaggacctaatgagttcgttgtaaaatattcctgggagtagatgggggatctactcccagttttttactttttacagaatattgttgctttcctavaamcaatgtacawatatttgcagttgtatatgctttttttttttccaaataaacttgtcaccctgcatgcccttggcaaatargtgaagnagaaataggaacacagtccacattcaagttgaggaacagtktayctttaaragctgmccttnwgggtgacctggaaagggggaaagatggctaa

SEQ ID NO: 9670 - DNA, 455 bp, Homo sapiens
atattaggaagagaagtgaacatcaggatccaaggcgggaagggatgggctaactgtactgttttgtgcaaatgcagccagatgtatgatcaggactgcccttatctataaaattgagccttgaagggaaaagaaacactgcctgccactcttttggttgtacagcaagatggctgagcagcaactctttttctggatcagttatataaatgctttgtttttaaagtcgggaagtaccttgccagtaagggattgcctttaatgttcttttgatattggacaatgcccctggccacccagaaccccatgagttcaatacaaacacattgaaatggtctacatgcgcctaaacacaacacctctaattcaacctctagataagggagtcataaggactttaaggatcattacacacagtactctgtggaagagaaccccaattgagagaatatcat

SEQ ID NO: 9671 - DNA, 81 bp, Homo sapiens
tttcctttatgccattttttgtttttgttatttgcaaaagatcttgtattccttttttttttttttttttttttttttaaa

SEQ ID NO: 9672 - DNA, 481 bp, Homo sapiens
acacagtagatcaagtttgtttatcccctatatttaaagatattttcaggatcttgaggcaagagacccagaaaaataacaggatcacatttctcaaggaagaattgtgaatataacattgctgaatgggtcagtaacatattggccacatttgatagaatgagcagaactagaaattactttataaatgcagaagtaaaatgtcaatttattaagaaaactggagctacaaaagcaaaggaaacatgaaaacatatggtcaacacaatggaagcttcactccaggcaattacagccaagaaaatagatctcccttatcttgctcttggtcaagagatgcaacatttctcattctgcacagctgtttgttgaagaccaatatatccaggtgaatgaggctgagaagtctgggagctcctgttctccacccagcatttaaaatagaaatctacttcaggcatggcagactgagaatactgat

SEQ ID NO: 9673 - DNA, 488 bp, Homo sapiens
tttaacactgataatgaggttcaaagcttaaggagaaaagactataaatgtgagaagagaagccactaacgattcacagtaagtggttttagtagattcgctagctatacagttataaaatcttaaggttttttcttaagcattccctgagaaaaatcttaagattttagacacttttctagtcaattatttacaataggtttattgattaattaactttgttttagttcacttcctattgtcaccttctatagtttctggtaatcataacatattcataaagagtaggctgggcgcagtggctcctgcctgtaatcccagcactttgagaggccgaggcgggtggatcacgaggtcaagagttcaagaccagcctggccaagatggtaaaatcccgtctctacaaaaaatagaaaaagaattagccgggcatggtggcaggtgctgtaatcccagctgcttgggaggctgaggcagagaattgcttg

SEQ ID NO: 9674 - DNA, 210 bp, Homo sapiens
aggtccttatttcctctctttcagccagattcccattccatcarraatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgaca

SEQ ID NO: 9675 - DNA, 378 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaag

SEQ ID NO: 9676 - DNA, 429 bp, Homo sapiens
  misc_feature 381: n=a, g, c or t
atagcatagaaagtttccattcagtttgctatttagaaacatgcaatgctccctaagtattgtatttgtagggtgatgctttatcatcaagarggtcttgctccacctaagggaatttccaactaaaggaacctcatctttttaaatgcaaaaaccattaaaatagatgggttttaaccaatttggacaggaaacttgctgctaaagtgtatgccgttcctttagtaagcaaacactaaactcagtttagtattaaactaagtttacaatatttgatgactgtggttacattgaaaaggctggaggaggtggagggggttgtccagaggaggaaagatactgtttaasctggcaggaaatggccccagactgttcactgcntattctgtggattcctttctgacagctgtcactttctgcttatcagck

SEQ ID NO: 9677 - DNA, 434 bp, Homo sapiens
actgattgccgcagctactctccctgccgtcgccgcccgggaccgggtgacattgaggttttcgtctatcgccgctgggccgataggcttctttttaagatttggctttccaagtaagatttttgtttgcctgcttttctcctggaatttttttgtttttggtcgaagaagcaggtaacttgcatatcttaaggaaaacattgtttttgctttgcttttgttgtttaaagatcctaaaacgtaccgtgattcctttacgttactaataattggaaagtgtgttaaatcaagggttcgcttaatgttctttagcctttgtacatagaatatataaatgtcgtgagtcatctttacgaggtttatgagtttgtgttcgggtttggcttttttgttgtgtgtgcgtggttttttttttycttttcttgtaacaccgt

SEQ ID NO: 9678 - DNA, 170 bp, Homo sapiens
cttctaggctgttagctctttaagagtcaggattgccagctgggtccagctgttatttgagcaaatcctccttgtttccgggcgtcagtttcctcyttctgtatagtaaagtgttgttaaatcagttgttctccacactacccttcagtggtttcttttttttttttttc

SEQ ID NO: 9679 - DNA, 441 bp, Homo sapiens
gaaataattgttagtttttaatatgcacttcgtggggaaatttcttagacgtatgcaagcaagtgaaaacaattagggccagtggtattaactacttkataaaattttatttttgtttgtaagaagtcatctatttaaggcccagttaatataagtggaatcatcatagtttaaggaatacccagagattgctgctgttctatttattttacagaaaggatagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaa

SEQ ID NO: 9680 - DNA, 97 bp, Homo sapiens
tttctccctggargamaatgctcattatttckgctctgtgagggcaggagcctwrtttcttttgmwwcctgaccttctcccctaagctgtatgagaw

SEQ ID NO: 9681 - DNA, 372 bp, Homo sapiens
tagaatatgggtggtaattgacaatattggagtgcatctgagcatgtagggagaaagctcagagtgagaaaacagaggcctgatagagtcctgcagacactaaaatgtgatagtttcatacaagaggaggagctttgaaaagagcctggaagtgaccaacgagttggagaaacccaggagagtttgtgttaaaaatgccaggaaagagaatgtctcaagagagtaattgctgctgagacgatgattagtagaactgagaagtgcccattggttttggtgagatagaggtcagacattaccttagcactttttggggaccaagtcgaatcaaagtatattggggagcaaaacttttcaagcttggccatgaag

SEQ ID NO: 9682 - DNA, 432 bp, Homo sapiens
tgttattttgtagctttaatgatttttgttttctaatagggcaaatgtctctaagcttggtgtttagagctgcttcatattttaaactagttyccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcac

SEQ ID NO: 9683 - DNA, 323 bp, Homo sapiens
taaggtgtctgaggtatgaggaaactatgaaaattggctggggacatgtttaatgtgtgagatgaaagggggaaaaaatatgtcccatcactccttccatatccacaccctccttcacaatggggcattactcaggttctcctcaggtaaagtaggcttggctccctgaccaataatcggtcttccactctcccaattcctagtaagattcacttatgaagagaagaaacggtctcaagttacgtgtgaccactacgctttgaactctgggramcttcaatgtattactgagaccatgaaccacaaaaataggtttgagtgag

SEQ ID NO: 9684 - DNA, 432 bp, Homo sapiens
aataatttctctctctctctctctttcataaggacacttgtgttggcatttagggcccacctggataatccagaataatctccccatctcmaagattcttaatcacatcctcaaagatgaacccattttccagttaaggtaacattcacaggttctggggattagaacatggacatatctttagaagctatcagactaccaaaataagcaaagacattttaaaatttaccatttattaagtaccatatgccagacacctacatacatttttctcacctcaattaagttttacaataaccctgaaatgtaggtattaatgcctgtattctatagacgaggaaactgaggctcagggagattgagtcacgtgcccaatgtcacgtagctggtaaatgacagaactaggatttgaaaccagatgagctgggctcc

SEQ ID NO: 9685 - DNA, 90 bp, Homo sapiens
gaggttgagacaagagaatcacttgaacctgagaggcagaggttgcagtgcagcctgggtgacagagggagactccggccccctcccaaa

SEQ ID NO: 9686 - DNA, 461 bp, Homo sapiens
tagaatagggttttcagccaagtcttgaagaatgagaaattttacacaggaagaaaggtattctaggaagaaggaagagcaggtgcttgtarggttgacatatagcatacatcaaggcacgtactaggaagttcctggagaggtaggagactgatcataaacacactagtatgattgatatgcagaggagttaggactttatcttatccatttattcctcacagtaacattataggatagctcttttattcccatataagaatcaggaaacgaagacttagaagtatgtaatgtgccaatgatccctgaatttagtaccctattagattagggtaagggaagttgaagagtttagaatgactcccagttgtctataatgggtgattggggcagattgggatgttcagttttagaattaagtttaaataccagtccaagtaaagatgttagaatgctatgca

SEQ ID NO: 9687 - DNA, 361 bp, Homo sapiens
caaacagaattaccagataagccaaaaatactgcttctaggtatacgccctaaagaactaaaaacaggtgttcaaataaaaactcgtatacaaatgtttatagcamcattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgaggcaggagaatcacttgaacctgggaggtggaggttgcagtgaactgagattgcgccactccactccagcctgggcaacagagactcggtgtcaaaaaaaaaaaaaaaa

SEQ ID NO: 9688 - DNA, 416 bp, Homo sapiens
  misc_feature 272: n=a, g, c or t
tcatcagcagtgtataagcatttcaattttaatatacttcctttaaaattaggtatcagtattttaaaatgttttacctaatgaactaaagagtaaaatggtcttgtgaattttctttcatttacattttcagttattttgtatagaaatttaataggaacaagaagtcagaagcagattagagacatgcaaaacttaaactcctaaccagagcatttggctgtgtagactactatgcactgcactagtgttttgaatctaaacctgtttmntccaggcgccgtggctcatgtctgtaatcctagcactttgggaggccactgtgggcggatcacttgaggtcagaggttcaagacctgcttggccaacgtgatgaaaccccatctctactaaaaataagctggatgtagtggcac

SEQ ID NO: 9689 - DNA, 67 bp, Homo sapiens; identical to SEQ ID NO: 8447

SEQ ID NO: 9690 - DNA, 440 bp, Homo sapiens
caatcaatcaatcaataccttatattccagtctggggaaggagtcagaaatgttagattagcaagaatagctaacattttctagtgttwatwatgttccagaagcccaagttatcttatttcatcttcacaataaccatatgggttaggtaatattaatatttacattttgcatgtgaagaaactgaattgcagagaggtcatcagtaaatggtagagccaggattcaaatcaaagcagtctaactctagatcaagaccacttaacttaatgctaattagcagtcattcaaagtagggtgaaaagtgctagttatactgtgggaggtagggagagacaaaagagagagagaagagattaatgctaagggcgtccaggagatcctttgtatagaagatgaaattttagctgatcttggatgattttcagtaaatatagtat

SEQ ID NO: 9691 - DNA, 387 bp, Homo sapiens
ccatattatgaatatgaaaataatgaagttaatttcctgttgcctttctgtgtcagccacaatatcaggtctaaccctaatccagggatgcccagtaaactgaaggcaattttaggttgtagaactcagattaattgtagaaaccattaattttaattgctctaattttcatagtaatcataaaaagtatgcaagtacctaatatataaactcaattgacactgtatctgtagaagtaaatttttaatggctggttaattatatcactacattttattgcagtatagtactcatttaagcacttaaaaatggaaggtgtacaaagattaaattaagacacggtaaattgactaaatatttggtttttatataaataaaggtcataac

SEQ ID NO: 9692 - DNA, 445 bp, Homo sapiens
  misc_feature 392: n=a, g, c or t
catgttaaatgttgttcctgggtccacagataaacatctgaggtaacttaatcttcatgactaaaactagatatgaggcccaggtaaaatgattatttkgattgctttgctaggaaagaaatcattgccatgggttagtacaaaatgcacaggggatttcccttttctaattggagcctcctaatgtgagtagctttgaaagccatttcttgtataaatactgcatcataatatttcagacttgaaatggacagagtataagagtgctttggactgggtgcagtggctcacaccagtaatcccagcactttgggaggctgaggcaggaggattgcttgagtccaggagtttgggaccagcctgggcggcacagggagacctcgtctccacanaaaataaacaaaattagccgggtgtggtggtgcatgcctgtggtcctagctam

SEQ ID NO: 9693 - DNA, 51 bp, Homo sapiens
cattatccatctatggattcattcagtaataaactttcctttttttttctt

SEQ ID NO: 9694 - DNA, 254 bp, Homo sapiens
tatatactgctccgagtgtggtgggctgtcctggtagttgcggatttgtagttcctcctgtaaccggatgcatgaaattgcaagagggctggctattgacaattgcatggcagttcttccatgtgacttataaaataatgagaccaatgccccattactatgtaatgagaccttacatagccattcacaataaatatgaacatataaccttataacccgtargcatggggggctawtttgkttcaaaatgcagt

SEQ ID NO: 9695 - DNA, 421 bp, Homo sapiens
aaacatggacttctcaaattagaaaaaaacaaacaacaaaaaaacaggttaagtgttttgttatgaaaattatgaaaatgttcttattattatggaaaatttcaaatagatatagagagaataatgttacaaacccccacatactcaacatttagcttcaaaaattatcaactcatggcgggttttgtttcatctgtacaaactagtcggcacactatgatggcctgtggacaaaatccggccctctgactgtttttgtaaataaggttttattggaacacagccacacatatttgttgacttattgtttttggctgtttttgtacttcattggcagagttgagtaattgcagcagactctatggcttgcaaaacctaaaataattactttgtgtagcgctttatagaaaaaatttgctaa

SEQ ID NO: 9696 - DNA, 458 bp, Homo sapiens
tggagtctcaactcttccctttagaagtcttgtaaccttgggcaagttcaaccttcctttctttttatctgcagaaggaaggaaatggtaatatgcaatttatcaggttgttgtgagaaaatatatctgtttgtgaatggatagcattcatatccatgttagttttttaaaaaatggtggactattttaaaagtttctattcaataaaatgcttttagtaacataatgcaataccatacaattgtgcaagattatacaagataatcgtagcttttataaaatgttaattcagaatatatattaataggacacaagcttttaaatctagttttatttttattaataccttttaatcaaactgctaataaaatacaactaaaggtgtcctaaagaaaaaagcagtcccttgccttctgtttcctaagccagttttttttagaggcaatgactttggatgt

SEQ ID NO: 9697 - DNA, 391 bp, Homo sapiens
ctccagacttgtatttgcaacttctgattctgttatgcacaacagcatgtatcagaaagtgagataatttcccagaaatgttagaaagttttaaattagtgtactgatgctagagaaagcagccatgaaagtcatcctcaatacaaagttgctggcacttttatggacagtatataaggtaatttagtgtattttacattcatgaataatcaaggcaggttaatcttgcatatttgtttctaattactctatttttactactcccatcatttctctttctcctgcaagaagttggaatgtcctaaccacagtgcatcacatacacccacagaacagtagcaaatgagggccccagtgtttctgtagagaaagcagtcaccctgataactgc

SEQ ID NO: 9698 - DNA, 86 bp, Homo sapiens
gaggttgagacaagagaatcacttgaacctgagaggcagaggttgcagtgcagcctgggtgacagagggagactccggccccctcc

SEQ ID NO: 9699 - DNA, 432 bp, Homo sapiens
tgtcagcttatggttcagcaggctagtgagcggagttacaaagaatccagtgggatttatctggtcagcatggggtcctgcacataatggaggagtcactggctgttgtttctgcctcctcttgggcctatcagtctttgccaccatcaggagaaccgtggagaccctcaggtcccaggcctgcatactaaacaggcttgggtttggcaggactcatgctgccttccccaggccacattgttttgctcatgtgtttggtatcccctgaaatccttgctatcaaagatgcctgtgcccacctaagaggagttaccttaaaatgaaaagcaaacaactttgctcttatttagaaagcatgaaaccagtgccttaaccttatggttttatcattcaaactacagagttggaaaaagtgtgtgtttttttgttgtt

SEQ ID NO: 9700 - DNA, 440 bp, Homo sapiens
ttaaatgacctagaaggtgcaagttgactgtacatcatagatattaaaaagcagacagtcattaacaatcaagatgtaaaagtgatccatgtttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaa

SEQ ID NO: 9701 - DNA, 336 bp, Homo sapiens
tcaacaatagaacatgtcacacacgaactggaaactgattctgtgggcgacaagagtctatagtaaacgttatgacagattctttgaatgcgctaatctcagactggactaaagttgcgattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaaataaagcagcttgcagaaacttggtctttg

SEQ ID NO: 9702 - DNA, 399 bp, Homo sapiens
cactaattataaagaaaaattatagtaggaggtgagcagttctctttgctgccattttgagataacggggaaaattttcaccataatcatatatactttagtaaatataagcacttcttgtttgatacagatttgtttttctagaagtaaaattgtttacctattagcttttattgatttgtaagttgaaaggttagcttactagagatcagcatcataattactaatgtttcatcctctgtacatcatctcatatacatctttttccccatcctttgtttcatcctttgtgtcaccatccatggaaggtcggggagtgaggacactaccaatctatttaaactcaagatagtttagatttatggtgtggtataccaagttaaatttgtgcatcaaaaa

SEQ ID NO: 9703 - DNA, 89 bp, Homo sapiens; identical to SEQ ID NO: 8903

SEQ ID NO: 9704 - DNA, 323 bp, Homo sapiens
tataaaaaagattagttctatttcttcaatatgacctaaacttcatctcaagtccagttggtaagagaactatgaacctgtttttcctggtctgttgtacaacggttcccttgtggactaaacggtaatgtgttctgcatgaatccaagcacaactgacattcactgtgttaaaaaacaaaaaagagaaacatttactacctttttcagatctcatttctgatggacctgaaaatattgtaagtgggtattttcttcaaatactcagagactgaattctaacatgtaaagaaaatgctgactcacacatgactcagtttgaag

SEQ ID NO: 9705 - DNA, 407 bp, Homo sapiens
taaagaaaaagaggtttaatggactcacagatccacgtgactggggaggcctcatgattatagcagaaggtgtaggaggagcaaagtcacatcttacatggcagcaggcaagagagcttgtgcaggggagctcccctttataaaaccattagatcaggcagggcacagtggctcacacctctaatcacagcactttgggaggccgaggcgggtggatcacctgagatcaggagtttgaggctagcctggccaacatgttgaggccccgtctctaataaaaatacaaaaattggccaggcgtgatggctcatgcctgttgtcccagattcttgggaggcwgaggcacgaaaattgcttgaaccgaggargcggargttgcagtgagctgagatcacaccactgcactc

SEQ ID NO: 9706 - DNA, 383 bp, Homo sapiens
cctttctcttctgccctccgcccaaacatttcacagcagggtatgaagcctttgcctcccttgcctctattatatcctatcctcaccttccgttgtttttttgttttttgttttgagacagggtttcactctgtcgtccagtctaaactgtagtagcacaaccatggctcactgtggcctcaacctcctgggcccaacaaatcctcctacctcggcctctgtttagctgggactacaggtgcaccaccgtgcctggctaattatttttttcttttgtagagatgggggggtctcactgtcttgccagggctggtcttgaactcctgggctcaggcgatcctctcacctcagcctcccaaattgctgggggttacgagcgtgas

SEQ ID NO: 9707 - DNA, 463 bp, Homo sapiens
atctcaggtctcttggctttgccagggcccaccggagaaaactgacgacccgtttctgtaatccttatgggagaccaaccttgtgcctccgggagaatccactckcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatkkctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcgcgat

SEQ ID NO: 9708 - DNA, 405 bp, Homo sapiens
  misc_feature 232: n=a, g, c or t
tctgcctctggaggtttatggttgaatagaggagcacacgatcacagcaagagtgatgtaggarggcaatcgaaaatatcgacaccttaaccaarctkggagagttkgtttttggggaaaaacaaaattactaaacttcagaacctggatgcgctcaccaacctgacagtcctcagtatgcagagcaaccggctgaccaagatcgagggtctgcagaacctggtgaagcacngggagctgtaccttagccacaatggcatcgaggtcatcgagggcctggagaacaatgtgcaggacagcctcacgtactgaggggaagtgtgctcacagagtccccascctcctcagctgcctccagstcaccctgctctgccccagtgcggtgttcaagacaaataaaagact

SEQ ID NO: 9709 - DNA, 72 bp, Homo sapiens
aatkgtgttcgcagccgccgccgcgccgccgtcgctctccaacgccagcgccgcctctcgctcgccgagctc

SEQ ID NO: 9710 - DNA, 367 bp, Homo sapiens
taattgatgatttttatttctattttgcataaagtgatttaatgttgcatttcctgatgtaactgtaaccaatatcaaagttgcttttcctggctggggcakggtggctcacagctgtaatcccagcastttgggaggccaaggcgggaggatcgcctgagagcaggagtttgggaccagcctggccagcatggcaagatcctgtctctacaaaaaatgaaattagctgggtgtggtggcacatgcctgtagtcccagctactcggggaggctgaggtgtgaggtcaagactgcagagccatgtttgtgccactgcactccagcctgggtaagagcaagactctgtctcctaaaaaaaaaaaaaaar

SEQ ID NO: 9711 - DNA, 411 bp, Homo sapiens
aggacccttgggtcaaggcaagccccgtggggcgcacgccggcgaggggagggcgggtcgggctcgtgcacgtaggggggccggwakrcgargggctttccykcstgtccccaaagtcccccacgctctccgtgccccggggctgcagagaagacagctctcaccccgcgtgtgccaaggtggagtatgcvtacagcgacaacagcctggaccccgggctttttgtagaaagcacccgcaagggragtgtagtgtccagagctaatagcatcggttccaccagtgcctcttctgtccccaacacagatgatgaggacagtgattaccaccaggaggcctacaaggagtcctacaaagaccggcgcggcgcgcacacactcaggctgagcagaagaggagggactccatcaa

SEQ ID NO: 9712 - DNA, 71 bp, Homo sapiens
cttttcgatccgccatcvgcggtggagccgccaccaawatgcagattttcgtkaawacccttacggggaag

SEQ ID NO: 9713 - DNA, 103 bp, Homo sapiens
  misc_feature 5: n=a, g, c or t
gaggntgagacaagagaatcacttgaacctgagaggcagaggttgcagtgcagcctgggtgacagagggagactccggccccctcccaaaaaaaaaaaaaaaa

SEQ ID NO: 9714 - DNA, 369 bp, Homo sapiens
taaagattaactacaaagataaacatggccaaaaataaataaataaatatggccatatgtccgttgttgcttagtcttcccttgcagccttttacccttgawttctscsttcabctctacccaaatatagcacaactcctcaagtaattttttttttttttagatggagttttgcycttgttgcccaggctggagtgcggtggcgcagtcttggctcactgmaacctctgcctcctgggttcaagcaattcttctgtctcagccccagagtagctgggattacaggcacctgtcaccatgcccggctaattttkgkatttttagtagagatggggtttcaccatgttggccaggctggtcttgaactcc

SEQ ID NO: 9715 - DNA, 316 bp, Homo sapiens
catcccaggagcacattccctcactgagggttccagccacctcttccgcctcattatactttgcttagcaccgagaagtctggcatcgtttctgttggaatgaaaagawtkgcaagagctgccctggacaacagcactgcaaaacactgtggcagaaggtttggtctacataccaaggcaggcaaagtattaattgcattctctgkgatcacaaaaataaggcgctgaattattctcttcatgttttaagaatgacaggcttttgctctgccagctycaagcatagtgcatcacatggaaaggagatgctagattt

SEQ ID NO: 9716 - DNA, 59 bp, Homo sapiens
tctccgccagaccgccgccgcgccgccatcatggacaccagccgtgtgcagcctatcaa

SEQ ID NO: 9717 - DNA, 359 bp, Homo sapiens
taaacaataagtgaaataattcccaagatttttgaacagatgcttggttttgtgaaccagaggagagccttgaagrbktgagcagataggaatggctttctggagaaagcacatgctgagctaagagttaagggttcggttaggtccgagtggttttcagaggcaagagaggacattctagttaaatcaacaagttgggaatgaatatcacttgttcttaggacaaggagatttgcctgcttttagttggaagtactcactgattatcttgggcagtgtggatggttgagaaggttggggccaatatacagaggatctgagcgtttagatctgataccgtaaaaaagatgagctgctga

SEQ ID NO: 9718 - DNA, 57 bp, Homo sapiens
tkgtaacatctctgmcttctctacctcctctgtgctcargtgactccacatcttctr

SEQ ID NO: 9719 - DNA, 434 bp, Homo sapiens
atatttggttaagatggcaaatgtgggtgtaactcttgattccccttagcattgctgttgctgcctttcatgtakskgtgcccagccaagagccaggttgtatggsmgtgattgggatgactggyatttactgctgcccactggcagtggtagaatagatcacctttgtttcttaggatagccatcagccatttggtttctatatttgtttaatatttagacatagaatgaaagghktgtgggaaaataattaacattgtaatcctacaatagctacaaaagatgtactaatatgtaatgacaataaatgaataacatgctattattgttagttaccccaccatatttagcaagctagagcagtgctgttgaataaaattataacataagccacatacataatttaatattttcttgtagctacattaagacat

SEQ ID NO: 9720 - DNA, 434 bp, Homo sapiens
  misc_feature 396: n=a, g, c or t
tcattgacttgcttagtcgtatactcaaatgatgataaacctacatgtgcaaaggctcacgtttaagattgtcargssagcagtctactgttgtgttgccattgcttttccattgggagaagaaagaattaaccagtcattaaaccatttggtaagttgcactttgctgtgctgrksscacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcrgaagaaatttattttaaattgtttaaatatctggaaatacttttagcwntcatttataaagatagttttgttctcagtttcactata

SEQ ID NO: 9721 - DNA, 378 bp, Homo sapiens
gtagccggagtgagaccgctctgcaaaccactgcgtgctttgcagagtgattatcagcacagttccctgccctggataaggaacagctacagtcgctgttaaatgtgcctgaaaagcaatttgcaatctttgcattaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaaa

SEQ ID NO: 9722 - DNA, 368 bp, Homo sapiens
tcaatttacattgtcagagtgaaatttaacagaaccattttaggggaaagatcttgggggcctacaaggaatttccttgtgagcaaattgtgagggaagtatgtagcttttttatcttgkagctattytattaggaacaaaactggatgcaggtttgggtgacccagttcccagcttgacttttccctttggcttarggaatttggggtactgagatttattttcctttcacatcacccaggccttatttgatctcaggtcttcccattttgcctcacctccagtgctctcttagaacagaataccttcccagcaaggatatcacactcctaacttttaatctattgccttcatttgcagactgttca

SEQ ID NO: 9723 - DNA, 300 bp, Homo sapiens
atgaaaaggttgtggtgtagytggtctgtwattaagttgcagatttaaaactgstgttagctttgtaaatcaaaatatasstgttttttgtcctggtatatcgsmttccatctgcagctggagctggaatcccattgatcttctagctaccattcattttcttcactgttcacaaaagaagagtgtgaaattcarygaatgctgyyactaatcctgktacsagatgaatctcatttcaccaaaattaaattatgtttttccgctamaatgatgatacaagytgaagacmcatcactctgm

SEQ ID NO: 9724 - DNA, 227 bp, Homo sapiens
ttaaaaaattactttgggaatagcatacccttccctgaataataaagaggtaatatcagggaatagagtagtgtcaggatgtaatcagttctcacctgacaaatgatggccmgggscarggktattcatctttgctggtgatatatgaagccgatccagggttctcagagttggacagaaggggttgtttggcaggtggtgtgagggtcctgaagttggctggatct

SEQ ID NO: 9725 - DNA, 297 bp, Homo sapiens
attgatcttaatctactaacagagaagggtagwyagtttgtgttaaatgttggcatttacttgtattgaccaaagttttgcagctctactatattctgtgctcaggactaaaatgctgktaattttttttttttttttccagkgctgdgcatatattctgkgatgggaaacattgttgatgtcctaacagaaatatatttkgatctattttcctatggagttgkttctattatgaccatttaattttgtttttatttaatagtagtattyccttcccttttatctaattttttatak

SEQ ID NO: 9726 - DNA, 183 bp, Homo sapiens
  misc_feature 129: n=a, g, c or t
ttcaccctgtggaaagtgcgaagatagaaccaccagatactggactttattatgatgaatatctcaagcaagtgattgatgtgctggaaacagataaacacttcagagaaaagctccagaaagcagacnaaaaaaaaaaaaarmmaacaammaaaaaaammaammmaaaaaaaaaaaaaaawh

SEQ ID NO: 9727 - DNA, 167 bp, Homo sapiens
tttctttctactgctccgccattgtgagggcgtgcttgcgtctccttcgccttctgccataattgtaagtttcctgaggcctctcagccatgcttcctgtacagcctgtggaactctaagtctattaaacctcttttgttcataaattaaaaaaaaaaaaaaaaaam

SEQ ID NO: 9728 - DNA, 67 bp, Homo sapiens
agactgaggctgaggctggggaacatcgggcagcatgagcggctgcgggctcttcctgcgcaccacw

SEQ ID NO: 9729 - DNA, 356 bp, Homo sapiens
acaaaaaataaataaataaataaaaggaaaaaaaagaattttgatggttagtcacccaataaatgttctggttggccgggcgtkgtgggctcatgctgtaatcctagcactttgggaggctgaggcaggtggatcatttgaggtcaggagttcaagaacaacctcgccaacatggtgaaaccccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcr

SEQ ID NO: 9730 - DNA, 58 bp, Homo sapiens
acgccacgggdcagccwagctakwagcctgwkgakccggwgakggtgctggctgccgc

SEQ ID NO: 9731 - DNA, 621 bp, Homo sapiens
ctggatttattgggtggcaatcaaaaataatcaaatacagtccttatttgtataacaaatgtgagatattggaaaatattttaccattatacatcatgtggacttattttatattaaagaaagaagattatattttggctaagaaacggaaacttgtctacacttgattagagaacaactatattttacttcccataggaacgacagaagcttttacaaggagttagagaacaaaacacatcaatataattagtagcacttttgtttaattaggtgtgatggttaactttatttatatgtcagcttgactggctaagggatgctcagatgattgatagctggtaaaacattatttctgggtttgtctgtgaggctgtttctggaaaagatgattagcatttgaatttgaatcagtagactgagtaaagaaggtcctccctcaccagtgtgccaatgtgggtggcatcgttcaatctgatgagggcctgaatagaatgaaaaggtagaggaggggcaaatgctgtcttcttgctgagatgtatccatctgctcctgcccttggacatcagggctctggttctgaagcctttagaccactctcctgggtctcagcgtgcaatg

SEQ ID NO: 9732 - DNA, 207 bp, Homo sapiens
acacctgtaatcccaacagtttggaagaccgaggcgggtggatcacttgaagtcaggagtttgagaccatcctggctaacacggtgaaaccccgactctastaaaaatacaaaaaattagccgggcgcggtggcgggcacctgtagtcccagctactcgggaggctgaggcaggagaatggcgtgaacccgggaggcggaggttgca

SEQ ID NO: 9733 - DNA, 87 bp, Homo sapiens
tagtagagacggggtttctccacgttggtcaggctggtcttgaactcctgacctcagttgatccgcctgccttggcctcccaaaagt

SEQ ID NO: 9734 - DNA, 63 bp, Homo sapiens
agtgagcggagatcgcgccactgcactccagcctaggcgacagagggagactccgtctcaaad

SEQ ID NO: 9735 - DNA, 135 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaaw

SEQ ID NO: 9736 - DNA, 93 bp, Homo sapiens
tacgamagacaaagagatgataagccaaaagacagtaaagcaaaacgaagaaagacaagggaggaagctgagamactacctgaggtgtctaam

SEQ ID NO: 9737 - DNA, 371 bp, Homo sapiens
caagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatga

SEQ ID NO: 9738 - DNA, 429 bp, Homo sapiens
  misc_feature 277: n=a, g, c or t
aagaatgttgagcagcagcctcccaaatcacagtatgcataaaagccaaaacagatgacagagctcagtaaggaagaccttactatttgtgacatccatcagaattttaacttgagaaactgatttcaaggacctgagggcactcgctttgctcctgtcagtacacactcccaaacagttaaacccagctctaattccaactctgcaagagcytttwaagccaatgsaggactttgtctgcamcagrgaaactcactccaagagcaagawgccaaangaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagac

SEQ ID NO: 9739 - DNA, 146 bp, Homo sapiens
aaatatatgttctttctacatcacccctctttctactaaaaataatctcagtaagattattattattattattatkbkbgagacagagttccactgcactctagcctgggtgacagagtgagaccctgtctcaaaaaaaaaaagam

SEQ ID NO: 9740 - DNA, 61 bp, Homo sapiens
agtggagggacagcttatagaaagttgagatggtcctaatgtaggtaaatagaaatctcar

SEQ ID NO: 9741 - DNA, 57 bp, Homo sapiens
ttttgtttgagatggagttcactgttgcccaggctggggtgcaatggtgtgatcttg

SEQ ID NO: 9742 - DNA, 108 bp, Homo sapiens
agccakctttcaattgtgttcgcagccgccgccgcgccgccgtcgctctccaacgccagcgccgcctctcgctcgccgagctccarccgragagaaggggggtaagtr

SEQ ID NO: 9743 - DNA, 146 bp, Homo sapiens
  misc_feature 80: n=a, g, c or t
aaaaatcaatgactkaagagtagctttctcccagcctccccgctggctctggagtatagagggaagccagccttttcvtnccccatcctgcccctcccctctcttctcatcttcccctccactctcctcctgaccctggcctggcc

SEQ ID NO: 9744 - DNA, 337 bp, Homo sapiens
  misc_feature 108..110: n=a, g, c or t
ataaaaaatgttatattaggttggtgcaaaagtaattgtgttttatttatttatttatttattattttttcctttgagacagagttttgttctggagtghagcgmwvnnntctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaaw

SEQ ID NO: 9745 - DNA, 78 bp, Homo sapiens
tttcctttatgccattttttgtttttgttatttgcaaaagatcttgtattcctttttttttttttttttttttttttw

SEQ ID NO: 9746 - DNA, 60 bp, Homo sapiens
ttwayyaktttcattytgtcawggtytatayatktacattctgtacattyacattctgty

SEQ ID NO: 9747 - DNA, 415 bp, Homo sapiens
  misc_feature 296..299: n=a, g, c or t
atccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctgctcctcttcatcctgtcgtcaatcacttacctcamctgsagscttctkggcccacstgckgcagtccaagtcagagctctcccactacaccttctactttgtggactaannnngcgtgasgtttaccaatatggcagtgctttggctcatttcttctacagctctgaccaggcctggtatgaccggttctggcttttcttcttgccagcagctgccttctgtggctggt

SEQ ID NO: 9748 - DNA, 501 bp, Homo sapiens
gtatttaawataggaagaaaaatcacagcttcaattaggaatatccttggtaaagcagtamaaatgaatcgtgaccccactttttagtaccctatgttatgaaacacgcaaagcacttctgctgcatacacaagcatgatggctgctgcaggaaaagcacttgagctacaagctgaactagctgttctttctatagaacaaactatggttaattcagacatgggtactaagttttttaaaaatgaagttaagtctgttccttgaagtaaaagaacagtatttgggttttttgttttgagacagggtcttgctctgttgcccagatttgagtgctgtggtgcaatcactgctcactgcagcctcaatctccaggactcaagtgatcctctagcctcagcctcccaagtaggattgagctgctccataaaagtcaaccaaagcaacacattccaagagtggagacagatgcaggtatgagaatccagctgtgttctattaagc

SEQ ID NO: 9749 - DNA, 406 bp, Homo sapiens
  misc_feature 197: n=a, g, c or t
agttctagaggctgggaagtccgggattgaggggccagcatctaccaagggccttcttgttacttcatcccatgatggaaggtggaagggtaaagagaggagaagaagcagtaccgggaatcttacatcagtgacaacctggacctcgacatggaccagctggaaaaacggtcgcgggccagcgggagcagtgcggngcagcatgaaacacaagcgcctggtsccgkccatycaacsgcmakccacagcagttcccacacctcgggcattgaggcagacaccaagccccgggacacggggccggaagacagctactccagcagtgcsatscaccgcaagctgaaaacctgcagctcaatgaccagtcatggcagctcccacacctcaggggtggagartggcggca

SEQ ID NO: 9750 - DNA, 109 bp, Homo sapiens
aatttttataaacttttgttctttcttgtaactttttatcagtcagctattccaatgaagcaaaatctgataatatattgcttttatactaaaaaaaaaaaaaaaaaaw

SEQ ID NO: 9751 - DNA, 371 bp, Homo sapiens
accaatagttctaatgaatatagatgcaaagatcctcagccaaagtgaatcctgaagcacattacaaggatatccacaaacaaaactgttagagctaatacctcaatatcacaggatgcccaggatcaacatacaaaaattagttatatttctgtatccttgcaatgaacatttcaaagtgaaatgaagaaaactcatttacagtagtatcaaaaagaataaaatactaataaacaagatgtaagacttacacactgagaactacaaaacatagttgagagaaatttaaaaagacctaaataaataggcattttatgttcacgtattagaagactttgaaaatggcaatactcccccaattaaccaacaga

SEQ ID NO: 9752 - DNA, 103 bp, Homo sapiens
gaggttgagacaagagaatcacttgaacctgagavgcagaggttgcagtgcagcctgggtgacagagggagactccggccccctcccaaaaaaaaaaaaaaaa

SEQ ID NO: 9753 - DNA, 83 bp, Homo sapiens
agaccagaccaacagtwwcaccaagggcargtgggcaggcctccgssctcctcccctactccagggcccactgcagcctcags

SEQ ID NO: 9754 - DNA, 224 bp, Homo sapiens
  misc_feature 112..114: n=a, g, c or t
tttamttatttgttcatcagttgatggacattttggtgttttcacttttrgctatttwtkagtaatactgctgtgaacattcatgtacaagttttttgtrtgaaacatadmnnnttatgtttataaaacatgttttatgtttatgtttttatgttttatgtttatatttctcttgggtacattccacctagaagtggcactgctgggtcatatggtaactttty

SEQ ID NO: 9755 - DNA, 462 bp, Homo sapiens
actgggattaaaggcatgagccaccgcgcccggcctgttagtataagtaccttgcattttaattttcagaagactttccagkagagaaggacacttcttcaaatggactaatcccaaggagctgagttctgaatctgccatgtataccccacacagattctgctgaacagtggaaggaggccaggatgggaagtttgtcaaagggtcacactaaggttcattctgcaacccatctacactcctgagtgttacccaaatgctctggcatcactgttaacattgttaactcatcctctcagaaataaggccttcattttcttttaaaaacaggattagaacctggcaggccatcagtatgtaaatkkgtttaatttagtcagtgattctcaacaaggatagcttcatcccaagggggaactttttggtattacaactgtttgatgctacaagcttttactgagt

SEQ ID NO: 9756 - DNA, 86 bp, Homo sapiens; identical to SEQ ID NO: 9617

SEQ ID NO: 9757 - DNA, 430 bp, Homo sapiens
acagcctgaccaacatggtgaaaccccgtctctactaaaaatacaaaaattagccgtgcgtagtggccggcacctgtagtcccagctacatgggaggctgaggcaggagaattacttgaaccggggaggtggaggttacagtgagccggaatcgccccattgcactccagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccgtgcctggctgggtatttatattatcattctagtttcagagtatacagaagtttcatc

SEQ ID NO: 9758 - DNA, 477 bp, Homo sapiens
  misc_feature 239,241: n=a, g, c or t
agccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgsaargtcacttatacatctcmaggaaagrttctngngaagaaaaaagkgcttagcaaaaaaatatactcacctctcctgcgataaagtcttctgccagccatggcagagatgcattgagggcacctgtgtttgtaaactaccgtatcagtgcccaaagaatggcagcagtgtgtgcaactaacaggagaagcttcccaacatactgtcaacaaaagagtttggaatgtcttcatccagggacaaagtttttaaataacggaacatgcacagc

SEQ ID NO: 9759 - DNA, 487 bp, Homo sapiens
tagtttttaccaaatggacccttttagagaaagaagcatcaggataaagtcccaatcttcagtggtttgtggaagagagaatctgatgattcatgccctcctaccctgttagaattaggacagggaatggcagaccctaaacatacatgtgaactgagcaaagattgcctttgcttcacctattgacacatttaagaacctcgttttatagagagtacggagtggggtctgagattctacatttcttacaagttcctggtttatgccagttctgtttgtctggtcaccacacttctgaatagcaaggtttcagaggactctatgaagtttttatttctcaaaaatttggcttaggtacatctttacatacagtggtgctagatattattctttcagaacttaaccatgcaacaatgcagaagaatacaaaaaatgcttgcacacagtagtgtattttaatggaactataaaagcattgaactgattc

SEQ ID NO: 9760 - DNA, 130 bp, Homo sapiens
aatacctctagttcttcccgtccgccccagccgcgtctgggccaggagaaaagcaaaaccasattcctgctgctgwcagttttgatgcactgagaaaacttcagagacctaagctttttccagagaagag

SEQ ID NO: 9761 - DNA, 432 bp, Homo sapiens
atgcaacgtgcacgtgcttctactggaacactaactgtcttgatgtcctttctgggatgttctcttttgagactcagcttctatgttatgagaagctcaggccacattgaaaggctatgtgtaggttgtcagtcccaggtgaactcagtttttgagtcatcccagcccaggtgcttgacatgtcartgraaggrgcccccmaratgactcsaktcccaagccatgacatcagcctcagccttagtgacttttgtgatgttgagaaccagagataagccattctcactgcacactgcctgaatccccaacccacagaatctgtgagtttaacacaatggctgttttaagcaacaaagatttgttatgaagtgattgtaactggaacacatccatcctccagaaaagaggcaattgcttccaaatgtttccatc

SEQ ID NO: 9762 - DNA, 483 bp, Homo sapiens
tgcactatagaacaactggacctaatagatatttacagaacatttcatccaacagctgcagaatacatattcttctcctctgcacatggattattctcaaagatagaccatgtgttaggtaacaaaacaagtcataaaatatccamaaahttggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccaaaacctataggatacaatgamagcagtaggagagaaattgtagcaatatgtgcctacatgaaataaaaacmmaaacaaaataacttcaaataaataaaacctgtatcttaaagaaccagaggacaggcaccatagctcatgcct

SEQ ID NO: 9763 - DNA, 323 bp, Homo sapiens
ataaaaaatgttatattaggttggtgcaaaagtaattgtgttttatttatttatttattattttttcctttgagacagagttttgttctggagtgcagcggtgtgatctcagctcactgcaacctccgcctcccaggttcaagtcattctcctgggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaa

SEQ ID NO: 9764 - DNA, 337 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaaw

SEQ ID NO: 9765 - DNA, 126 bp, Homo sapiens
gatccccggcgctcccgcgttcggtgacggccgggtaggctgtaggcagcgcaatgccaagacagagctgctggcggcggcgggcgaatctccctgcaccatgagcctcggctccggccccgttas

SEQ ID NO: 9766 - DNA, 284 bp, Homo sapiens
  misc_feature 10..11: n=a, g, c or t
actctatcgnncaggctggagtgcagtggcgggatctcagacccctgcaacctctgcctcctgggttgaagcaattctcctgtctcagcctccctagtagctgggattacaggcgcccgccacctcgctcggstagtkkttkkatttkaggcagaracggcgtttcaccatgttggccaggctggtctcgaactcctgaggcaagagaatcgctcgaacccaggaggcagaggttgcagtgcggcaagatcacgctactgsastccagcctgggtkrgagagca

SEQ ID NO: 9767 - DNA, 76 bp, Homo sapiens
attttccaaagccatggtgaaacatctctgtgctaatttcttttgttttgtttcctaatttttttttttttttggm

SEQ ID NO: 9768 - DNA, 135 bp, Homo sapiens; identical to SEQ ID NO: 9735

SEQ ID NO: 9769 - DNA, 466 bp, Homo sapiens
attctggggttcgtttagaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaagaccgtcactacataacttcaaaaataatcaaccaccctcccttcccaaaccacccaaattcacccatccctactaaaaatacaaagattggctgggggtggtggcacgcccctgtagtcccagctatttgggaggttgaggcaggagaatcccttgaacctgggaggtggaggttacagtgagctgagatagagccactgaactccagcctgggtgacagagcgagattgtcttaa

SEQ ID NO: 9770 - DNA, 440 bp, Homo sapiens
agaccgctctaaaaccgagatgactagaggttccgtttaaccgattcctgcctgggaagcgtcagaggtggggatctcggggcagcctgcattccagctctacctgggattgtcgccgtgcacatggctggaggagcgtctctccgccactgcgcacattttgcagcctgcaccggccaacgcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttt

SEQ ID NO: 9771 - DNA, 407 bp, Homo sapiens
atgtactgtatgtggagcagtgtacagtgaagcggaggcagagcgggtccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgcgcaaagaaacttcttga

SEQ ID NO: 9772 - DNA, 443 bp, Homo sapiens
  misc_feature 311: n=a, g, c or t
ctgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagatmncatctgtgagtgcttactggagcatgaggagcaagtcttgagggatgcacctatggattccattgaatgggctgaagtggtgatcaatgtgaacaatattctcaaggatatgctgcaggctgctagtcatta

SEQ ID NO: 9773 - DNA, 89 bp, Homo sapiens
actcactttctctgatggttttgaaggcctggtgttcgctgatttcacgtttccttaatttcttctttgtgcctttttttttcccttty

SEQ ID NO: 9774 - DNA, 151 bp, Homo sapiens
aataagaggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaaam

SEQ ID NO: 9775 - DNA, 424 bp, Homo sapiens
  misc_feature 10..11,368,374,377..378: n=a, g, c or t
actctatcgnncaggctggagtgcagtggcgggatctcagacccctgcaacctctgcctcctgggttgaagcaattctcctgtctcagcctccctagtagctgggattacaggcgcccgccacctcgctcggctagtttttttattttagcagatmcggcgtttcaccatgttggccaggctggtctcgaactcctgaggcaagagaatcgctcgaacccaggaggcagaggttgcagtgaggcaagatcacgctactgcactccagcctgggtgagagagcaagactctgtctcaaaaaataataataataataaatgatgaatgrtttatatttkcktcttcttgcttactgatattttctaattnrtkkanvanngtgaataaatgtkgcttctctaaaaattttttttcaataaaattaw

SEQ ID NO: 9776 - DNA, 248 bp, Homo sapiens
  misc_feature 188: n=a, g, c or t
attatctgtactcttcccggggtgggtctaggtctggctcctcctgaggtcggttgtccacctcaggggsargaggscarggggtttyctggggggctgggggtcctgccggccaagggtcgtcaggccggggaggttgaggaggatccgttctaggcggttcagggggccagactccagtttcagmnccacccagccccagccccaggaggaggagsctgtctggatggacgcagcctaactgaccc

SEQ ID NO: 9777 - DNA, 322 bp, Homo sapiens
  misc_feature 86: n=a, g, c or t
aaaatttttttccttccatttttcttaaaaaagaaagaggccgggcgcggtggctcacgcctgtaatcccagcacgttgggaggcngaggcgggcggatcacgaggtcaggagatcgagaccatcctggctaacacggtgaaaccccgtctgtactaaaaatacaaaaaattagccgggcgcagtggcgggcgcctgtagtcccagctactagggaggctgaggcaggagaatggsgtgaacccaggaggcagagcttgcagtgagccgagatcgcgccactgcavtccagcctgggcgacagagcgagactccggctcaaa

SEQ ID NO: 9778 - DNA, 68 bp, Homo sapiens
agagctgtaaccaatctcactgtttccgtacctcacttctgattcctgtacgtcactttacctttttt

SEQ ID NO: 9779 - DNA, 399 bp, Homo sapiens
aacgtcttcttttactcagcaaacacgccttcactcctcctctgttaatgcgtctcccacgaggcatttacgatggctggarggcaaatctcttacccagaggaatgaaagccttcttgaaaatgacctacacatgaaaaagtaaattattggatccaggcaaacattacacgcagacaagaaaagtgtaatttctttgcagtaatataggattttttgtgcagattcatctaaaagcctgtctaagtgactaaaagtaaaaggaattctgcacaagtgatatggtagaaagcaggtaaaaaacacagccacaacaaccctgatgctctggttatgttttcgctttcggcttgactgacttatgaattgcctgctggatttgtggatgtactggatatg

SEQ ID NO: 9780 - DNA, 542 bp, Homo sapiens
  misc_feature 464: n=a, g, c or t
attctggggttcgtttagaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaagaccgtcactacataacttcaaaaataatcaaccaccctcccttcccaaaccacccaaattcactcatccagcgtttacttttaaatccactcagaacttttttctgcgacccccctccctaaatggagttgggttggggggaaatgaatactgagttggcctttattttttaaaagactttttgatccaatkaggccccctaaataattgagttttgggtcctggttggttvgnttattttttttcctccaaaattttaccccctcccccctgagcccgaggtgctgacgtcgcaaaaaaaaaaaaaaaaag

SEQ ID NO: 9781 - DNA, 153 bp, Homo sapiens
actctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagc

SEQ ID NO: 9782 - DNA, 431 bp, Homo sapiens
gaaagctctacaagatggcggcggtcggggccgaggcgcgaggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctac

SEQ ID NO: 9783 - DNA, 353 bp, Homo sapiens
cagggatggccagcaaaggggcacaaggaatcttttagagttgataaaaatgttctgtatttttattgtgttggtggtttcatgggtgcacacactgtcaaaatgaacactgaatagatacaattattgtatgtaaataatatcttgctaaagttgattttttaaaatacagaagatagatccatatctgaatatagttcatgtttaaagatcagatcattttattaattgaaatcatttcaagttatagagaagtatataccaatattttatttcttgtaattgcttcattgcaactttaaaatacatcatcactcttagaccatcatagtaagtacaggaaaaaaaaaaas

SEQ ID NO: 9784 - DNA, 346 bp, Homo sapiens
gtgagagtcatcagaaacaacagcaaaatcagcttgtaaaaacttttgatattggatgatcaattatagatttattttataaatatatagaatgtatttaacattgaaagtataaacaggagaatataaaaactgacaaagtagatctgaacaattagaataactaaaaattaaaaattttaattgaaataaaaaatcaaagggactagttagcatattaaaaacagatgaaaatttaacagtaggctgtcatgaccaaaaaaaaargagagagagagrgagaaaatcagtccagtcacggtggcatatccctgtaatcccagcactttgggaggccgaggcaggt

SEQ ID NO: 9785 - DNA, 435 bp, Homo sapiens
agtggattcatcaccatgtgtgggggcagaaactacttccactcttaccttccatactgcataactgccagatagacaacttctgcctcacacttaaggccccaaaggaacaagaataaaagcaatacttagattatcaggaactacaatgccaatgaaggaatgacaaccatcattgttgtcaacaacatgtcaacaacatcaacaaatagaaagcattcctccattcatcactccttctgggaagaagtagactaagaggtaagaagcaactaatttttcatgggatttgaaactaagtaggtgaatctgaagtctgcgctgcttccattccatcccattgtctcttctgagggagaaagcttctaagggagaaagcctttggggcttggaacaaaagaagccagattctttagagtacacactccgtacttc

SEQ ID NO: 9786 - DNA, 380 bp, Homo sapiens
ctccaatcgccagccctccaaccgcctgccctccaatcgccagccctcctggcttccatctcctcccagctacctgcagtgccaccaggtttatcaccttagagcatccacagccacagttacccagagagaagagaaggaggagacacagggcttggggacgaaggcattcaaacaggcaggtcctcccacgggaatcccgtgacggccgactccacgaccacttccccagcatgactagatttcctgcagcttcgaaatgcaaacattgcctcagacaaaagctaaaattgttacagtcagaaccgaaaccacgagtgagaaggggctctgctcccagtacccacagccacggggagccaccgaccagcacgtcttac

SEQ ID NO: 9787 - DNA, 362 bp, Homo sapiens
aaggagaactgaggcaaaactaacaggcagcagcgactgcccgctcatagctgccagagatactatcctgcaggtttttttcagaggtaagaacaggaaagacgagagaacacgagaaaaccagcaattaaacggcaagcaaaggaataaccaccaagcaatgagtgatccaacagagatttatgtagaaggatgctaattgcaacaataagtgttacatttaaaagagaaaaactggaaacaactctaggatccaacaatggagaaaatggttaaataatgcattattccagttggagatataaagcagagaaccatcattctcaaaactgttctgagagtcagcatgtcacctctttcam

SEQ ID NO: 9788 - DNA, 500 bp, Homo sapiens
  misc_feature 159..161: n=a, g, c or t
catacagattaatttaatataaatwtttttttattatactttaagttttagggtacatgtgcacattgtgcaggttagttacatatgtatacatgtgccatgctggtgcgctgcaccactaactcgtcatctagcattaggtatatmtcccaatgctannnactmcmccctccccccaccccaccacagtccacagagggtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcatttttgatggctgcatagtattccatggtgtatatgtgccatattttcttaatccagtctatcattgttggacatttgggttggttccaagtctttgctattgtgaacagtgccgcaataaacatacgtgtgcatgtgtcaaaaa

SEQ ID NO: 9789 - DNA, 429 bp, Homo sapiens
aaaatcttcggagtttgttcagtctatgggtgactgttggaaccctaaaataacttaaagtagaatttggtcatttattgtttttttttattaaaaggtccaactgagaacatccctgaacatctgaaccagaaatttgacatagagctctaaatattcactcattcattcatgcaacaaatatttatttatcaagcacgtcaaccatccaaggactgttctaggtacacatagttgatgtgatgaagtcagcaaatctgccttcacatggtctgcattctagtggagaagtcagatagaggatgtttggagcatgccagctagaaagaaggcaaacaagaaggacacaacaatagcaagtggaaagttctagaggagcatcctgcattggcgatacgcactgaggatctggcaaggtagacagtgggc

SEQ ID NO: 9790 - DNA, 375 bp, Homo sapiens
agttgcttgtgtcgagggagggagggagggaacagagggtgcgcgtgtgaaagctccgcccccagccctagctcctccttcccgcttcagcaggtccaggctctgcgccagtgcatccttctccaagagtgcgctgcctgggcccgcttgccctggagttaacttcagcagtcaacggagagaagagtggaaaccttactggatgcggacaggagagccagttactgaaagcagatataacgcggatcctgtaaagagtgaaaggagaagaccacttttagttgcctccctgctagcaccctgacttgctctgcttgaataagaatccaaggacacaagctaagacatttgcactgggkttagatctactgcgat

SEQ ID NO: 9791 - DNA, 425 bp, Homo sapiens
gaccgtgatggatgtcgtcgaatattttactgaggctggattcccggagcaggcgacagctttccaagagcaggaaattgatgggcaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcacctcttgtccttatctttgccccttgtgtctgtctcasacacatctgctcctcagcacgtcggtgtggggagg

SEQ ID NO: 9792 - DNA, 299 bp, Homo sapiens
acaaggataatttagggatttataaagttgtaaggatttcactgttttcggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgkgc

SEQ ID NO: 9793 - DNA, 356 bp, Homo sapiens
agctctccataaaatagaccaatcagcaggatgtgggtggggtcagataagggaatagaagcagactgcccaagtcagcagaacactttgctctggtacggttctgcggtgtggaagttttgtttttttgatctttgtaataaatcttgctggtgctagttctttgggtttgcactgcctttatgagttgtaacagccaccgcgaaggtctgcagcttcactcttgaagccagcaagaccacaaacccaccagaaggaagaaactccgaacacgtcggaacatcagaaggaacaaactgtggacacactaactttaagaactgtaacactcacggcgagggtccccggcttcattc

SEQ ID NO: 9794 - DNA, 456 bp, Homo sapiens
aaaaacctagatggtatagcctaccacacacataggctatatggtattgtatagcctatagactgcttccaggccgcaaacctgtatagcatgttactgcattgaatactgtaagcaactgtaacacaatgaggcacggaagcgcatccgtggaaatccatcccttccgacttccttacacctatacaaaagcctgcatttgatgcccaggactccagatcagtacattctgtgacaactaaggcacagtggaacaagaagggcccaaccacataaagctccaggagagtaggaattagtcttgctctcaaggacattcctggcacccagcagaatacctagcctagtaggcaacaaatgaatactggatgaataaatctatgaatccatcaagaagcaagcttgagaatgaggccaaaacacagaggaaggcaaaagagcaatgaagctgagcaa

SEQ ID NO: 9795 - DNA, 385 bp, Homo sapiens
  misc_feature 302..304: n=a, g, c or t
aattttttttttgacggagtctcgctgtgtcaccaggctggagtgcagtggagcgatcttggctcactccgcctcccagcaggggcggggtttcaccatgttagccaggatggtgtccatctcttgacctcgtgatccgcctgcctgcgcctcccaaagagctgggattacaggcctgagccaccgcgcccggccgtacagtttgtattctaacaccaactcataagggaataaaccagggttacaagtgttgctgcctcaccatggacatcccacaggacaatccactgaacaaataaaannnwtgtgtagatccaggatacttttcacttcctaaacataaatcccaccacatctgttcaaccagctctgctccaggataaaa

SEQ ID NO: 9796 - DNA, 374 bp, Homo sapiens
aatttaggaccctctcaccactaggttaggattaaactccgcatctttcacttcgaagtgaagagaaggaatcccggaggtacaaagtattttcagcaggcgctttgctcggtgcactcctctagatagctcaacgaggagccagccccgtggctcaagcacctgctggcttgcccaggtgctgctcgccacgagtctgttcgccttgtcctcacgcccctgtccacagatggatggagttaccgaacggcctccacgccgcgcttcacttatccccgctcacagcccatcttcgggctgttcataatgttctgacacttttatgagtyccttgctctctgccaggacaggcggtccctcgaaatgtgcagtga

SEQ ID NO: 9797 - DNA, 446 bp, Homo sapiens
ascaggtgctgcgcatgcggacagcggatcgcaaggggaaaagaccccggamatcatatgaagtgtgcgtatggtacctattggagctatcttgagcccatataaagmgtaagctttagaatgacggcgactcacagagaaagctaagamtcatcagamaatgaaaatcgatgtctctgaagtctctcttcagccaggaggcttttcctattgaagcactctggggcacattgatttctcctatgttttaacttcaaacatggcatcatctgaaacctatattttgattatgggtttgtctgcaaggtttttttcaaattggcacaaatttccaaaaaggtttctgaaatatttattgaaaaaaaatccacatatcattggagccacaccaatcaaacctgtgttgttcaagggtcaactgtattcyctaaagtctcaattcatga

SEQ ID NO: 9798 - DNA, 375 bp, Homo sapiens
  misc_feature 103: n=a, g, c or t
gaaagatggggacaggccaaagaaaaaagtgactttcaactcttcttccatcatttttatcatcaccagtgatgaatcactgkcagttggamsgacrgcgacnaaamccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattattttaattcaacgggtgctttacataatgaaaaaaccacttgt

SEQ ID NO: 9799 - DNA, 425 bp, Homo sapiens
cagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgt

SEQ ID NO: 9800 - DNA, 405 bp, Homo sapiens
gaaaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaagg

SEQ ID NO: 9801 - DNA, 462 bp, Homo sapiens
tattatattaagttccatttgtaactggttctgtatggtgactggcgaattggagtgcttctttctccagcccaatcagggcatggagtatgagaaggaggcattaataaggttacacaattagaatgagagctgttctgttcggtcacttgaactcactttgtccctgctgaatgtaaaaggctaagttctattcaatttaatttatttgcttgaacctgacagctgtctttcagtttttattgtattcccctttaggctggtcaatttctgacaaatgagaaaaaatatgttaatcactgagtgtttgattattggatgatttgtgtattttagttattgtctagatttggacttgaagataaaatgacctggtaaatttcatgaaaaagaacaaattggaaaaaacctctttccctgtttacatctcaatatatcatttcctataatgcttctgtaatc

SEQ ID NO: 9802 - DNA, 91 bp, Homo sapiens
aattctcttgcctcagcctcccgagtagctgggactacaggcacccgccacctcgcccggctaatttattttggcattttttttttttttw

SEQ ID NO: 9803 - DNA, 236 bp, Homo sapiens
acatttgagtccctgtggaccaaccggaacacaacttaataggcaaacatgattgaaacctaacttaggactaagttagttaagtcttggccaatcccagcagcagtacgtcaaccactcatacactgctgtgagtgttcaaactgtgttcaagtaaggcaaacaccaacctataaccaatccagccgttttgtacctcacttccaatttctgtacgtcactttccgttttttttk

SEQ ID NO: 9804 - DNA, 254 bp, Homo sapiens
  misc_feature 122: n=a, g, c or t
acattagggggagcatcacagcagataaagctagagtttttgcaggagacagaaggaaatggaaaggggagtctgatccctgaggtggactatcaagatatggtgaggaggcaggaggsddnattgagtatattgacattggaccgatacttctgagactggagagaaatgaaaaaaaatctactcatctggatgcataaatcaattaatgttatctgttaaatctattaaattaattaattgttttctattaa

SEQ ID NO: 9805 - DNA, 351 bp, Homo sapiens
  misc_feature 118: n=a, g, c or t
aaaataaggccgggtgcagtggctcacgcctgtaatcccagcactttgggaggctaaggcgggcggatcacgaggtcaggagatccagaccatcctggctaacagggtgaaactccanctctactaaaaatacaaaaaattagctgggtgtggtggccggtgcctgcagtcccagctactcgagaggctgaggcaggagaatggtgtgaacccaggaggtggagcttgcagtgagccgagattgcgccactgcactccagcctgggcgacagagcgagactccgtctcaaaaaaagaaagaacacaaataaaaaaccggsctcctattttgtgtacacagtccctgtacar

SEQ ID NO: 9806 - DNA, 425 bp, Homo sapiens
atcctatcaaaagttacggtgaagtcagggtgggtggcgagtccctgcaaggtcgcccctctgtgccaacacagcctgatggcttcttgtttcaggaaacatccagaattacaactgaccattgagttattacatatcaattgaacaaggtagttttaaaatgaaagaaaatcttgcaacatgaataaagagatagactctttgaatctggcatacagctttcccttccttcttcctgctttcctggacacaccgtggacagacccatttccctctggattcatggtaaggtcccgagtgcttctgatacagctgctgagcagaccccgctcatctcaggagtcccgaggacactcgcttccctgcagcccgtccgccctccataagcctgggggcatctgscctgcagcactggggaggagcas

SEQ ID NO: 9807 - DNA, 68 bp, Homo sapiens
attcagataaggatgttgaagataatgacactaaatctatggacacacacacacacacacacacacas

SEQ ID NO: 9808 - DNA, 394 bp, Homo sapiens
  misc_feature 348: n=a, g, c or t
aaaaggaacaggcagaaaggagaaagaaggtatctaaagtaaatggccttatgtataatcctgaattataagtcattgcaaaagaatcaggcttgtgggctacttctctgacagagccaaactctccaattcaattattctgagcaaaacaaacaaggagggggaccctcttacggattaaagacctctttgtgatatgactggcccaattcaattgcctaagcatcacgtagaaacaatagttcaatacttcaaaggaaagtttcagaaaggtgatgaaaktkaagctgggctttaaaggctacatcaaatttgacaaatggaattgtgaggraaagcacatagaangtaaagagtgaacccacaaaaacaagagavcatcatgtttctagag

SEQ ID NO: 9809 - DNA, 463 bp, Homo sapiens
tgttactcataatttttaaactcatatattcagactttctgtcaatgtccagtattaacaaacttttcctgttttccatccaacaaaaataaaaatcttactgtgccttttctttctcttgttttcagactatgggggattgccatcctagatagctatgattatattttcacaaccaacacctatataaatggggcaatatgttttcctggtttctttcctcactactgttttttctatctattttcttttttaaaaatatatattttattggccaggcgcggtggctcacgtctgtaatcccagcactttgggaggccaaggcgaacacatcatgaggtcaggagatcgagatcatcctggctaacacagtgaaaccccatctctgctaaaatgcaaaaaattagccaggtgtggtggcgggtgctgtggtcccagctactcgggargctaaagtaggaga

SEQ ID NO: 9810 - DNA, 368 bp, Homo sapiens
aactgcaagctccgcctcccgggtttacgccatwctcctgcctcagcctcccgaggcaggagactagagtagctgggactacaggcgscccgcacccaagcccggctaattttttgtgtttctagtagagacgggatttcaccatggtctggatctcctgacctcgtgatccgcccgcctcggcctcccaaagtgctgagattacaggcgtgasaccgcgcctgcccaggagaaacttaarhstatagtttgtagtttaaacaaagatggtaacagccttttcccaaagcagacctccttctcgcctggagactatattgcctttgtaggactaacagtagccacaagattggaaattatggtttaag

SEQ ID NO: 9811 - DNA, 62 bp, Homo sapiens
atttccaaagccatggtgaaacatctctgtgctaatttcttttgttttgtttcctaattttt

SEQ ID NO: 9812 - DNA, 502 bp, Homo sapiens
tttgtagatttggcccgagaaagtgcctggattttacaacaggaagatacagatcgaccttccatatcaagtaatcggccctgggggctggtatccctattgctacaatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtc

SEQ ID NO: 9813 - DNA, 500 bp, Homo sapiens
atgccctcaggatgtaatacaagatggaggcttgatttcacaaccaaaactttccagagaatatagtgatagatgttggaggtccctagtctagcacaacatcttctaaaagaaaatgaaacttttaaaagttaactaccaacagggtagagagaaaagaaaagaaacagtttaaaaatacctgaggaagagcctctcattcctatgcaactgattcgtccaccatggagattagttcaattattgtccaatggagtagaaccccttggctggggtaggggaaggagaagaccgcaagctggctctgcgaagacccttgagccacgcgtcccagccccagcatgaagcagtgatggaaggaaaatgtctgggaagccccggtggaatgcaacaggaagatagcaacagcatctatctcaaagtgtgtccggaattggtgggttcttggtctcactgacttcaagaatgaagctgcggaccctcgcagtgagtgtcacagt

SEQ ID NO: 9814 - DNA, 500 bp, Homo sapiens
agaaacatcttgctctagaaatggaagaggcatagggcctacagagaattacataacaatgtcaaaattgtttaaagggcacccttgaacttctatatggtctccaaagacatgataaatacagagattgctctctcctctcaactgcaacagtaatgattscytttgcattttaattaagtcttttacacatgaataagtctttatcctcaaatggactaaagactcctcgaggacaagaactatccttcagtcccatacattggttacctggcaaaggaccctaaatgcagtctttctttattacacaggctggactcaaactcctgggctcaagtgatcctcccaccctatgctcagcctccaagtagctggtactataggtgtgcaccactgcacccaacaaaaaccttaatagaaaggaaatgagccatgactactgaaaattaagactagctattatccacaagaggtgctcgctgcctctttgcagaagtgat

SEQ ID NO: 9815 - DNA, 416 bp, Homo sapiens
agaacattccattccttgcactaatctcttgagtttgactgcccatcgggagctttgctctcaggtggatttctgagaagagaaagccaccatttgcttgctataccctggggccaaccagctgccaagtgccagctgaacagaggtgtatcaagaggcctgcagtcaaaaggcagcaggatggccaattgccatcaatttctgcagcaagtctggcatcatggcatcttggcatcttgctgctctccccctcccccagatgccactgtggttggatggcatcccaggaaagatgtgaagtgctactgccaggaatgaatgattggcattgggtaaagcaattctctgaactcagccttggcataccattaattgttaagtctgttctgctaccaccaacctcttgtcagaatcat

SEQ ID NO: 9816 - DNA, 370 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggs

SEQ ID NO: 9817 - DNA, 471 bp, Homo sapiens
tgttgtagccatggagacctcagatttggttgaaataaatagacaaaattaaaacctgcacaaaaagttggtatcagaacaaacaatattgacagtttatatttcaagagtattttgtctgaggaaatcaatcattctacagacatgacctcattctgatctctcaggtagcaaaaggacagtcctgccttcctctaagatcctcaaaggactcatggtgacgaccaggctgtaagatccacaagagtagagacaattgctggccatgcttatcactgtggacccaaagcctgaagtagcatctggttcattaaacacatgatgaatatatgttgaataactaaatgaatgaaaacaccgttcttcaagctcccactaacaccttaccactctctaccatgtcaacttattttattataacaattgctcatcattaaaccgtatggtcctggaagaaaaagactgttttta

SEQ ID NO: 9818 - DNA, 400 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgac

SEQ ID NO: 9819 - DNA, 472 bp, Homo sapiens
tttggcagagaaacttagaagagggcatttctgttaaagaatctcctcatacttacgtagcttaaattcactttgcttttcaattggtgtatttataaggcacttgtcttccaaaagtagatttgtatttcgatgataatggcaatagtgctttctttgtagaacctatctgtgtgatcttggccaaatcagactgggtgaaacatagagcacacatttgcttcttctgaatggtgcttcatctcagtggctgagccacgtggatggcattcagaaataacagttgtgcttccacacagcggtgagccaatccccagtgattctaaaggctgaatgttctggttctgcaaccaaatgaatacaattatagatacttagccgaccctgactaggtttcattctttcattaattaacacatgtattataggcacttatttgggcactgcagagctgctgtagattatctaaagk

SEQ ID NO: 9820 - DNA, 482 bp, Homo sapiens
tymwkgraratccycwactttccaatcgtgggctggtgatgttgacctccttagcaaatgtaggctaggcagtctaatttttagccatattgtggaacaccagggtttcatttgtatttcctgtttggttaaactcatagttttgtccttcccttaattaaattattcttttctatagggtaaaaccttcttcccaaagtcacccagaagcttctgaaagatgtttggaacctgagggtgacttttcaatgaatgagccgatcacaccaaactcctgtaactttaaaaattctgcwattcyccygrgawatmyggcmaatttaaatggtatataattacagtgcccawagtgtagactggcagtccttttcctgtgtcctctgaagtgcttgtctgatgtttcgctgaaagacatgaaagwgtagtcatgccttcagcaataaatatttgcttcacttattgtaaagaaaaaaaaaaaaaaw

SEQ ID NO: 9821 - DNA, 441 bp, Homo sapiens
aattcagatttaatccttgagtgaaatgagtcactggctcatccagttaagatcatcacccactttcctaacaaaacttctcttcaaagaaggactcgctcatccatcaggtggacctccacaggaacaaatcatatccatgtcaggcggcaccaaacctaaatctgcttctgcctcagcagacaggacatgttgagtttggccagtgagtgctgcaggatactggagggaggacaacagagaggaaggtcacctacatgtctatgttcagaagctgccttgatgccacatgcgggaggctggaaacgsytgaaggttgmcmastgctcagcagcagtctaccagtgatggatgagagttggtgcacaaataccccagctcccttgcctctcagtttggataatcctgaaaaggtgtgtactatgctatttctgagattaa

SEQ ID NO: 9822 - DNA, 444 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaargtcaggktacccacaargggaaggcccatcrgactarcagcagatctctcggsagaaaccctacaagctagaaaagagtaagggccaatactcaatgttcttaaagaaaagaattttcaacctagaatttcatatccagccaaactaagcttcataagcga

SEQ ID NO: 9823 - DNA, 237 bp, Homo sapiens
aaagttctccaagtcctcactggacccagcagcgcaaccggcttcacctctcgcagtccaggcgggactttgcggcacctgtcccaggcactcctgcttcccagagggagggcttcccagccaatcaagaggaagagaggagaagctagtaacmsaaaggagacsmgmcatcgtggscaacgacamcgcgaagasggaagggcggtccatgcacgaggacccagcgtccaatcaagc

SEQ ID NO: 9824 - DNA, 79 bp, Homo sapiens
tgcaacgagaagatggccatctgtaaaccataaagtgagccctcaccagacaccggatctgtcagcaccttgatcttgg

SEQ ID NO: 9825 - DNA, 452 bp, Homo sapiens
tgacaaaaagatgatgctaatacataaagagtttttacaaattaaaaataaaccagagtagttccattccaaaaatggagaaagacaataaatagacagttcaagaaataacacatataaatgtcagttaagtatataaaaatctttaggccgtgcgtggtggctcacgcctgtaatcccgacactcttgagaggccgaggcaggcagattgcttgagtccaggagttccagaccagcctagcagcatggcggaaccccgtctctactaaaaatacaaaaaattaacccaggcgtggtkgcakgtscctggtggtccaaggctactcgggagcctggggtaggagagtcacctgagcccagggggagaggttgcagtgaggcaagatggcaggcaccactgcactccagcatgggtgacagagtgagaccctgtctcaaaaaaaaaaaaaaw

SEQ ID NO: 9826 - DNA, 155 bp, Homo sapiens
attcaaacgatgccaaaggggcggcgcggcascacagccccaccatgagccagcggtcggctccgcccctctatttcccgtccctgtacraccgcggcatctcctcgtccccgctcagcgacttcaacatctggaagaagctcttcgtgccgctg

SEQ ID NO: 9827 - DNA, 438 bp, Homo sapiens
aacacagggagctctaccatcaagtgaggggaatgcccaccatcgctatcatcaccatcaccactacttctgccacggccatcacattcacctctacctccaccatcaccatcactactcaagttggagaaatagaggccaggggaaggggataaagggagggcaaagaaaggtaattccaaaggaacatgagcaccaataatgctttaagatgtgattctgggtgtcatctgtcacatttgtaaaatgagtatattatcacacaatccttcgcaamtgtgscagsahtttcccytaggmaawytgcaamcttgagttttcaggaaaacagtttacatgagaaaaggcaagttctttcccatttcgaatgaagtaccattaaactctgtcacctagtgaaaaataataaaaatacttgcaacttttaaaaaaaaaaar

SEQ ID NO: 9828 - DNA, 463 bp, Homo sapiens
gaatcacaaaccactaggtcagagtagagctatttacaatcgtgctattggcaagccatccgcttattctaaggaatcagccaaaatcctttagagctgtttttgaaactgcttttaggacttagtatgttcttctgatccttttcatctagaaagcctatgtcttggaaacaatttggtttctgaaaataatttttgatcatttgatgttaagtcttgaagtaagcaggtagccggcaattctgaaagggagggacgcatttggattggawtggtcatcaamagccycaagggmhtttcscggttccttggcccaaycyccakgrgctttcccttggtcaagggcatcctcagaaggcataggaagacaagactacatgtctcttckgttcttggatcggtctttgcttcattcatggcacacgcatttcctgaatgtacaaagaaatgctggcttgaacaa

SEQ ID NO: 9829 - DNA, 487 bp, Homo sapiens
  misc_feature 300,310: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaawtgttaaggcagcaaggagaaaaggcmmggttwscccamaangggraacccnwtcagaytaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagat

SEQ ID NO: 9830 - DNA, 479 bp, Homo sapiens
tgcaagagaagccaagacaagaagagggctttatttctgatactagaatcagccttcctcccctttattctctaggggacatttttctttgctgactcatctgttcagaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgracagrcaattwamccccawtyavaawbssgyccgtyactgggahctacvgtcatagsgccccacaggatgacctcatgctcatcaagctggctaagcctgccatgctcaatcccaaagtccagccccttaccctcgccaccaccaatgtcaggccaggcactgtctgtctacactcaggtttggactggagccaagaaaacagtggc

SEQ ID NO: 9831 - DNA, 79 bp, Homo sapiens; identical to SEQ ID NO: 9824

SEQ ID NO: 9832 - DNA, 426 bp, Homo sapiens
agcagaacttgcagatctattacagatgtaggggtgaggagtgccagggtgactcttgagtgtctggcttgagcagctaggcaaatgatgtggatcaaaaaagcagcaggttgcagggaggacggcagtgttaatcgaaagtcatgttctgtaagttttaggttcgatacgactctgagcggagatgtcaattagtcaaccgaatgtcaggtgtgaagatcggcacagagggcagaaccagagacattcattagagagcaaacaggtagagggcacttaacctataggaaggatgcactcatatagagcgagaaaagggccagaaggagcctaatgagtagagaaagacaggctgaaaaggacatcdgcgaggtcagagaaatacctttagggtgtaattacgcctacgcgagtgggtaaaatgag

SEQ ID NO: 9833 - DNA, 369 bp, Homo sapiens
atttttcaggacttgtattcaatcagattgcactagtacactttcaccaggcattaaaatgttgatatcttatattacttgttggtaaatagccgccccaaaccctcagagtacccccctccagttgtcttgtccacattggccattcccccagaaccctctggatctcatcacaatctaactcctaaaaaggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacag

SEQ ID NO: 9834 - DNA, 500 bp, Homo sapiens
gaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttac

SEQ ID NO: 9835 - DNA, 343 bp, Homo sapiens
ctcatatgacctcagcgattgcatgatagtagtaaactagtctcctggaaataatggatgtaggtgcttctagaatatgttacagaatttcagacttaacctattaatagataaatggatcttgacttaaggtgacaaaatgaaacttttattattgcttaaaaatgctgtgccaatattgtataactagctcctctaatacttttggtattttggatttaataataagaccttaagcattttaaatgtgaacatgttcagggaagtatgctttgatgtaaatgtctcagatctaagttgtaacacaattgaatacttgtggcttattcttggtttaacttag

SEQ ID NO: 9836 - DNA, 497 bp, Homo sapiens
gaggggtgggtacgacccgcgcacgagccggtgccatctgtgggggctttgggccaggggtctccggacagcatgagcgtgggcttcatcggcgctggccagctggcttttgccctggccaagggcttcacagcagcaggcgtcttggctgcccacaagatacatggctagctccccagacatggacctggccacagtttctgctctcaggaagatgggggtgaagttgacaccccacaacaaggagacggtgcagsacagtgatgtgctcttcctggctgtgaagcacacatcatccccttcatcctggatgaaataggcgccgacattgaggacagacacattgtggtgttctgcgcggccggcgtcaccatcagctccattgagaagaagctgtcagcgtttcggccagcccccagggtcatccgctgcatgaccaacactccagtcgtggtgcgggagggggccaccgtgtatgccacaggcacggcacgccc

SEQ ID NO: 9837 - DNA, 72 bp, Homo sapiens
haaaaaaaaaaaaaaaaaaaaaaaaaaaaaaaaaaaaaaaaaaaaaaaaaaaaaaaaaaaaaaaaaaaaaaa

SEQ ID NO: 9838 - DNA, 507 bp, Homo sapiens
  misc_feature 423: n=a, g, c or t
acgcccacccggaactccagctggctcttgctcgcagccccggttcccactcgcacctctccctccacacctcccagcaagctgagggagccggctccggccttggcagcccagaaaggggcagwggwggcgcagagagcgagcgagggctgtgaggrctgccagcacgctgtcatctctcagcaacactcttgcattgtgtagacagtgcagtttcctgtgcatgaagctggggaaggcagccgtgtctgaaccagtccgtccatttccaacgacttcagtcgcaggcctagacggaacgttcagtgtgaggaagcatgtgtgagccagcgaggagacagaacacacagcaaacccgtgccaagtcagcaatgcattttctttagcactttgtacagttgttctgaagtaaaagaactgttnktagaaataraacaaaatattataaaagcttcacaatcaatttgaaacaaaccatggatttaaatgtgcaaataaattttaaaa

SEQ ID NO: 9839 - DNA, 574 bp, Homo sapiens
  misc_feature 531,534,536,538: n=a, g, c or t
aaaatgatttgtttcaatggattttacagaagtcatctgggcttttcaacaaaatagattcctctctccattgacctgaattgccttaactgccaaatgtctgggtctttgcttagtaaaagatagacacagggtgcaattcttctattttgtatccttgttccctttgtcaattgaacgtctagttgggcatttattgctgaagcgcactgaaggcaatttcagctgaaggttattaaaacaccaagtgtgaaaatctggaagaagttaaggtggagaacaagtacgaagggcctaagaggaagaatgcttgtctcatttaaagcaaagtcatgaggctgattggctcctgaagaaaagctgaagggaagggtggaaggaggtaagatgagcaacgtaacgatgaactagaccctggaaggccatgtagaccattcaagagctccacagattggacctagatattaaaacagaatgagatttctgactgtctacaagattttgccttgagttactggaaaaaaatggagnghnanankyatttactgagacagacaaagatgcaggcagactt

SEQ ID NO: 9840 - DNA, 303 bp, Homo sapiens
atwctggcggctgggcacagtggctcaagcctgtaatcccagcactttgggaggccgaggcgggcggatcacgaggtcaggagatccagaccatcctggttaacacggtgaaaccctgtctctgctaaaactacaaaaaattagtcgggcgtmgtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaaaaaaaaaar

SEQ ID NO: 9841 - DNA, 78 bp, Homo sapiens
aatcgcccatttccaaagccatgaaaaacatctctgtgctaatttcttttgttttgtttcctaatttttttttttttg

SEQ ID NO: 9842 - DNA, 415 bp, Homo sapiens
aatcacagcactttgggaggccgaagtgggcggatcccctgaggtcggagttcgagaccagcctgaccaacatgtagaaacccccgtctctactaaaaataaaaaaattagccgtgggctgggcgcggtggctcacgcctgtaatcctagcactttgggaggccgaggcgggtggatcataaggtcaggagttcaagaccagcctggccaagatgatgaaacctcgtctctactaaaaatacaaaaaaattagccgggcttggtggttggcacctgtatgtaatcccagccactcgggaggctgaggcagagaattggttgaacccgggaggcggagattgcagtgagccgagatcgcgcccctgcactccagcctgggcgacagagcgagactcgtctcaaaaaaaaaaaaaaa

SEQ ID NO: 9843 - DNA, 214 bp, Homo sapiens
tctttgtgtggtgcccagataggggagcggaggtggcggcggcggcggtagggtggccttggttgtcttccagtctcctcggctcgccctttagccggcaccgctccccttccctcccccttcctctcttccttccttccctccccttccctaaaaaaaaaaaaaaaaaaaaaaaaaaaaaaaaaaaaaaaaaaaaaaaaaaaaaaaaaaaaaa

SEQ ID NO: 9844 - DNA, 529 bp, Homo sapiens
atatttgtctgtcctagttctaccctctgtggttaaactagcaagctataatcatttttccatatggaagtactttttctatttgaagagttttcaaatctctttggataatcttatcccagatccttcaactatttctcttgattttgagaacttcaccgtcttgatcactttctgtggaaaagctctgcttactgaacaactctgaatgagggaaacttaatcgacagcaacactactcttgtactttgggacttttattagataaagtaactgttccttgaacacaagcactgccataccagaaagtcgatgtgatcgcagaaagggcggctaagtgactcacaggtgaaaagctgttacagcgtggatctgctggacaaagggaagattcatgtcctgagagggacggaacctgacggcccaagatttcatcacactactcagaactgcagtcagacttcttgggagcgtaacaaaagaagactaagaatttgtcactagttgactgtactacaggaaatactaa

SEQ ID NO: 9845 - DNA, 71 bp, Homo sapiens
atttccaaagccatggtgaaacatctctttgctaatttcttttgttttgtttcctaatttttttttttttk

SEQ ID NO: 9846 - DNA, 424 bp, Homo sapiens
taaagcaccagggacacttcctacctcctcaggttgttgcactgtggctgcataatttaatgtgaagtgaatactcagaatatcagacccaaaaataaattagacagtgaagtaaaaataatttttggcttatgcttggttttctttgatcttaactgtaataataacaagttcaataaataaatgaattacttgcagcagtggcttaagatattcatagaagatgcaatttgttaacaaagtggcaaagagttccaaaagttgtataagtttggtgtttgtaattggagaatttgttgactgtcctttttagtttgtcatttagttaggatttactgagctgattaaccaaattttactaataatttaggaatcttaagggaaatttttttacccaaagatctgctaaagtagaagtataata

SEQ ID NO: 9847 - DNA, 455 bp, Homo sapiens
taatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgag

SEQ ID NO: 9848 - DNA, 339 bp, Homo sapiens
agatgaagggatatgctcaggatcacaaagcaaattattggcagttctataatagaaatcagcaacctaaagtactaaaacttgaggacttcttacaagaatactttcatcaccccccacggaaacaaaaaacacatgcccggctgggcacagtggttcacgcctgtaatcccagcactttggaaggctgaggcgggaggatcacaagtagagatggggtttcactatgacctcatgatccatctgccttggcctcccaaagtgctgggattacaggcatgagccactgtgcctrgccacggaggctacattcttgaaaaaaaaaaaaaaaaaaaaaar

SEQ ID NO: 9849 - DNA, 449 bp, Homo sapiens
tctctagtcagttccatcatgaagcgcagttatcagtgtctcatttcttcatacccttcccaagcccattgataattttcaggaacataacatgttactataggagagcttgggatccagctgactgaatgtttacagatgacttgatgagacccaagaatgtggcccttatgcccgtggaagcttttaattgcctcttttggaaactagttttgattcttcataatcacgtctgtttgaggacacagacgatcaatcttcgatcttcctcatctttctcaccttcctcactgaacacctaagatcattcagaatcaaagataagcacaatatatttatggccttggtgtttaaagtggagctgaagattactgcagatgcctttccagtaaagctaacaaaaaacaaaacaaaataaaaccacatccaaaatactaaacagctgtctc

SEQ ID NO: 9850 - DNA, 117 bp, Homo sapiens
gcaaccctctcaggtcaccttccatgctgtggtggctttgttctttccctctttgcaataaatattgctgctgttcaaaaaaaaaaaaaaaaaaaaaaaaaaaaaaaaaaaaaaaaw

SEQ ID NO: 9851 - DNA, 173 bp, Homo sapiens
  misc_feature 145: n=a, g, c or t
attcggtaaaaagtctagctggcgccattggaatatgggctgctagactcaatttctagttgatgtttgaggtgaggcaaaaataaagctaaagtagaaaacttaaaaaaaaaaaaaaaaaaaaaaaaaaaaaaaaaaaaaaarnvaaaaaaaaaaaaaaaaaaaaaaaaaam

SEQ ID NO: 9852 - DNA, 444 bp, Homo sapiens
  misc_feature 393: n=a, g, c or t
cgagtttcactatcttggccagggtggtcttgaactcctgacctcgtgatccacccacctcagcctccctctcttaatcttttattttattattattattttttaaatttaatagagacagggtctcactatgttgccccagctggtctcaaactcctggactcaagcaatccattctccttggcctcctaaagtgctgggattacaggtgtgagacaccacacctggccccctcctaatcttaaggactgctatgaagctggggtgcctatagtcccagctactcaggaggctgaagcaggaggattgcttgagcccaggagttcagggccagcctgggcaacatagtgaggctccaattctaaaaaaaccccaaacaccaataaacaaaangcgatatgacgaagataatcttgccgggcacagtgactcacgcctgtaatc

SEQ ID NO: 9853 - DNA, 387 bp, Homo sapiens
aatagggttgcaccatcccggaagctgctgttagctcgccggtcctcggcacgccgcccgttcgcccctgcgctgtccgcccttcccctagcgkttacttccggtccctcgctgagggggttcgtgcggctcccaggaggcgtgaaccgcggaccatgagcgtgggcttcatcggggccggccagctggcctatgctctggcgcggggcttcacggccgcaggatcctgtcggctcacaagataatagccagctccccagaaatgaacctgcccacggtgtccgcgctcaggaagatgggtgtraacctgacacgcagcaacaaggagacggtgaagcacagcgacgtcctgtttctggctgtgaagcacatatcatccccttcatc

SEQ ID NO: 9854 - DNA, 396 bp, Homo sapiens
agaatgttcaaagggtgcaaaatgaactacagacaactatccccggcacacaactcctatgttgtcagcactgttatcagcattagcaaactctcacttatgaatgagaacatgcagtgtctggtttcctgttcttcacgggaaattttaaaggaactgtggtgtgtgagacaaacaaataactgctacaacttgttggttgcttattaaatacctgactcaatgctaaatgatcatgtgctattttgttgcatttaatcttcacatcaatcgtacaagggcacagaccaaagcatgtcaggaaatgacaaactttattaaaagacttcttctgggctgaatacatacttattatttaattactggaagaaattatgtatacctatgacatttgag

SEQ ID NO: 9855 - DNA, 92 bp, Homo sapiens
tactcttatttccccttgttgtaactaagtggtgcaggtataagcatatccccagcattcctgtgtgtgtgaatgtgsactgctgatttgga

SEQ ID NO: 9856 - DNA, 439 bp, Homo sapiens
cattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatattattatgtttgtaaaattcattgcmgatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaaar

SEQ ID NO: 9857 - DNA, 440 bp, Homo sapiens
  misc_feature 135..137: n=a, g, c or t
ctaatccattattaagaaatagttatttcctcagtttcgcactcagagctctcaacaagctggctccaaagcaggatcacctcccactacttcacaaggcttttgcaacaattaaactggcttatttaccagdcnnnagaatctctatgaaaaatcctgcatttatgagcatggcagcattgtagttaaaacatctcttacatgtctacttgatcagtggtgggcacttgcggaggagaggactaagatagagatgatgatagttcagctatgaaatatccaaataaagggaacaaatgggagcaaaatggcagagtagcctacctatattttgtccctgtctagaacagccgttcccaacctctcgggcaccagggaccagtttcatggragacaattttccacagaaccgggggtgaggatggtttgggtatgattca

SEQ ID NO: 9858 - DNA, 429 bp, Homo sapiens
  misc_feature 324: n=a, g, c or t
agaaaacttgggaagccagggatttccagcgcagagagctggggctgtctgtggggtgagtaggggccagaaagcatagccagcgggacaggagtcctttgaagagacaccattgttgccaaggccacagcggtgcaggtcacaccagccagttacagggatcagagacccaaccccagaatcacattcctcatgacccatgcgttcagaagagcctctgaactccaaggggcaaagcggacagctggcagccctttccctggccagcagaggtggcagttctggtaaaactaagagtggggaggaacatgaacttgctttacngattcccttccattaataaaacagaggaccctacacggggcgcttcataaatgtgctcttgcttaatcaccaacaaaaatctgcaagtwaaacgcaatgaacags

SEQ ID NO: 9859 - DNA, 488 bp, Homo sapiens
  misc_feature 197,349..351: n=a, g, c or t
gacaattgaggaaagaataactaccgtacatttttttcatggtatacataaatctattcataactacagcttctactattaaagtctaaaagattgttggttaatataatatatgatgtagacaatttttgagataacataaaacccagtttttttgtccatttttagtttaccagaatgattccttcattcagttntttaaattcaatgccaaaatcacataagaacatgtagtaggcatggtgcttgccaggctcttgaactaagattagtgtaagattattttatcaaggacgcaatgatctagttcactggttctcaggctttgctgctcgatggaataattktnnntttagggaattaaaaaaatatattggccgggcgcagtcgctcacgcctgtaatcccagcactttgggaggccgaagtgggcagatcacaaggtcaggagatcgagaccatcctggctaacgtggtgaaacccgtctc

SEQ ID NO: 9860 - DNA, 438 bp, Homo sapiens
attccgagcttccggtgcagcaatgagctgacacaaaccgtggcggcctgaagacctggaccttccattttgcctttcaggacccgtgttcacaccagcacttagtttggaggaagcacctggaggagatgcagagtccagatgtgcgccctctgccggaagsctactgcaccaggacgtaggcctggagtggcccttaacgcatttggaaatcagtcttcactaaaaaaacttcctccaaaatgttctttaacagccctttaaaagccattgtttcaaaacagtccaaggtggtgaacaattaatattttcgatttacatgaagactctggagtaggaattacctgagttggaaactcagttctactctattggtatcaggttgcattctgkatcatcattaaaattttcagaaaaactctcaaaaaaaaaaaaaaw

SEQ ID NO: 9861 - DNA, 553 bp, Homo sapiens
ctcatttttctactgctcgtggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacact

SEQ ID NO: 9862 - DNA, 472 bp, Homo sapiens
ttarawyyttgrakyywaccggggaagtragactgttaaataggtaactgcaaggaggtgatatgaatgccatgaccgggatgcacagctctatggccacatacaacagggtgcctacctgtccaaggaggtagtgaagaccgcagagaaaagtcatgtttagtaggactcgcttattacctcttgacagatctgtttttggaagtccctaacaagatgtaattcagttaggtgttgcaggatagcttgtacaaagaattagttacttccaatcacaatcctcaagtcatattccttcttccatactggaaagtataaggaagaggtgataccagccagccggtattaccggtagatatggacactatccctaatggccacaagatggcagtagaatccatcagccagtttcccccacctcaaaaatatttattgaataaagttttaaattgtatgttttaaaaaaaaaaaa

SEQ ID NO: 9863 - DNA, 345 bp, Homo sapiens
tataacatacagatttgaactataattcttcctaattaagacttccaatttggctaagtgcagtggttcatgcctgtaatctcagcactttaggaggctgagcttgagcccaggagtttgagacaagcctaggcaacttagtgagacctcatctctgccmaaaaaaagaaagaacgaaaaagaaaattaggcacgtctgtagtcccagctacctgggaggctaagttcacgggaggatcacgtgagcccaggaggctgatgttgcavhgagctgtgtttgtgccactgcactccagcctgggtgacagaacaagaccttgtctcgaaaaaaaaaaaaaaaaaaaa

SEQ ID NO: 9864 - DNA, 110 bp, Homo sapiens
attctgtctggcaagcgccgcgcgatcctcggttcccgccgcgccgttgccgccgctcctctccctcctcacctccccgcaagctgagggagccggctctggccttggcc

SEQ ID NO: 9865 - DNA, 157 bp, Homo sapiens
cctcattggttagtgcctgccatggcagttggtmmctgttttgcatatcatccctgcccattagagtgaacaatattagcamrggcwctgwgwagghwtaatcttggcctgtttatcgamcgggactatkcatttccctggctacgaggattttaaa

SEQ ID NO: 9866 - DNA, 461 bp, Homo sapiens
agtcctttagagctttatatttaatggaaggttaaaaacaaaaacgggatgggaagctaacctcctccatcggaaaatgtctatcaaaacagagacagctggaccaatgtttcaacgttcctgaacaattcttcagcaactggaggtaatagtgcaaagaagggtgcagtcccagaggctcagctgcgctgacagtgaagttctaacaagcttcccgcggatggcttccattctagtaacaactttggacagcctaaccaacagtatatgttgtcaaactcctggatttttgccagtctctaggttgtccttaagatttcatatatatggaatatcaacacttcatcaatttctcccttgattcccagagagcgaagttttcccaattctatcaaggaatttacttacattgtctttgggactttaaaagtctttgaagagatggggtcctgctggtctca

SEQ ID NO: 9867 - DNA, 475 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaawtaccagaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtratccaactgtctcggcctcccaaggtgctgggattacaggcgtgacactgtgcctagcctgagccascacgccggsctaatttttaaattttttgtagagacagggtctcattatgttgc

SEQ ID NO: 9868 - DNA, 144 bp, Homo sapiens
attcggtaaaaagtctagctggcgccattggaatatgggctgctagactcaatttctagttgatgtttgaggtgaggcaaaaataaagctaaagtagaaaacttaaaaaaaaaaaaaaaaaaaaaaaaaaaaaaaaaaaaaaat

SEQ ID NO: 9869 - DNA, 502 bp, Homo sapiens
  misc_feature 453..455,459: n=a, g, c or t
gtttggatggcaccgggtaaagactgacaccagcattttctctgcaggcctttgaacttttgtgttatttcatatattatatgtgttataaagcacattacaatatatttttctctgtcttctccagtcctaggtgaaatgtgtcatttaaaaaaaatttcacttgccattctaaagtttttctggtgagagttttgtgtttttcatttacgcaaacacatctccacataagtagggaaaaagtcttcttgagtatattagtgtcttcagcctttgtattgggacagtagcgtccattaatttttatgtgaagtgaaattaggtatcgggtcawaatcagtctgtghggtcttcacagctttcacatttaccttgtgataatcaagtgtgtttttcctcaggtgttaaccagagaagaggggtcagggactcttccctggtcgtagctttcannnghcnggtaaggaagactttccggaggctgtacatgactggggtcttg

SEQ ID NO: 9870 - DNA, 356 bp, Homo sapiens
agaagggttaatttcagctagcaaacaagctcagccaggtcctgtatctcatccaccccatcagtaatatctcacatcattccagcaatctcaagaattactccaactgagtcacattctggaaatgtgtttggactattcagcgtggctctcatgatgaccttagtgttctcataattagagatactgaagaccttaccttctctgccatgtgaggatacaggatgaaggtgtcacctgcaagccaggaagaaagtcctcatgaagacctgaccatatggcatcctgatgttgggcttctggcctccaaaatcatgataaataaatttctgctgtctacgaaaaaaaaaaaaaaw

SEQ ID NO: 9871 - DNA, 165 bp, Homo sapiens
atttttctactgctcgtggattacgcgcacgttggaaccgaagagagcwctgttgttgcaatgttcagcccacaagagcttactggtgaaggaatgggacaagacccatctttatgcaaagbyagcgttacagtaatgttccagagcagcttgttgctatatacc

SEQ ID NO: 9872 - DNA, 424 bp, Homo sapiens
aggacacagcagcagaaggctatctgcagccaaagacagaggcctcaggaaaaaccaaacctgatgacacctcagtattggacttctagcctccagagttatatggacccacctctctattttcaagagcattaaattcagttaaaaactaaaaacaaaaatactaccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaattttt

SEQ ID NO: 9873 - DNA, 175 bp, Homo sapiens
  misc_feature 71: n=a, g, c or t
tactttcatttccctcaataattccatactccaaaatatggttacaaatgtttcacaagacagcaagtgmnctgagaatattcatttggtttccaaagcagactgccttggaaaccaaatgaatattctcaggtacttatcgtccgtggaaacccaggaagggaaaagaaaggtg

SEQ ID NO: 9874 - DNA, 500 bp, Homo sapiens
aatacagctgttgcattttccccaccactagccccacttaaactactactactgtctcagagaacagtgtttcctaatgtaaaaagcctttccaaccactgatcagcattggggccatactaagtgtgcttcatgaaacaaacatctggaaaactccaagtataagagaccctggactgatgatggcccagccaagtatatggagggacagagttctctctgtcattaatgaggacatcggttttcacaattgaacctcatgcactgtccacagcatctcacctagctcctgtatctcctgatctgcttttaaaaatagttagttaggctgcctttttacaccaccttctctctctccccttgtggtaattttccagccttccccatagatataaaactagaacacctttatgatttggggtctatgtaatgactgaccgataagaacccaggcagatgctaacatacttaacagctcgcattaaaatactttaaatcag

SEQ ID NO: 9875 - DNA, 452 bp, Homo sapiens
cttctcttctctgctgccgtctgaggtgcgcgtttcaccttccgccgtgattgtgaggcctccccagccacgtggaactttggatctgcctgccgtcaagactcaccacttcccacctgtacactgctgtctgtcctcatttcaagtgaatcaccttgcggtcttcttatgccaggttcagagctcatgccagacgctgtggaaggattgttttttgactctctaatactgtggaagaaaaagagatcttccagatatcagagttctcctgacagctgaagagtgatggatgagctggggtctcaattcatcagaacatcaaggcatgtgagacgtgcctgcctccacttcgccttccaccatgattatgagtttcctgaggcctccccagccatgcttcctgtgcagcctgtggaaccgtgagccaattaaacctcttttctgtataaatt

SEQ ID NO: 9876 - DNA, 365 bp, Homo sapiens
attaagcattgccctggcctaagacaccacatgggtcatttcttccaggctccaacttgcttctgctttgccatatggtaacacgccgtattatggaagcaccatcattaccgccatttgcaggggaagcctaaagagataaatgccagccagcatccctgtctctggggccctggagaggccttcaacacacctggcctcactgccctgtggcttcaacaaagaggccgagcatctcctataaaccttgaggtccatggatgacatagcggaatgatggatttcagaaaagcacactgctgttacgactccagaaccgataaggaagctatgtgtggaagtatgagctcaggtcgccttctgac

SEQ ID NO: 9877 - DNA, 426 bp, Homo sapiens
cgggtcccggcacagccggttccagccagttccaaccagcctccgcctaccctcccccaagtctcgggactcccagcgggggctcacactcaccatttcctggctttcaggtgactcccacgtccaaagcagtcacaacacagacgacagggcgacagaagtatggcggtggcaaccggtccctctcagagcaggaaaaacggggtgccaacctcacccggcgggaggggccaaagactgaggcgaacggcaatgtgacccgcggataaacagttggccgggccccaccccggcgactctgattgggtggagcgccaggccccgccccctgcatcctgagtgacagcagaagtcctgggtaacagggccaagcagagcaggactgaccgcttcaagccacagtccaaggtcaagttccctctctam

SEQ ID NO: 9878 - DNA, 439 bp, Homo sapiens
gcgaagtcaaactgttgctgtttgctgatgatgtaatcatrtacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccaaaacaccaccatcattcttcacagaa

SEQ ID NO: 9879 - DNA, 504 bp, Homo sapiens
atttttatttgagaaggcagcagaaagcaattataaaatatgtaagactaggacatatttcacatttcttggatacttctctattttcttttaaaaaactcaggtgctttgggaggctaaggcgggcagaacacttgaggtcaagagaccaggctggcaaacaagccaaaacctcatctctacttaaaaaataccaaaactatccaggtgtgatagtgcatgtccgtagtcccagctactcaggaggctgaggccggaaattcacttgaactcgggacagaggttgcactaagctgagatcatgccacttcactccagcctgggtgacagagcaagactctatctcaaaaaacaacaacaataacaactcaggattcttgctgaagttggggattgcaaaaatgaacacagaagcccagaggtcaagacctagttggaagaaggttcaaaagagcctgaataatgtttgatcaagcatggagtctttgtcactaaataaaccaa

SEQ ID NO: 9880 - DNA, 194 bp, Homo sapiens
atcctggggagaggggtcccagccagcactcgtggtgagaacagagctccctctcgggaccccgttatgctgaccctggcttccacttctaggagaaataaagcatagaaagtcctgttggtggtaagattgcttgctgctttctgtggccaaaacgtaggggttccatctgccagcattttgaaataagtagg

SEQ ID NO: 9881 - DNA, 483 bp, Homo sapiens
actttgaagttagtgagatagttgtctcttgctatagatttttgccacttgtatttcttctgattttcttgtccaggtactcttgatcatttttctctttaaatttttctttttaaaaacttcttcttattattattatttgagataaaagtccactctgtgacccaggctgggagtgcagtgctgcaatcacaactcactgtagccttgacctcccaggctcaagcaatcatcccacttcaacctcctgggtagctgggactacaggcgcgcatcagtttccagctaatttttaaattttttgtagaagcaaggtctcgctatgttgcccttgaactcctgacctcaagtgatcctcctacctcaacctcccaaagtgctggtttactggcatgagcactgcacccagtcgggtttcataattttctaattgatcattaaacaaacattttcataagttaaaaaaaaarraaaaaaaaaaaa

SEQ ID NO: 9882 - DNA, 438 bp, Homo sapiens
  misc_feature 153: n=a, g, c or t
attttccagtctaaggcctgaagggtaagtaggcattaaccaagtgaagggaaggaaggtgtgaacacggagaaaggacataagaagaggagacgcagaagaaattgtatatggagggctgtacaggaagcatgactgggaaggsctcagganacttacaatcatggcaaaagcaggaagaagaaagcgaaatgaaaggtgccacacacttttaaaaaaccagatctcaggaggactcgctattatgagaacagcaagggagaaatccgcccccatgatcccatcacctcctaccaggcctctcctccaacaatggggattacaattcattatggaggaggacacaaatccaaaccatattaccaggctaggctggattttcctttcttattctggcatagcgccatgttcttttttttcaaattaaaaaaatgacat

SEQ ID NO: 9883 - DNA, 581 bp, Homo sapiens
acttttttcctcacgaagaggtctctggtctcccctctctgagcactctgaggtagggttgctgtgtgttttgctcttggtctaattcctttggctaaacatgaataattatattaatgaatggctttggagattcttcttccgtcctttgcatttttccgagatatgtttctggttttggtatctattagaagggtattttggtttctgttttgtgacaatcaagatttatagtacagaaaattagaagtgattatttctatttcaaggttctttctgtggcagccaggtaatcccttgggtgccctgatttactcacttggtttttttctctctcctgggtataagaccaactacataatttacaaagcccagggcaaaataaaaatgcagcctctcattcagaaattatcaagaacttcaagagggtgagagcacagcatcaaatcaagagcagggcacttcttttttattttaatttttccataagtattggggtacaggtggtatttgattacatgagtaagtcyttaaatggtgatttgtgagattttggtgcactcatcactcgagtagtataa

SEQ ID NO: 9884 - DNA, 345 bp, Homo sapiens
  misc_feature 180,325: n=a, g, c or t
aaaatttttttccttccatttttcttaaaaaagaaagaggccgggcgcggtggctcacgcctgtaatcccagcacgttgggaggccgaggcgggcggatcacgaggtcaggagatcgagaccatccctggctaacacggtgaaaccccgtctgtactaaaaatacaaaaaattagccgrncgcagtggcgggcgcctgtagtcccagctactagggaggctgaggcaggagaatggcgtgaacccaggaggcagagcttgcagtgagccgagatcgcgccactgcactccagcctgggcgacagagcgagactccggctcaaaanaaaaaaaaaaaaaaaaaaar

SEQ ID NO: 9885 - DNA, 585 bp, Homo sapiens
  misc_feature 46: n=a, g, c or t
acatttgcatagcccctgggacgtggcgctgcacccaagcctcttntcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggccaccctttccgtagttgtcccaaatggagctggaattggatgctggtgaccaagacctgctggccttcctgctagaggaaagtggagatttggggacggcacccgatgaggccgtgagggccccactggactgggcgctgcgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtaga

SEQ ID NO: 9886 - DNA, 359 bp, Homo sapiens
agtttattgaattaggatataaagaaagaaagtttttttgtacagctaatgtgtttgtgttttaaactaaatgttattaccaagacagtaaaaaagttttaaaaaatttaaaagtttagaaggtaaaaaagttatgttaagctgaggttaattcactattgaaaaaagaaatatttaaaaaataaatttagtgtggcctaagtgtacagtgtttataaaatatacattagtatatagtaatgtcctgggccttgactttcactcaccactcacccagagcaagttccattcatggtaagtgccctaatcagtaatcaggcataccatttttcgtttttgggtttttttttttttttttk

SEQ ID NO: 9887 - DNA, 444 bp, Homo sapiens
aaaaaggaacaaaccgctccgagcccgggtggtgggaccgatcctggagcccagatcaagccaagtccggccaaagctgtgtcgcaaagtaagaatctgaagacaggtccggtgcttaaatgactatkattctaaagagttgaagatgggaacggtggacgcacaaaatctttaccctcggcttaaaacgccttttctggcaaaagtttgtgtatgaaagaaagctgaacaaacacgttgtagcactgtttaagtgaaggcctttccttttagaacactgctttacaatgcctaatcagccggcgctcaggttggtgcattcagagacccgagcgtttgtgttcctaataagtttgctagaatgtcaggtaactgaagcaggttagtttctatcctgscccaaaacacagactgtcactggcaccacaatgttgtggttttttc

SEQ ID NO: 9888 - DNA, 454 bp, Homo sapiens
aaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccata

SEQ ID NO: 9889 - DNA, 461 bp, Homo sapiens
attggtctcctagcaaccaactctactaacttacttttgtccctatcactggagaatgggtttggtgctttgagctgtgtttctacataaaaaagaaggaatcaaagtgatgctgggtaactactgatggtgtgacaatataacatttgaagctgctccaaacaactttgactgtaaaaaaaggccaagagaatacaagaggctctaaccaaggactctgacttcactaagccactgaaacattcctggcactacctacctcctgccttttcgttatgggaggaaaccctattggttaggtcactggtttaaaacacgtcctttaaaattgcagaggaagaaaaggcttggaggtgataaaggaataaataagttcattcccttgattatggtgatggtttcataggcatatgcatatgtccaaactcatcaacttgtatacatcaaatatgtgcaattta

SEQ ID NO: 9890 - DNA, 79 bp, Homo sapiens
tttcatatgcctcttcttacttcacccatgtttgttgttatgtaaataaaggttttctctccgaaaaaaaaaaaaaaar

SEQ ID NO: 9891 - DNA, 439 bp, Homo sapiens
aaagtttgaatatattattagatgtgctgcttagggtttttgatagtttgcttattttttgtttttgkkttttagatttgtttgkggaagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaa

SEQ ID NO: 9892 - DNA, 68 bp, Homo sapiens
agatctctggtttctcttcataacgaataaatctttcgccttttactaaaaaaaaaaaaaaatgsvaa

SEQ ID NO: 9893 - DNA, 482 bp, Homo sapiens
tacataaaatattggctcattactctgtcaaattgctgtaaaatattttaaacagttcatggtcaggcagtgaaatcagactatacttttaatagcattggtctggttgctgatattcaaaggctttccaggtaacctcctcctctaaacttctttggcactgtgacaacttctagccatgaaaattaggagataaaatggcttaactcagttttcctgatttaatgagaaataatgtctgtgataggatctgagaagataaatatgaaagagataattccaggtatctgagttactctcaaggctggtgttaaaggagaaagtgggctgggtgtggtggttcatgcctgtaatcccagtgctttgggatgccaaggtgagaggattgcttggggccaggagttagagaccaccaacctgggcaacgtagcgagaccctgtctctacaaaaaatttaaaaattagctggacatgtggtgcat

SEQ ID NO: 9894 - DNA, 145 bp, Homo sapiens
  misc_feature 114: n=a, g, c or t
agtgacatgtctggcagagcacggtgcctgctgtgtgctgatactgttctgtgtaatggggattcagtgaacaagactaaaaaggwacckgtacttatggcgcttacattttgntggaggaagacagacaaaaattaaggaaata

SEQ ID NO: 9895 - DNA, 379 bp, Homo sapiens
  misc_feature 323: n=a, g, c or t
aacttttataatttatcttattttataatttaagaatatagtacatatcagtwgggtttggttttggtcatcgrgactaaaagctccatcaaaacagaactttgtgttttctgctaacttatttaatgacacaagttttaagagaaccacaattcattgattcacttattcttttccctaattgtgaattttagtgataaatacacctgtactactgaagaaaatattctgacacttcacgtgtgcaaagtatagaactgacagtgtcagtttcagattttgtatgtacgatttctggcttatatatccaatggtgcagattnkgaaatttgtaagaacaaaatttgttaagaaaaacaacttgctctagttttgtgac

SEQ ID NO: 9896 - DNA, 449 bp, Homo sapiens
  misc_feature 236..237: n=a, g, c or t
atcctctggctgctgctgcascagagccctctgcagacctttggccatgctctcattacacttgattgccattgacagcytgrattgkwaagtcaggtgaacaaatagaagctgagggtgaaggacctacagctgtcacctttatctcttctcaacactgccaactgtccccttggatctcbvagacagacaacaagggacatctctggtttctcggtgccccctagaaacctcbnntcatttcaaggcattatgcaaatgagaagctttccttctcttcacctcatctcctgatctgcacaaaagtgactgtaggacccagtgttgtagatgagcatgagagtgtggagcagagtcggcgagcgcaagtcgagcccatcaacctggacagctgtctccgtgctttcaccggtgagbhdgagctaggggaagatgagatgtactactgt

SEQ ID NO: 9897 - DNA, 478 bp, Homo sapiens
  misc_feature 324: n=a, g, c or t
ttggagatagcctcgtagaaatgacaaccacaatgttaatactaacatatgtattacatggcttgtttgttctttcgcttwaatattttcagagcacctacctattataggcactgtcacttctcacaaaactgggacaactaactgtttatccaacatctgctggctaaataaaddcatgatcttcaccttttgggattgttaatttaaaattgttccataagagcaatgcaaagacagagatatttggcagcactgcagctggtgatttatatggctcttcacaaggtgttattttggggtatcaaggtatggatgcttamnmtcagctgcaggaagtaagaaagaagaaaaaaggagtgataaagataaaaaaaaatcaaccttggtccttccaccaagacccattaatttccatatcatcatctgcataagagggaagattcctacatgaccaggttactgcaaggatgtgaat

SEQ ID NO: 9898 - DNA, 414 bp, Homo sapiens
tttttagctcgtatgacttgttttcattcattaataataatttgaaataaaactaaggaaatggaatcttaaaagkctawkamcrgkgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatbbtgacttgtaatcaattatgaatatttcttgatatttaatgtataggacatttatttatactcaataaatatttttcaa

SEQ ID NO: 9899 - DNA, 177 bp, Homo sapiens
agaggaacctgtgacatcacaaggaaagctgcccatgcgactgctgtccctgcccacttggggagaggggcggggcctgcctactccgggagaggggagggctggtttttgctttaaaatgttaaaaataaactttaaaaaaataaaaaaaaaaaaaaaaaaaaaaaaaaaaaaaaw

SEQ ID NO: 9900 - DNA, 245 bp, Homo sapiens
gataagaaacaaaggtcttgttttcatgtaaatgagtttaattatacagcttgctgttgaaaagtctgtggttaaggatacttatagaatccggtttggtttttgtttcaatttctcacttttgcagttatgaatatagacaattaggcatttggttaaatgggaagagagagcagttgctgaattaggtgagggagaactaagcatactgagactgtagagtatcagttgtctctggataatcc

SEQ ID NO: 9901 - DNA, 425 bp, Homo sapiens
  misc_feature 93..94: n=a, g, c or t
ctgtgttttctacccatagtcagtgctcccaaagttcctattctgtggagattctggagttgccacttcggtgttcctacgtccttcataahnngatagatggccttctacttggaaaggttttacagttcagcctgtagacagggaactggaaatacttttgggtagctcttctacaccaagatgatggtgttaatgatagtcacttttccttctcctctacacccctctcagtgttttttctctttgtttatcttgggcatctgcttctcatatatgtattctttattctcctcaaggctggtcttttccagcctcctgtagccattttcacagcataatttgaagtcctcccatgtctgctgatttaaataaatccctaataattttcttccaaatcatggctgagcacactctaaatctgt

SEQ ID NO: 9902 - DNA, 155 bp, Homo sapiens
attgaaggctcagagttttgtttcaagaactgaatcccaagcccacacgttattagcctgcgcttcttaaaacaagttatgagatgggaaaaagggcacccacaaacatacgtatacattatgtatataataatatacagtatcatatatataat

SEQ ID NO: 9903 - DNA, 308 bp, Homo sapiens
tgaatacagttaggttaaagtataaaattaaagaatttatattttgtaataattttgggaaagaattttaggacatagaatattccacatagtttgagttttgtatcagtttaacctttggacataagtttgtatttacagaaattactgttcaaaagtaagttttattcaaccaggataattaattactagtatatttactattaataaataacttatttaaaaaaataattctgggcacatgttgtcaggacctcctgaggctgggtctccaaataaaaaacaaaaaaacccactattctttggat

SEQ ID NO: 9904 - DNA, 79 bp, Homo sapiens; identical to SEQ ID NO: 9890

SEQ ID NO: 9905 - DNA, 296 bp, Homo sapiens
aggatatgtgttcgagagaagtggtcatcatggagcatgggagaatgagtcaattagagaggcttcgtaacattttagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgsctyccatgscccmacatgtattttwaaagtgatgagctagagttt

SEQ ID NO: 9906 - DNA, 429 bp, Homo sapiens
  misc_feature 311: n=a, g, c or t
caaagtaagctattaattcataaagtatactgaatataaattgcctttcattatgatgtttccacaaataaaaaaaatcattttccttttataagttaaagtacgaacagatattagagatgaaagccttaaagaatttttttagcctgttttattattgttttaaaatttactacagtgtacccctttattgcctgcactgggggcaatccacttctgccttgcacttagcatgacactgctttttattgacatgtaacatacattcagaaacagtgatcagatgtatccagatcaaacatcaccacctnrgtcaagaaagatgatattacaggtatcccagaagcccactccacaacccctcctaathgwtaacaccatatattagttttgtctcatgtttatcttcaaataaatggaatcaatcaa

SEQ ID NO: 9907 - DNA, 174 bp, Homo sapiens
aagctggtccggtccttttcgagggtgtggaagctttgtgtttttgctcttcactgttaaccttgctacctcttgttgtttgggtccgtgcccatctttaagagstgtaacactcactgggaaggtcgctggctagtcggtgccatctttaagagctataacactcactgcgaa

SEQ ID NO: 9908 - DNA, 180 bp, Homo sapiens
aacatggtacatgacattcttcctgttttcttcacaagacaaggatgatgtttaaatgggcatttgtttgcggaatgacttggagagttcctctctttcagccatcttttctcaaagactaaggctgtggacaggatgggcatgaagactgtcaaggagcccgagtgagggaagcagacc

SEQ ID NO: 9909 - DNA, 265 bp, Homo sapiens
tgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcct

SEQ ID NO: 9910 - DNA, 424 bp, Homo sapiens
  misc_feature 315: n=a, g, c or t
tcctataccctggagcccactgaaagtgctcaaattagtcaatcctaagcctgcgtatcctgcctcatccattccttcctgcagaaaccacaataaagacacttgtcttccctcttcctttgcctcacgaccaaccttggtgcttcccctgagtggccctgtgtggcatattgtgttcttcccagagaactgtcagtataagaaactgtaaaactctttctggtttctgtctgttgatctgcatctggcctcaccaggtaatataactaaaacagtattaaattaatactgagttggaagaataacaatttgtanttaatataaatgcttttccagccataatctttgaggcacaaatgaaataatggatacaactttaaagaatgacaattccttgtaaatgtagggtattatagttgactct

SEQ ID NO: 9911 - DNA, 73 bp, Homo sapiens
atctacctgtgagttaggggagctaaaagagcataaagctcactcctgaacatgctgtctcttacctgcttaw

SEQ ID NO: 9912 - DNA, 441 bp, Homo sapiens
  misc_feature 241..242: n=a, g, c or t
tctaggtgagcccattgtaagtatcattgaaaacaaaacatgcccgtcaacatgtcacagaaaacgaacgaaggacaacaagaagtggatgagaatattttgttgaccttcatgggtttacagcctctgtctctaaacaaagtatggaaacaagtagagcttttattttgcttttgtttttgttttgtttttttttkgttttcccccactaaatagaaatgagggtccttagtctgttyynnacaatckgtwaatttcttaggacagctgyctttggtttgctttccagcaggcgtagtatatttagtcggagagcacatctgwatgcgamaacttgattacatcttttttyctagcwatttkgcattttttcttttaccatgtttcagtttckgcatgtagatttaaataaaaaacaaaacttgtaaagttgtaacattt

SEQ ID NO: 9913 - DNA, 414 bp, Homo sapiens
cgaaaggagaaaaaaagccgagatgtagactctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgtacacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgt

SEQ ID NO: 9914 - DNA, 442 bp, Homo sapiens
tgtcatcaattacttgttaattacagatatggttttcatttttttttctcaatttttcattatgttatttttggagactgtcttaggtggggagtgaattataaatatttttatttcaccacctttaactgagtcaccatatgttatttgcacttccaatagaccagggattgaccagagtatcttttactgatatgaccaccagagctacatggcttttaccttctgtatatcagatgtcactggaatcaagcattaaacctagattaaatctggattaaaccagctgtatggcaccttagaaaattgagaaggactaggaagctgatagaaagaactcctgtataaaaaataaattctttttacattttccttggtagtatttctgcaagcttctttagtttctataggggaatcccagagttttcctctgagattgctt

SEQ ID NO: 9915 - DNA, 428 bp, Homo sapiens
aaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggag

SEQ ID NO: 9916 - DNA, 138 bp, Homo sapiens
  misc_feature 46: n=a, g, c or t
gttgccgcgatccgggccgggagctgcgggcgcccgggcsaagggntttcccggtgcgctccgccaggtcagtcatcgctagagggttattattgacatttactcatcataaaatgtgatgtcagcctaccagctcgg

SEQ ID NO: 9917 - DNA, 412 bp, Homo sapiens
aagtggaatttggttttatgctaaaataaaatcctagagccaggtgtggaggcgagtgcctataatcccagctactcagaggctgaggcaggaggatttgttgagaccaggagttcaagaccagcctgggcaacataataagacctcatctcaaaaaaaaaataataaagtaaaataaaataaaaatcctactctagggcacctgggaaccaaccagtggtgcctttggaaatcttggtttatgcttcctctctgacagtaggaaaaagctattgtgggagtttctcctgccatgtagagtgatggaagagcagaattgtggaggagcagggttgctttgttttgtctttgttgtactcagctggaaagctgtttaaggaaagaatctggtcawatgacctcctttctgcaa

SEQ ID NO: 9918 - DNA, 891 bp, Homo sapiens
tactggggtgtcttgcggagtgcagaaggctttctggcagctgcctgggtttggccagaccctgcctcccctcccgccggccaacccctagtccccttcctgtctcsacttgcattcaggggtggctgctgttctgagaacattagaactgggaagagagatggagtcacatggatttttggtgggcattattctgaactttcgtatcsaagttagtcccccttattccactgtggcattgccgytctaagcagttacctgatgcctgctgctgaagagctgctcacaggaggcggcggcggccctggcactgccccttrcattasgtcttgtgtttgatgtsttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggcctctgtggaccttggctccctccgtggacctgggcttcgtggtgagcactgcagcctccctgggcattccctccagcgccasaccactgcaacatatagacctgagtgctattgtattttggcttggtgtgtatgctcttcattgtgtaaaattgctgttcttttgacaatttaagtgattgttttggttactgtagtttgaa

SEQ ID NO: 9919 - DNA, 200 bp, Homo sapiens
taagagataagtacagagagataagtggtatttttctaatcaacaacttcctgttctaagtcatacgtaaaagttaaagtatagcagacaatatcgttttaggttaaaaaaaaaaaagtcakscctgtwwammcgtytgtcaaacaaaagtagakttttttaaawacctcagsycccaaatcaccttctgtttgcccatk

SEQ ID NO: 9920 - DNA, 182 bp, Homo sapiens
caagtatctctctaataactaaatccacttatttgcattctccttgtggattttttgtcacctaaggaaatgcatttbatgagtgctggaaacttcttaagtgctttacagtttgttttcattgtttgcagcggatcactggacatcaaagattcattgcacttatgaacaaggaaccttct

SEQ ID NO: 9921 - DNA, 164 bp, Homo sapiens
  misc_feature 26: n=a, g, c or t
aktggcaaacgcatcctcttgccttnccggtgtttgggccttgcctgtgacggtgggaaaagaaaatggccttgctgtgctacaaccggggctgcggtcagcgcttcgatcctdagaccaattccgacgatgcttgcacataccacccaggtgttccggtcttt

SEQ ID NO: 9922 - DNA, 468 bp, Homo sapiens
  misc_feature 389: n=a, g, c or t
tttgtctcawatacatttatcatttttactcaaaggatgttgaagtattaadagtcattatgctgtctgtggaatcctactattagtacagaacaccctgcagtgatttttccgcccatgttagcattgaagttgtgagctctacttgcttgtctttatggccctttaattcaagtaattggkcarkawcccgaawggggccstttwawaccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgkncttttcagattcttcaaacacctaaatgaaagtgataaattcaaaactgatccttttagttcctcattatatgatatga

SEQ ID NO: 9923 - DNA, 414 bp, Homo sapiens
ccacacagcatcawccaacckgtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggarrycttgsccgkkttycaaatkggttggccaagtcaaacagtgtgaaggaattacaagtccagaaggctcaaaatctatagtggaaggdatcatagaggaagaagaagaagatgaggaaggaagtgagtctataagcaagaggaaaaaggaagatgacatggagaccaagaaagaccatccatacacctggagaattgaactggcaaaaacagaaaaatactgggacgg

SEQ ID NO: 9924 - DNA, 169 bp, Homo sapiens
attcagaaaacttcttatagctacctcatgcaaaaytgttttcttcttccttctcaatggtgacatttgaagaggcagagcaccttggggctcctccttctgtcttaagagaaagccaaggcacgtagagtagggagaagaagggcaccatcctctctttcctccccar

SEQ ID NO: 9925 - DNA, 69 bp, Homo sapiens
aattactattgtgcggctgcaggaggtgtcrgcggcgttatttttttttgcggtttgccttttttttty

SEQ ID NO: 9926 - DNA, 441 bp, Homo sapiens
  misc_feature 196,306: n=a, g, c or t
adagtacatggaacaccatgagtctaacatgattgtstatcttactggtattattagaaagggcaggtgtaccgatatgtttatgcccattcttcttgtgtacttgtgactcttagcagcatggaagagaagtgtaaccatgcaaatacaatgagcttaatatgctaactttagsaagawgtdaaaakgtggrhcnaaawtgggkgggwagggaatgggawagtctgagatacccaggcttcatgatggtgtatattattkcagcatattataaactagtcactaatgaaaatggccatccatgancattgactcaaaactcaccaaggaacctgaccttgccctccacactgtggcctcactgtaacagtttcctcaaggttcctaggagggtatcaccttagagtgaagtctaaaatttggctattttttatctataaa

SEQ ID NO: 9927 - DNA, 168 bp, Homo sapiens
cattttgtyacttaatgccagtacaactgtgttactcctaaggacttttgggattthkatgagacctgcgagggagaagacactgagaagccagtgatctgcaagcatttgctcttgtttccacatcacctctgggatatttcagctgttgtttccaaatggcaaatc

SEQ ID NO: 9928 - DNA, 457 bp, Homo sapiens
tctgtttaagtaggggaaacattcgccagtcagacgtaataaatatctccataatgcattcaggtgaaggagacacactactgtacataaagtacattcagacattcttattttaatccagagttttaccttgatccataaactcttgtgttgttatgtctttccagtataactgtagctcctgttaggacttcaccaacagatttgtaagttctgtgcatgggtcyctcgkggraasatcyccwakgcttwamcwatttdatccattwaaaagcatttgactctgggtccccagctagggactagcaaggaatctaggtcttctcttcaggccttatctaagcattggcttaggcaagttgaagttagatttttcttagtcatttttgccttccagtttttaaagtttcctcaaactagggtgaattgccgggtacagtagctcactcctgtaatc

SEQ ID NO: 9929 - DNA, 54 bp, Homo sapiens
acactcacaaagagccgaggggagagagggtgcgcagacggccagccgggccgc

SEQ ID NO: 9930 - DNA, 379 bp, Homo sapiens
  misc_feature 221,233: n=a, g, c or t
gtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttycccgnccbkrggccggngaagccytgggksctgcaggtattcaaaacctttgaccacatgrccccgtcagratgatgagaagagaaggcaggaacttgaagagaaaatcagaagaaaggaagaggaagaggccaagactgtgtcagctgctgcagctgagaar

SEQ ID NO: 9931 - DNA, 419 bp, Homo sapiens
taacatgtaacttgcagtgtttgccagctttcaaagcaggctttgtgaaaatgtaatacaaacagcagtgaatgggactcaaatgttgtgcttcctataaacagctccgctctttcagggaaggatggtaacaaactagaaggacaaatatgtacgtatttataacgtattaaaactcttttaagtagcttaaggtattgtgcaatggcctagccyagtagaaatggggggaaarcaatgctgtgggaccattgttaaagtgacaggagttgtagggttacccctttgacaagcttccatagtcttcagacacgcacattgatggcatccctacagtcttcttcacttgaactttgtaaaactgcatatggacctgtaatcaacttttgatatttcttaataaaggcgttgaaaatcaa

SEQ ID NO: 9932 - DNA, 422 bp, Homo sapiens
tattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcsgatgcaaactcmrcctcagggatycatttggkgcctwagttttawatgcatccttatttttaatacacckgcttcacgtccctatgttgggaagtccatatttgtctgcttttcttgcagcatcatttccttacaatactgtccggtggacaaaatgacaattgatatgtttttctgatataattactttagctgcactaa

SEQ ID NO: 9933 - DNA, 198 bp, Homo sapiens
  misc_feature 174: n=a, g, c or t
catcacgctccgcgtgcgcagcacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcancagaatgacaaaggcaagaacgtc

SEQ ID NO: 9934 - DNA, 207 bp, Homo sapiens
attgtatttccttgttgtgagtctagcgaatatttgattatctttaagttgatccatagtatattcaacagtctcatgagaacataatttttgttgatgatttgtccaaagtttctatcaatccatcttagcagcagagccaagtgttagagttattgctgcctgagttataacagctgccctgggaatcttgtctgaacaacaagt

SEQ ID NO: 9935 - DNA, 413 bp, Homo sapiens
aagcagagactgcagaacaatgaccaggtctgagggaggatgggcgaaacgcaggctagattatgacaggcatcaggtcaagggtttcctttccaagagagccgtacagggtggcagcagccagtggcatgtggagcctgggccattggtgtccatggaggtcagccagcgacaaggcagggcctggagcaggtgctgacagaagctagactgacctctgggccaaaattccctcttccttccaaactaaccaggccaggcctccaggaaataacaccagaaccagacttctgaactggcaaaagaatcaccatgagccttctactggatatggttgggtccctgaccaggatctccaggaagctgcagctggttgtatatccaatatccgcagctggctcttgctacagaga

SEQ ID NO: 9936 - DNA, 440 bp, Homo sapiens
cagtctaggatctctgtttttattttaatgttggtcagttgtgtctaaattccagagcggggcaggtataatggggcatcccgagccctccttcccattcatggcctgaactggtttttcaggtttctttgggtcccggtggctgcaaggggatgcactcagttggctgggggacttagaattttagttttggtttacagcaggatttgatgggcatgcatatttatcaatgtgaaagtgttgtctgtgggcggcggagggcttgggccgtgtccaggccacgcactgcaagggtgcagcccccacacacggtccctgctcctaaagctgttrcccccactgcaagagtggagtaggttgaggtgtagcatgacattctggaaactacattttttgtaatagtcattttgaaaataaaacatttgaaaatactgtgcagc

SEQ ID NO: 9937 - DNA, 391 bp, Homo sapiens
tattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcactggatgtgagtatattgggcctgggacaggctgggggctaacaccctgtgtgagatgagtgtctttgtgtctgtgcttgatgttggtggctctctgtagtcacatgacagcatgggtgtgatggagatctgacttcattcaacaaacatattttctaaggagttchctgtgccaggcactaagctgggcactgggaatgtaataaaatagtcaaggtccac

SEQ ID NO: 9938 - DNA, 308 bp, Homo sapiens
catatataccaggcttgctctttgcagtgaatgggaagcctcattttggggaccaagaacctgtacaaggatttgtgatgaacttttccaatggggaaattatagacatcttcaagccagtgcgcaacattttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaatctgaacacaaactcgagacgagtt

SEQ ID NO: 9939 - DNA, 328 bp, Homo sapiens
tacatataccatgtagtatgaccatggttgaaacaaggtcaaaggtgatgtcaatcccatgttgtaacatctacgggggcaggagtcacaaacgttggatcagatatcacctgtgagttgcaagtacaaggtagtttcaaagctgtgcctctgcaatatttcttttcttctttttgaggattcccgtcacccttagaattatatcaaagctcattgccaataccctggtctcctaagccctgtatgattctgctccagcacatttctccgacttgccatgccacttgtcactttgctacaatgacctcccttcatttgtcctgtctca

SEQ ID NO: 9940 - DNA, 400 bp, Homo sapiens
aattaatcatttagatgggaaacataagcctactcagcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatc

SEQ ID NO: 9941 - DNA, 161 bp, Homo sapiens
  misc_feature 17,19,25,135: n=a, g, c or t
acttctgctgccgctmnvngtagcngcggcggcggcggctgcggctcgggagcgcggctgctttgagggctcgggaaccttacagagtagggacgtdgggaggctagarggtgagahagctggcvggagattagnrcggcgctggakgagggcggtgcgtg

SEQ ID NO: 9942 - DNA, 169 bp, Homo sapiens
  misc_feature 165: n=a, g, c or t
taagtaattcgtttcggtttgtagatgtttcccctgacttgttaaagaggdaaccaggaactcagtcatgtttttgtcctgggataatctacctgttatgccagkactcccatccgaggggcatgcccttagttgcccagatggagatgcagttcagtagatttngggc

SEQ ID NO: 9943 - DNA, 256 bp, Homo sapiens
attcatttcatttccccacaggcatgattgaaaagggttgtaagattccaggaatgaactaaatgtttctctgagcccaaatcaactatcatctgaaatcgtggtgcagagaagaaaggtgcaattcctaaatcacctgctaagaagctgactaatgcattaagcaagtccctgagctgtgcttccagccgtgaacctttgcaccccatgttcccagatcagcctgagaagccactcaacttggctcacatcgtgc

SEQ ID NO: 9944 - DNA, 172 bp, Homo sapiens
tatgctgaagagtttcatctgacaatctgcttcaagaaatctcagaaaatatgataacattttaactttcattttagagcacgttttggtcatttttaaaaatacctaaagtgccagaccggaacctatagctactgctagaagtcttaaaaaaaccaacagsagcacaggr

SEQ ID NO: 9945 - DNA, 138 bp, Homo sapiens
gtttgttgacacatgctaaaaatgtctttggagagaacttctgcctgataaacacccaattctagactgtgggtggattttcgagctgacggtggtcaattcctttcattaagcagtgatctgatttckccacatggs

SEQ ID NO: 9946 - DNA, 88 bp, Homo sapiens
atcatgtccctttttaagccttacctgagaggaacaatgccttaaaataaaaaagcattaatgagatgaaagtatgcacagaataack

SEQ ID NO: 9947 - DNA, 64 bp, Homo sapiens
tagtggatataaataactgttgtaattataackccaaaabagaatgtdtaagtckaaacaatcw

SEQ ID NO: 9948 - DNA, 219 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaaaaaaaaaaaaam

SEQ ID NO: 9949 - DNA, 190 bp, Homo sapiens
tcctgaggagtgctttacttccaactatgtgatcaattttggaataagtgctatgtggtgctgcgaagaatgtatattctgttgatttggggtggagagttctgtagatgtgtattaggtctgcttggtgcagagctgagttcaattcctggatatccttgttaactttctgtctcgatctgtctaatgk

SEQ ID NO: 9950 - DNA, 188 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggt

SEQ ID NO: 9951 - DNA, 140 bp, Homo sapiens
tattktttacattttgctttagaggcagggtcttggtctgttgcccwcactagaatgcagtggtgccatcacagctcactgcagccttgaacttctggactcaagcgatcctcctgcctcagctagctgrctagctgggr

SEQ ID NO: 9952 - DNA, 188 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggk

SEQ ID NO: 9953 - DNA, 176 bp, Homo sapiens
tatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctctctcttaaaaaaaaaaaaaaaaw

SEQ ID NO: 9954 - DNA, 176 bp, Homo sapiens; identical to SEQ ID NO: 9953

SEQ ID NO: 9955 - DNA, 479 bp, Homo sapiens
  misc_feature 372: n=a, g, c or t
cttcttccttctccgtggcctacgagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagkacttggaawcbkracbcbtttcbcccwaattckgcggattccggcccctaatattctttatcagaccctcagacaagaggctgacttctgcccccttgtcaaggagcgaggccactttcctctccaccccatgctagcgaggataacttatttctcttctggaattgcatcttatgcgccttnvccacccatccccacagcccctgcaatacccagtttggcctctwttgcttaataacgcagatcccagcgccacggcaccttagaacagactttttctttctcgcgtg

SEQ ID NO: 9956 - DNA, 400 bp, Homo sapiens
tattttttacattttgctttagaggcagggtcttggtctgttgcccacactagaatgcagtggtgccatcacagctcactgcagccttgaacttctggactcaagcgatcctcctgcctcagctagctgactagctgggaccacaggtgcttagcacgtgcctggctgatttttcctggtctcattgttgctggggstkgscstkramsycmaaccstcaggcaatcctcctgccttggccacattttatgttgggattacaggcctgacccaccatacccagcctaatactatttttaaaaacaaaaagtaggaaatcaattttccttttaaatgaacactaaattataagaattaacttgggtaatctatgcaacattctcacttttttttttttttk

SEQ ID NO: 9957 - DNA, 380 bp, Homo sapiens
tgggaaaatttttgaattgaaatagcgtcttttgtggtaagttttaagaccttttatttgttaaaatgttgctcaaggtggagctagtgaggaaaaataaatttctggaaaaaattggaaatatttttgatatttgccaatcgaatatcacataactaacctaaaggaacagaagtaggtgtactttagttaactcagkttgrwtawkgatggccaaggadttaaaaagaaaaattgyctycctttcagactttttcttttttggagatgggtactcactctgttgcccaggttgcagtgcagtggcatgatcatggctcactgcagcctggatctcctggctcaagcgatcctcccgcctcagcctcttgagtagctgg

SEQ ID NO: 9958 - DNA, 112 bp, Homo sapiens
  misc_feature 47: n=a, g, c or t
tattttttacattttgctttagaggcagggtcktggkctgttgcctnbtctagaatgcagtggtgccatcacagckcactgcagcctkgaacttctggwctcaagcgatcck

SEQ ID NO: 9959 - DNA, 423 bp, Homo sapiens
ccagagcccgggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcacvctcacagactataccaaaccagbtggbttccmaggmawkgccagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggt

SEQ ID NO: 9960 - DNA, 128 bp, Homo sapiens
aacacgggaacacccacctttagagatgagacacaagcaggagaagagggattaaacctgctagttttggaaaaaaaaaaaaggaaagaaaagaaaagaaagaargaaaamcaaaaaacaacaacaam

SEQ ID NO: 9961 - DNA, 364 bp, Homo sapiens
tcctgaggagtgctttacttccaactatgtgatcaattttggaataagtgctatgtggtgctgcgaagaatgtatattctgttgatttggggtggagagttctgtagatgtgtattaggtctgcttggtgcagagctgagttcaattcctggatatccttgttaactttctgtctcgatctgtctaatgttgacagtggggtgttaaagtctcccattattattgtgtgggagtctaagtctctttgtaggtctctaaggacttgctttatgaatctgggtgctcctgtattggatgcatacatatttagtatagttawccwcttcttgttgaattgatcccttgaccattatgtaatggcctt

SEQ ID NO: 9962 - DNA, 56 bp, Homo sapiens
accaccgcgcctccgcctcggccgccgccgcagctgctcctggtccccgtcccttt

SEQ ID NO: 9963 - DNA, 185 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctg

SEQ ID NO: 9964 - DNA, 469 bp, Homo sapiens
atcagagtccacatatgttcgggggagggaccccagaaggcggctgacagtattcctttagccagaaatcccttcagggaagagaaaggtgctcccctttgcctgcttttatactacagactgtttccaactccagctagaagtgactattgccgattatgctaatcagtggcgacaagctccctttgactgctcacttctccagtgaggcttcaagcttctaggcatcaagattatattttccagaaaatatttcaagcagaatatacttattttccagttttgaaaacaactagattgcccatctccatttctctctatcatctactgtattattctatggacaactgccaccctaataaggtcaagaagggaagccagaagtcaaggccacagaagacacaggaaacatcatatccaaagtgggagacaaagctgttaacaggaaattatttgtaaagtcaagagc

SEQ ID NO: 9965 - DNA, 56 bp, Homo sapiens; identical to SEQ ID NO: 9962

SEQ ID NO: 9966 - DNA, 72 bp, Homo sapiens
cagacactgtgctaggagaatggaaaacaattttgaacaaaactgtctacctacatgatttttttttttttk

SEQ ID NO: 9967 - DNA, 104 bp, Homo sapiens
atatgcacttgtatattctgacagccatgtcacttacaccttctcacctktkgtctcgtcctattkgctatckaccattckaccactgtccatttckaccagct

SEQ ID NO: 9968 - DNA, 176 bp, Homo sapiens; identical to SEQ ID NO: 9953

SEQ ID NO: 9969 - DNA, 56 bp, Homo sapiens; identical to SEQ ID NO: 9962

SEQ ID NO: 9970 - DNA, 434 bp, Homo sapiens
cagacactgtgctaggagaatggaaaacaattttgaacaaaactgtctacctacatgattttttttttttttgagactgagtctcattctgttgccaggctgaggtgggagaattgcttgatcccaggaggtcaaagctacagtcagctgtgattgtgccactgcactccagttttgatgacagagggagaccctatctcaaaaataaaaaaaaagaaaagaaaaaagcagtaagaaatggtacattttatgttatgtgtatttttaccacaatttttaaaaagtgggtccagggctgtgccaccccactggcaatgctggctgccttctggaaactgcatatgcctcactccctcagtgtgtaaattcacaaacactaatggataacaacagaaaatggcatgaaaacagtaggaatcagcaattttgcacra

SEQ ID NO: 9971 - DNA, 439 bp, Homo sapiens
atatttaaattgttagctctaaaaatagattcagagaaagggtggacacatgttccaattttctcataacagtcctgggttgtgcctgttatcctggcatagttattaatcctgtcccctttcactctcagactctcctggtttggaggataatttcattctattcmaagagggaaatctacaaaaaggtgtcatcatctaacctgtattcatataaacattttccagtctcacggttctgtgtacctctccaaacccctcaatcttctaatcattttgtgtattatttataggaaaagagcaccagctaaaatatcttgcccttggatttcttcagccagctgctgaagtaatttgtcttagtctttactgaagactgaattgtatcattaagactttcttctaagtcctgttattttgactttttgactcactctgk

SEQ ID NO: 9972 - DNA, 114 bp, Homo sapiens
aatttttataaacttttgttctttcttgtaactttttatcagtcagctattccaatgaagcaaaatctgataatatattgcttttatactaaaaaaaaaaaaaaaaaaaaaaaa

SEQ ID NO: 9973 - DNA, 349 bp, Homo sapiens
gtttttgtattggaagcagttgtttggccttgctgagcaaacgtctatgccttctccattacatccaaaggagaatagccccatgtgaagaatggaatcagtagatgtttggtcgctgtaccatatccactcctaggatacaacaagagcaagcccaattctcttggtggtgtgggcagtcggcttgcaccacgtacctatctcagctctttttggaagcttatgtcctccccacaacttccagctttcttatgggacaagggtacactcaccactgccatatctaatcctgcttgcctggtaaatgttctcttcttctttacamccctgatgactctggtcamtctam

SEQ ID NO: 9974 - DNA, 505 bp, Homo sapiens
aacttggtcgggtctgcttccgcgctgtggaggttttgttttttactctttgcagtaaatcttgctgctgctcactctttgggtccgcactgcttttgtgagctgtaacactcacggagaaggtctgcaggttcatttctgagccagcgagaccaccagcccgccargaggaagacgctgccgaacatcagaaggbamcaaactccaaacacgccgcctttaagaactgtaacacctggagggtccgcggcttcatgaagtcgcagagaccaagaacccaccaattccggacacaaatgcatcattgcactccagcctgggtgacagagtgaaaccctgtctcaaaaataagcttccattgacgaccagctttggctgttccaactcaccacagcctctgaaagacccatgctctctttggattgsttggtasctgcagcacgtttccatgcctgggarggargttacatcctgaacaargtggcacagctacatcatgacatct

SEQ ID NO: 9975 - DNA, 86 bp, Homo sapiens; identical to SEQ ID NO: 9617

SEQ ID NO: 9976 - DNA, 487 bp, Homo sapiens
ttaatataatttatttcaaaataagaatatcttaaatattcaaatgaatatattaggaatttaggagccagaaaatagtgttggactaggggtaaggaaacctaattgttgtttttgttttgtcactaattggttttaagactcaagtaaatcatttattggktttactgggttccactcacctcatctatgactatttaagtttctcctaataataatcacaattctagaaaggatctttactagtcaagctcttcaggggactagatctcttccagctctctgatggggaacacaagtacacagaggttgttctgcttgatcagggttaaaggcatgctggaactagaatctaggcattcaactactactcctccctccaacctctagccagtacttctagccatacgtacaggctgcctcatcttcatctgggaataattttgcattaactacattattaaaaagaattattgcaaaacactaa

SEQ ID NO: 9977 - DNA, 338 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccmaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaaw

SEQ ID NO: 9978 - DNA, 473 bp, Homo sapiens
aagcgccccctgcggccgggaggaggacggcagccaggaaagatgaagagcgcgtgcagtccccgaaggtacacmctagggttcccccccacgcgaagtttctctccgcaatccgtgccacctatcgagtaggattcctagtgttcgattcctgtgagaaaaggtagrcctacgctgcctgtcgcagtttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcattccgccccattgaggataatgaaaagagcaaagatgtgaatggacccgaaccactcaacagccgaagcaacaaactgcactttgct

SEQ ID NO: 9979 - DNA, 438 bp, Homo sapiens
  misc_feature 339: n=a, g, c or t
tgcactatagaacaactggacctaatagatatttacagaacatttcatccaacagctgcagaatacatattcttctcctctgcacatggattattctcaaagatagaccatgtgttaggtaacaaaacaagtcataaaatatccaaaaattggaaataatgtcaagawtatyctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccanaacctataggatacaatgaaagcagtaggagagaaattgtagcaatatgtgcctacatgaaataaaaacaaaaacaaaataacttcaaataaataaaac

SEQ ID NO: 9980 - DNA, 423 bp, Homo sapiens
  misc_feature 366: n=a, g, c or t
aaacaaacaaacaaacaaaaacaaaaaaacagttacttgtggaaaggttacttatcttgatcatcccattttggtattatatgaaatagaggttgagactttggactcaggatggagctcagagacacagtggctgagccacttaggataaagcactccagcctggggcaagagcgagactccatctcaaaaaaataaaataaaggccatatgtttaatcacattccccaaaaggagaacttcataaggcactaatgagtaatgtttattttacgaatgattttacgggaaaaattacagaggatgtttaaattgcaaaaatactcctccccttttttctcctccaccgccccccaaaaaaaatcntttgcagttatcacctaagctttttgggtgtgtgatttaaaaaaaaaaaaaaaaaac

SEQ ID NO: 9981 - DNA, 283 bp, Homo sapiens
ctttttggaagaacagaagtgaatgggaaaagaaaaggtatggtaaaatcaagaaagacttctggaaagaagcagcagcattagaaattaagaacattgtctgtgaagtctttcaccagcgaggagtggggttgtgagggagaatatctgacatatcattargaacatgaaaaamctagaaggcaggagggtacagagtaactttgaggaaaaccatagaatccatgttgatgtgtgaaaggaamtcattttttagattgattcagaaatggggtaaatgaaa

SEQ ID NO: 9982 - DNA, 55 bp, Homo sapiens
gcgcgaggytgtccgctgttgggagytgccagcccttggcctggsgccgggcgac

SEQ ID NO: 9983 - DNA, 388 bp, Homo sapiens
atttagcataatttcttcaagattcatccatgtttagcatgtatcaattcttcattccttttcatggtggaataatattccattatacagattcacctcatttttttatccattcatcagtagatgggcatttgggttgcttccagttttgggctattatgaatwatactgctgtgraacattcatgtacaattttttgtacagacatatgtttttatttctcttgggtataaggctataagtggaattgctgaatcatatgattcttttggctattctggatccctggaatttttatgtgaattttaggatcagcttgtcaatttctgcaaaaaacaaaacaaaacaaaacaaaccaggattttggagatttacctaagatacagaa

SEQ ID NO: 9984 - DNA, 71 bp, Homo sapiens
atttccaaagccatggtgaaacatctctgtgctaatttcttttgttttgtttcctaatttttttttttttk

SEQ ID NO: 9985 - DNA, 485 bp, Homo sapiens
gtattgttccgggccaggtcaaaacagtgagcttccgagtttcttggtacatatgttgcagtagcatacctaaaactgttatatgttgcctctagacttcagagagtcccaaaaggcaccacgctattttcttggttgtagatttcagatatagcctctttccatttaccttggagcagatatgttttcatgggctcagactgaagaaaaccttgaaacttaaacaaaaggtcagacattgaatttttatggggctctatttctcattttcaggcatacaagtatcttaccaaggcttctgagatattcaatacatcctgcttacagagtccaataaractgctacaattaatagagggaactagcatgatgtcttctggaagaatacaattatacaggtccctataccttacattttgagagagagctagagggttgatatatctttcacgaaagtgaatgacaccttttttctttttctgtct

SEQ ID NO: 9986 - DNA, 162 bp, Homo sapiens
agtggtggtggaagtggtggaagggtggaagggctatttaaatttttattcatcctctgattggttgtttcacttaagcctctaattggttcttgagtcctggagcctgtgaagggtactttattttcagtaaatgcatgctttttttgtttaaaaaaaaaa

SEQ ID NO: 9987 - DNA, 455 bp, Homo sapiens
ttatttaaaaatgttttttggtttttattctgaagtggtcagaagattaaatagagtattccaagagaagcactgagagcggtacctgctgtgtaatatgtgctatgtaaatgttaactgttcatttcttattatgtcatcagtgttccagggtagraaatgcataacctggctgggcacggtagctcacacctgtaatcccagtactttgggaggctgaggcaggcagatcacttgaggtctggagttcaagacggcctggccaacgtggtgaaaccccatctctgctaaaaacacaaaaattagccaggcgtggtggcgggcacctgtaatctcagctactcaggaggctagggcaggagaatcgcttgaacccaggagtcgcactctgcagtgagctgagatcgtgccaccgcactccagtctgggtgacagagcaagactccgtctcagaa

SEQ ID NO: 9988 - DNA, 488 bp, Homo sapiens
aaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcgggtccgaactcggggacggagaagggcagactagtcatcccggagaagcaggggtgagggggtcggctaggatgaggaggggagagactattactctttggaggggaggagcctcggacccagtaacgtgaggaaaataacttgtgggaggcctgtggtcactgagtcccaaagttgggagagttgttgggtaaactctaaagggccctggaggtcgcgattattgtctgggagtgggaggaggtgttagggggcaagggagagaagaggctaattttgacgggggaggcatgggcagaactggggcaaatctggatgtgatggtcttggaaacatactgaca

SEQ ID NO: 9989 - DNA, 383 bp, Homo sapiens
agcagtgagaaaagtgagcctcagatgagtggttgcccttcagcaggaacatggacagctcatccacagtaatgggagggggcagggggatgattgtcctgttgggaaatgtggaacttcttcctgacccatcctggtttactcattaaatgtgsctcaargtcatcggatgaaagagaagattggaagaagctactgaaggtaaagcagaaatataagggataattcctcadctacagtggacagagctggaatctgagccaagcggasagtcatgctgagttcaggaagcctcactgctaaatgccacctatcaaagtggcctcccctgaccatcctgtgtaaaataatccctccttcctctctaaaaaaaaaaaaaaaaa

SEQ ID NO: 9990 - DNA, 491 bp, Homo sapiens
tgttaattggattatgtaactctgttactagtctgttattggctgttgttactggatgcatcttgatattcagaagaataactgtgaggcattcttcagttgcgggttaagtggggttagtttctgttctgtcagatgccctttttcagtcaaaggttagccccttgtttctccctccttccagggtttagggagtgcagtgatgtcgatttcatttcccttccccgcaccccttgacactcagcaggattgcactgaaacccttcacagatctctcgttcactagttgtctcctatttttccataactagcactagtttggccttatgacctggttagaatcactcttctgtattctcatttccaatttttgtgccactaacgtggactagagaaacttggcctgctgtgcagtgggccttctgttcaacttaccctccamcgctgaccctgtgtgaagagagatggtgcgttactgccatctaatggga

SEQ ID NO: 9991 - DNA, 500 bp, Homo sapiens
actgaacaggaagttaggaaaagatgcacatcatctgctctcctgaaccaataagagccagttccaagacaccataactgattgctatattttaggatttttttctgattataaagtgtatctttctagaaaccatagaaatttcaatatatgctcaaactgaagccattcctaatgggaatatcagaaaaagaagaacttggaattcagaaggaaaagtaaagaaactggttaagaattaataaaggctttagcaatgaacttttaagatagctaaagctggaagaaaataaactccgaagttcgaactgtgttcctgtatttgttagctctcaagggaattgagggtgaagaaggagctaaaggcaggagctttggcaagatatcatcaagccaaatatcagataatctcatatgtttaactaagctgagttaattaaataatgattgcccaagatttttccacctcgaacatccaaataacgacagatgtctgacac

SEQ ID NO: 9992 - DNA, 448 bp, Homo sapiens
atttagcgcctcctgactgccgaatgggggctcgccttggtctccgtgctgattggctggcagctgtacagcctggcacttcgccctccaccacatctcacctcctgagggactctgagagaacgcccggccagggtgaacgccgcggcaggagagcacgggagactgtgaagagcatggggagcctttgtcgtgcagcgtgaaacccttgagcctttggcctaggagctgggagactcagggcccttctcacactcagaattggagcagggccttctagacagtcccagcaccatgagccctgaaaagtcccaagaggagagcccagaagaagacacagagagaacagagcggaasccatggtcaaagatgccttcaaagacatttccatatacttcaccaaggaagaatgggcagagatgggagactgggagaaaactcgctatag

SEQ ID NO: 9993 - DNA, 355 bp, Homo sapiens
  misc_feature 223..226: n=a, g, c or t
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaaccccatctctactaaaaatacaaaaattagctgggcatggtannnnaagcctgtaatccagttacttgggaggctaaggtagcagaattacttgaatctgggaggcagaggttgcagtgagccaagattgcgccactgcactccagcctgggtgacagagtcagactctgtctcv

SEQ ID NO: 9994 - DNA, 142 bp, Homo sapiens
aaaccaggatccccactgaagacaggccagggkggtcggawatcacttgggggatggtggaggatgagatattgagggtccagccgtccattccggtggaggcagaggcagtcctggggctctggggctcaaaaaaaaaaaa

SEQ ID NO: 9995 - DNA, 481 bp, Homo sapiens
aaaaaggatggcccctgtgtttgagggccttggcagcaactgccctgctagtacaagaagcaaataagctgactcttgggcagaacctgaacacaaaggccccccatgctgtggtgactttaatgaatactaaaggacatcatgagccctgtcgagcatgattgtgtagaagtgttggactcagttgactctagcagacccgacctccgggaccagccttgggcatcagtagactgggaactataggtggacgggagcagctttgtcaacccccatggagagagaggtgcagggtattcagtggtaaccctggacactcaacaacttgaaggcagatcattgccccaggccacttcagcccagtaagctgaactcattgctttaattcgggccttagaactcagtgaaggtaagactgtcaacacttacactgattcttggtatgcctttttaagccttcaagtgcatggagtgtgacaga

SEQ ID NO: 9996 - DNA, 367 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgacaccgcgcccggcctgagtgagtcttaatccgtggc

SEQ ID NO: 9997 - DNA, 86 bp, Homo sapiens; identical to SEQ ID NO: 9617

SEQ ID NO: 9998 - DNA, 327 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagctycccaagtagctggggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaad

SEQ ID NO: 9999 - DNA, 348 bp, Homo sapiens
gttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtggggcrktgatcactggagcaggcgatggaattgggaaagcgtactcgttcgagttctgcaggcttgtacaggaaggatgatgctggcatttgctcggcttcggaggcctcaggaaacttacaaacgtggcggaaggcaaagagggagcgagcacttctcatgcctggagcagcaggaagagaaggg

SEQ ID NO: 10000 - DNA, 479 bp, Homo sapiens
taaagagtagggtatttctataacaratattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttmcmttcttggaagggaacattgatatttaacagagtttttagagattgtcatctcatatatataaaawggacacgtggctataaaacaccatataagagatgagtagtgcgttttattttatatgccaatctactttgtttaaaaaaggtctgaatcaggacttgtgaaaac

SEQ ID NO: 10001 - DNA, 487 bp, Homo sapiens
  misc_feature 336..337,368,370: n=a, g, c or t
ttagacgttgaaagtcttaaacgacatccttcctttacagcgttaaatatctgttcctgatttcagaaatagacaatataataacacaaaacataagagaaatggatgtagagatgaaaacatgtagggcaggcatttaattggtgggatcacatgctcagtaatttgttttgtccaccagtgattgattctgcttgtgtattgactatttgagaacactgtctctgtgaggcctggctgactcttggatgtcttttaaactgattctaggcagagaggttttctgaccagagctgtgaatttatggtagcaactctacaaaaataagtgaathbnnatttttaaaactgttgcttatccaagathynrngaaaagaacaaacataaaaagggatcaccagccttttgcaaatgcacacgatgtgctagcccgctcccgcagtcgagccaacgtgctgaacaaggtagaatatgcacagcagcgctg

SEQ ID NO: 10002 - DNA, 325 bp, Homo sapiens
  misc_feature 221: n=a, g, c or t
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttwngtatttttagtagagatggggtttcaccttgttggccaggttgcagtgagccgagattgtgccatgcaccccatcctggcgacagagcgagactctgtctcaar

SEQ ID NO: 10003 - DNA, 367 bp, Homo sapiens
ttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaaaatggaattgattattttcctttttggccatcacgtacacatgtaatctggaaaatcatacctttgtcaattttaaacataacttttgcatttcccagatttatactatgaagggggtaatacattttattttttcattgctatatgacagctaaggggcaaatgattcaagtatattttaaatcagr

SEQ ID NO: 10004 - DNA, 437 bp, Homo sapiens
agaatgtcaaacttctgttggtacattgttagccaaaatgaagacctgtgttgatacctatacgaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggggctatgaaacccaaacctttgtcagtattaaagtcacttgaagaaaaatatgtggctgttatgaagaaattacagtttgatacgtttgaaatggtttctgaagatgaagatgggaaattgggatttaaagtaaatbaccactacatgtctcaggtgaaaaatgctaatgatgcgaacagtgctgc

SEQ ID NO: 10005 - DNA, 364 bp, Homo sapiens
  misc_feature 168: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcagganatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagwvaccctacaagctagaaaagagtaag

SEQ ID NO: 10006 - DNA, 476 bp, Homo sapiens
aaaaaacatgtgcaacatttccagaaatgtaccagagttgttcgtgatcataaccccaaatcattggtacctcgatgtttagaggggaaacagcattggctgggcaagctggggcagggaacgtgatgaacagtgggctggaataagttaactggaggaggggaggcgtctcaggaagggagaatagcatgaacagcagcatagacgtgagaataaccatctggagtgatgaacctatgctgagtagaaagttccagaaggctgcataagggaggtgtgtgaacagcagaagcaggacaaacctgagatgctactgcacagaccgtgtaaatgaacaggacagccagagagggagaagatggctaaactgaagcaacttggagctagaagataggctgcatctgctcagttcacctgcgcagaccaaaaacagtgcacgctgtagggggcccagtccagctgaatttcatcagatg

SEQ ID NO: 10007 - DNA, 486 bp, Homo sapiens
  misc_feature 74,90,214: n=a, g, c or t
accattggaatgcctcattctgcactctcttgacctcaccttcttctggtctttccacacctcaagcaagccancccgccctttccaranccagccccgcccaccctcgccactcggagatgtttacgtctccaaagagccctcacgtctgtaaccaaaagagggggaaggcggggcctggcgttgtcacgtggctgtaccaccccggaccacngagagagcggtccgcactactttcccgttgacgtcggcggagggatacaaaacgaaatagctcaccggaagtgcgctgctcgcaccccgggacccgcccgggctgccggctgatgtggaccgtccgacccgcgtgtctgataatcctttgacgggttttggtcggcggagaatggtctctaaacttcccaaaccgcccccgtttcacgtcctgtgaaaggaagtgctcctctgatgaccaatcagcggcgagaagctcttttaacgtccgtc

SEQ ID NO: 10008 - DNA, 415 bp, Homo sapiens
  misc_feature 373,375: n=a, g, c or t
tagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgmattatgtgcaggtatgatattttcttcactactttttctatcttaatatagtgtggaattttattgtattattcttccattcttaatactgtaccacattcctgctcagaaactggwcacttccttaaattgtcttttttcccccagcgtgaanbnbatccatttataactgcctattgcctgttctattagcatc

SEQ ID NO: 10009 - DNA, 289 bp, Homo sapiens
ctcagcatctggagtagctgggattacaggcacatgccaccacgtctggataatttttgtatttttagtagagacggggtttcaccatgctggtcaagctggtctccaactcctgacctcaagtcatctgcccgtgtcggtctccggaaagtrcctgggattacaggcctgagccaccacactccacccctaatcaccccttctaataaagacacagctcatgtaggatgagagctaaaaaaaaaaaaaaaaaaaaaaaaaaaaaaaaaaaaaaaaaaaaaaaaaaaah

SEQ ID NO: 10010 - DNA, 440 bp, Homo sapiens
  misc_feature 360,363,376: n=a, g, c or t
acttcaaatctaattttatttaaaagaattagtaatgattttttgagtgaagttttcagaaattgcactaagtattttttaatgcttcagtgaaatatggaacacatgagataagttatatttggttgatgaagttattctgaaaaaacgctatttggaaaggtgaacttctgaaactacaataacatttcatctattcccaggaagaaatattcctaaggtgaagaaactgtgcaacatgcccagatcatacaacaaggaagtaatggaattgagattctatcctgggcgccaagcattgctctaaatctctatgctgcacaagatacagctgagtaaagattagtaacaacaaaaaanaancamcaaaaaaggncaagtcccagggaaggttcctgtgagtctttatgatccactggccataatttagagagaggcat

SEQ ID NO: 10011 - DNA, 326 bp, Homo sapiens
  misc_feature 105: n=a, g, c or t
ataaaaaatgttatattaggttggtgcaaaagtaattgtgttttatttatttatttatttattattttttcctttgagacagagttttgttctggagtgcagcgntgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaa

SEQ ID NO: 10012 - DNA, 361 bp, Homo sapiens
aacaagaattacaaaacttagccagggtgcatcagtaccaataggatatcatttttcaaagatacctattgagtgcagaaaaggaacatctgaaggaacgcctgacgagtctgaacccttggcggaaagaagcctgagtaggctgaacacttggtggagggagcgcctgatgaggctgcacgcttggcgaaaagaacacccaacgaggctacacccttcgtagagggaacatctgagattatcgcatatcctagaaaagaaacatctacaaaagcaaatacaaatgggtttcactatgttggccagagtcgaactcctgaccttgtgatccacccacctcggcctccaaaagtgctgggat

SEQ ID NO: 10013 - DNA, 514 bp, Homo sapiens
gtaagttcatactaactgtttaaaatggcagccagagctacagctatccaatcaatgttctagtcagtagtaggaggaatggaagaaaattgttggccacaggagaaatttgacaaagtgcatagaagccacccgatgctactgatcattctacagttcacagraaaggaaaactgagtctcaaaaactatcttgtacagattctcagacctaccatgggatggaacttaattatgagccccagactccaaaaacatcacatcctaccagattcatggctgaagcgtctgaaacaagactaacaagactaacgagattaacaagagaaaaacatacaaatttttaaaatataagttgtatgtgacatagaagcatttataaagaaaagaagaccagaagaaacgggtagacctgggtatttttatgctacttttgatgaaaatgggaatgcttttggagacgcatgagtgaataaaaaaatatgatctaatggtaataaactagaggaaacagr

SEQ ID NO: 10014 - DNA, 476 bp, Homo sapiens
atattttctaagcccagcaccaagtgctgtgagtctcctgactgggcctgccacagggagaatcgtgatctttccctggactcaatacctaggtcatgtactctcctttctacctagacccagcctacaagggtgtgattttgacctataccttttcctagtacctgagtgatttgcctctttagcctgggctaatcccacagataggattgtgacatatacctggcacaagaacctagggggcattgttacatattcctggcccagaacctaggtgatgtgactctcctacctggtcactgctcacaggtaggatggtgactgtcaaaccaagattcaacacaacattgagaatatggctgccctgctaggacgttgttcacaggtggagttgaggctgtcatttatggatcttgtccaccattgagattccgtctcacacacttgggcacaaatcacagaaggtggtgactctc

SEQ ID NO: 10015 - DNA, 289 bp, Homo sapiens
agaataatagagggttccgtctatgaagaagggtaactcctgggtcacagtgaattagtgascaggcaggattccagaggcctttccttcccacttccaccttgaattccaacttaaaatgcaagccatgtacagagaatgaacagagggscagaaatgtgctacgtttgcctgtgtataacagccaccadctattacagaagaagaatttgtaagtatcatttcaaggggctatttttttctttggsctttaaaaaaatagcaaatattagatcatagaagaaaaaam

SEQ ID NO: 10016 - DNA, 411 bp, Homo sapiens
  misc_feature 383,386: n=a, g, c or t
aattgatttcaaaccaagatgtaagtctaaattgaagataaagtgaggatagtccttagcttatttaagtacttaatgcttaggaactgtaactaaacaattgggacacttggaaagatatcacctggctgcaaactacagttatttggttaacaaattttcactggttttgggaaaaacagacttagaatagggagacatactcctgtcgtccaacattttggtgataatcaaggacaaatttgaaaaagtgaagaaactgtgcaacatgcccagatcatacaacaaggaagtaatggaattgagattctatcctgggcgccaagccattgctctaaatctctatgctgcacaagatacagctgagtaaagattagtaacancanaaaaaacaacaaaaaaagacaagtc

SEQ ID NO: 10017 - DNA, 246 bp, Homo sapiens
gactagtataattatcatggattagttgttatagatagacccacatcaactgagactttctccttggcttcatcaaagattgaaggggaattgataggtaggcggtctctgtaccaccttgcaccatgcatgtacaccagtgagtaacacgtgtgtyccccaatctggagaatatctttctatggaataaaccccaccattctttgtgtaggattcaaaaaaaaaaaaaaaaaaaaaaaaaaarar

SEQ ID NO: 10018 - DNA, 432 bp, Homo sapiens
  misc_feature 338..339: n=a, g, c or t
aagggaataaacgcaggctgccagagsasvagcggcgaactgctggggtccctttccatgctgtggaagctttattctttcgctcttcacaataaatgttgctgctgctcactctttgtgtccaggccaactttatgagctgtaascctcactgcgaaagtctgcagcttcactcctgaagccagcgagacgaggaacccaccgggagggacagacaactccagacagaaagaacgaacaactccagacagaaagaacgaacaactccagacgcgctgcctttaagagctgtaatactcaccaaaggtctgcagcttcgstcctgaaacctgsmwtrnnatgaacccaccagaaggaagacactscggasacagctgaacatcagaaggracaaattscggrcataccatctttaagaactgtatcactcac

SEQ ID NO: 10019 - DNA, 502 bp, Homo sapiens
acattccaccttctgcccattccacctgagttactgagttggcaaagaaacaaattcttttcattcccattccacctgagttgctgagttagcaaagaagcaaattattttcaatcccaaagctaagaggcatcagtcccatacaacaagcagaaaggcagtccaaagatggggctgagagtcacactgtcagctcaggagtcacagtgcctgggctccaatcccagatccaccccattgtaacctgggacaagctcttcaatatctgtgtgtcttagtttcctcatctggaagagaacagggcggasaggatgggcagacagagacaacgtccagcacaggcatcaacatcacaggccaggagggcttccagaagccatcactccctcccctgcctccaggagggtctgcacacccacctttgtcatgaaaggctggtctccttgttctagaacacatcttccctatgctctcctgagtaaacatcccagtgattctctaa

SEQ ID NO: 10020 - DNA, 326 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccsmrtcctggcgacagagcgagactctgtctcaaaa

SEQ ID NO: 10021 - DNA, 141 bp, Homo sapiens
  misc_feature 91..92: n=a, g, c or t
aagaagtagagttgcggttccctcgggagaggggcggaggctcagaggtgcaccacgtggggtttgctgccggagctgagtctccggccgnnmtccagtttgagtctaggttggagttggaaccgtggagatgcggaagga

SEQ ID NO: 10022 - DNA, 445 bp, Homo sapiens
  misc_feature 10,155,368,374: n=a, g, c or t
actctatcgnbcaggctggagtgcagtggsgggrtctcagacccctgcaacctctgcctcctgggttgaagcaattctcctgtctcagcctccctagtagctgggattacaggcgcccgccacctcgctcggctagtttttttattttagcagrnacggcgtttcaccatgttggccaggctggtctcgaactcctgaggcaagagaatcgctcgaacccaggaggcagaggttgcagtgwggcaagatcacgctactgcactccagcctgggtgagagagcaagactctgtctcaaaaaataataataataataaatgatgaatgatttatattttcttcttcttgcttactgatattttctaatknaddkmnaagtgaaataaatgttccttctctaaaaattttttttcaataaaattattaggttgctcttgtttctttta

SEQ ID NO: 10023 - DNA, 212 bp, Homo sapiens
gtatggagcttccggaagtcttggcggctgtaccagcgctaatgttcctccttttcctgaggtggagtgggccgaagaggtggtcaggttgggaaatttagtgagaagcctgggtggggtgttgctgcggtaccatgttataacctggcaagtkggacschtkrtwagtgwcgyaattsctggagtagctcctgagtttccgcagatgagcc

SEQ ID NO: 10024 - DNA, 119 bp, Homo sapiens
aatttttataaacttttgttctttcttgtaactttttatcagtcagctattccaatgaagcaaaatctgataatatattgcttttatactaaaaaaaaaaaaaaaaaaaaaaaaaaaaw

SEQ ID NO: 10025 - DNA, 337 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagctycccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaaw

SEQ ID NO: 10026 - DNA, 146 bp, Homo sapiens
aaatatatgttctttctacatcacccctctttctactaaaaataatctcagtaagattattattattattattatttttgagacagagttccactgcactctagcctgggtgacagagtgagaccctgtctcaaaaaaaaaaagam

SEQ ID NO: 10027 - DNA, 468 bp, Homo sapiens
tgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggraactgarggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgact

SEQ ID NO: 10028 - DNA, 396 bp, Homo sapiens
tactcagcatcgctcagggcactgcattacgccttccaggcaattatacaaggtactgcttgagcttaagcaaactgagagaagatttagcacactttctaaaggtaatatcataaatagacattgattccmatcattttgtttattttgagatggagtctttctgtgtcacccaggctggagtacagtggcgtgatctcgtctctactaaaaatgcaaaaattagctgtaaatggtggtgggcacctgtggttccagctgctttggaggctgagacagaagagttgattgaacctgggagttggaggttgcggtgagccaagattgtgccattgcattccagcttgggtgacagagtgagactctatcttaaaaataaaataaaatkkatttatt

SEQ ID NO: 10029 - DNA, 436 bp, Homo sapiens
ccaatctatgtttcaattagtaattcaagtaattttgatgtacattgagtttgagaaccactggcttagagcaataaagatccatcccttggggctagggaaaggcctagcctcctttgaaggatatgaggccaagaagaggagaagagagaagggggaagaatgaatgttagataggcaaccaaacatgtttacacaattcttcagggagtatgatctttcttacttagtgccagctactattgctgccctcccttcttttattctctgtgtgggcctcaagatgccatactgatctacctgcttaatctctgaaggagcacactgtatctcaaaaatgtgacgccttagttgcttctgattatcacaccactgtggctatgatttgtttgtttgctgtgaagggcttttagtttctttagattataaaaatagg

SEQ ID NO: 10030 - DNA, 452 bp, Homo sapiens
  misc_feature 340..341: n=a, g, c or t
acttctcttgctggtgactcattcagaaatcccaaagttagtcctgaaccccaggactacctcttattttctgggagaaccaggacaaatcacttgcttttctatctctttacccttcatgggtaccgtgactcacattataaactcgctgagggtaggaccctgcttctcatttgtgaaaaacgagttcgaaagacggtcttgaaaaattccttcaaagtatgaaatcccacgcatgcaaaactccgtgcctgtctcttcgtgatactctgaagtggtgcgcgcacacagtgggtaaccaaggatgagctcggtgtaaggaatggaaagcccccagtvnnaaccaccgccccctagacacgggtgaaaacctgcctaaaagctaactcaggcagtgactctatcacccgaaggsccctaggcgcggcgaccgggcttttgaggacacttac

SEQ ID NO: 10031 - DNA, 471 bp, Homo sapiens
  misc_feature 422: n=a, g, c or t
tcctttcgatgtcgacgggaggaaactgtcacgcaggccaccaaccggcggtggagggcgcggtgccgagtcctgccactgcagggtcgccccgctggctcaagctctagaagcgtagacctccccagccgcaaaaagcaactcacgcggcgaaaccgcggactcttttgacccttccgagctaccatttactttccatagaggggcgggacttcctgtttcgcttttatcttctcgagtgcagtggtgagaacacggcttactgcagcctcaaaatcctggacccaaaagatcctcccacctcagcctgcctcccaggtagctgggactacaggcgcacaacaccatcgcttcttggattaaaagaaaaggatgaaacgggccccagaaagaggcggtgacgtcccagaacccatgdswwngggagttgggaaaataaatatttgtattgttttaatctcccttgtggcc

SEQ ID NO: 10032 - DNA, 564 bp, Homo sapiens
cgtcccgcgctccgcttggcccaagatggcggcctccgtgtgcagcgggttgctggggccacgggtgctgtcctggagccgagagctgccttgcgcttggcsgccctgcacacctccccggtctgcgccaagaaccgggcggcccgagtacgcgtaasaagggggacaagccggtgacctacgaggaggcacacgcgccgcactacatcgcccaccgtaaaggctggctgtcgctgcacacaggtaacctggatggagaggaccatgccgcagagcgaacggtggaggatgttttccttcgcaagttcatgtggggtacttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagacaatccccttttttccatcaagctgtagctgcagaga

SEQ ID NO: 10033 - DNA, 463 bp, Homo sapiens
agcaacgtgctcgggtccccttccacactgtggaagctttgttctttcgctgtttgcaataaatcttgctactgctcactctttgggtccatgctgcatttatgagctgtaacactcaccgcgaaaatctgcagcttcamttctgagcccagtgagactacgagcccaccgggaggaaggaacaactccagatacgctgccttaagagctgtaacactcaccgcgaagatctgcggctttattcctgagccagcgagaccacgaacccacgagaaggaagaaactccgaacacatctgaatatcagaagggacaggctccagacacaccaccttaagagctgtaatgcacaccgcgagggtccacggcttcattcttgaagtcagtgagaccaagaagccaccacttccggacacaagataatgccactgcactccagtttgggcaatacagtgagactctca

SEQ ID NO: 10034 - DNA, 461 bp, Homo sapiens
aagctcccagaagacagaggttttgttcagttcactactggattcctaatacttggaacagtgcctggacagagtaggtgcttaaaacttatttttgagtcaatggataattgacatggctggtttgaacttctggatcttttgctttgctttcacacaaggattacttataccaatactttattttaaaatctctggaaatgagaccatctgaaatcagataaatatggcttcagataccagctctggcactactagttgcatgatcatcaatatgttacttctctgtgccttagtttccacatctgaaaattgagggtaagagtccctctctagatttgtgaatgggatgaacacaggattttaagtacggttagccagcatccaagatggcctcaatgatctctgcctctggtatttatgcccttgagtaatcccattccacatgtctcgggttggtc

SEQ ID NO: 10035 - DNA, 439 bp, Homo sapiens
  misc_feature 156..160,182,368: n=a, g, c or t
catacagattaatttaatataaatttttttttattatactttaagttttagggtacatgtgcacattgtgcaggttagttacatatgtatacatgtgccatgctggtgcgctgcaccactaactcgtcatctagcattaggtatatcccaatgctnnnnnctcvcccctccmmccaccckancacagtccacagagggtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcatttttgatggctggnvagtattccatggtgtatatgtgccatattttcttaatccagtctatcattgttggacatttgggttggtt

SEQ ID NO: 10036 - DNA, 86 bp, Homo sapiens; identical to SEQ ID NO: 9617

SEQ ID NO: 10037 - DNA, 478 bp, Homo sapiens
tttgtgtgtgaaagtataacagataggctagtattcacaagccagagtcattcccaaattcttgttctcaacggagcaataatattttttaaattactcttttttattgactcctcactcacctaagagtgcacttttatctcttggcagtggtcatttaatggtttatttttttctgcccaaacttacatttttaaagataattcttgaatgcgatctgaaacaataattgtgacggagactgtatagcgtctgaaaatgtcagatccatcacatatcttgttgttgtctataaaaaagtaacatttgctcagtcctttgttccaagctaacctacgaaccccatctaagtatatgctctagaaatatacgtgccaatgcactttgattcctactacgttttatcctttgactctcaatttgaagagtttcctaatttacagtcctgacaaaataatttataagttctgtcatcccc

SEQ ID NO: 10038 - DNA, 288 bp, Homo sapiens
agttccagcggcggctacggtggtggcagttccggcggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggataaaaaaaaaaaaaaar

SEQ ID NO: 10039 - DNA, 393 bp, Homo sapiens
attatttttttgacagggattaaaactgcctatgctaaatatctggattctttacctcctccctggttgggccactgttgtatgttaagagttagacacttcatgtcgtgagcagttgagccagccatgtgggatcaatttcactgtgaacccacaggactccaaaccatgccttttttgttgttgctattcaaagtgaatgctgagatgtaaggtcatctcccactgcctgtgtctgctatggatgtgagctgcaatgtgacaggaggcccccaagattagaaggcagcctggcaaggcaggacggtcagaagatggggctgaaactccaactcacttcttggctataggttccttggcacgtcattttctctgtttttttttttttttttc

SEQ ID NO: 10040 - DNA, 435 bp, Homo sapiens
gctcttgtttactctctctcagcagcatcatgtaagatgtgcctgctcccccttccgccatgattgtattctccactggttgaatgcaaatggaagccagaggaaaagggaacccttgacacagttttcatatagattggcctccagggcagacagcagattccaagaaccaggaggttgtttgctgtactctcccttgtacagttagctgtctctagtgcctgaatgcactaattgtcctttgggtatggatgaggtaatgaaggaaagggatgctgggaagagaggcbwcatgagaagtggttchtaacttgatgtatacaaattttctgagaagattatttaaaaagtagtttccacccaatccaaggattccgattcagcagggctgaggtactccgaagcagggtatggattctgctttcatcttccaac

SEQ ID NO: 10041 - DNA, 433 bp, Homo sapiens
  misc_feature 364,366: n=a, g, c or t
attctcctgcctcagcctcccgagtagctgggactacaggcgcctgccaccacgcccagctaatttttttgtgtttttagtagaaacagggtttcaccgtgttagccaggatagtcthgatctccggacctcgtgatccgcccgcctcagcctcccaaagtgctgggattdyaggctcatcaagagttcatataactagacctgtcttggagcaatttttatcttttgcaaaataccttgatggtttatctcatggagcacctttgctgaagcagctttgtgatcatattttgtttattaacccaccatctggatacatacacctgcaaaggttcaactttccctatatacatatttgtctgananatttattggaactgctaccatctacaccaccatacgcagaataggaacagttattaaagataatgca

SEQ ID NO: 10042 - DNA, 483 bp, Homo sapiens
acactgcgcagaaaacgtgttggcggccgcacacaaactctcggggcccaaacaaacacaggctgattccactgggcgcctctgctccttggacagctgggggagccaaggggctagtcttaggggattgggggccgctcccttctcaggagggtttcgctaccagggcattttaactggagtccaagagcccatgcaaacgcacgccccgctgcgacaactggccttgcctgagtgaaagtccgtaacgcaggcccccaaccacgctctccctggcacggaggacacaggcgccagacgggtccagctcagggtgttaagaggaagtaagggagggagggaggagagaaggaaggaagacagaaccatcagcaccgtgactggcccggcccggccccgaccccagcaagccatacttacttcttcacgttggcctccccgttgggatccttcgcaacttcttcttcttgaggatcttgacgg

SEQ ID NO: 10043 - DNA, 437 bp, Homo sapiens
attttcagtctcagaggaatcattttgtagtatactcttggtcatgcctataggagtcagggacctagcctttgtttttgagggagttctagttattggcaaagttatccaagtgcaaatataaatttttaaatgtaaattttaaaggtttcatatgcccggttattgtcccaaatgcacatgcagaaaaataagttgtgcctgatgaactaaatgtgggctaaccaacagattaatcagaaagtatgtgtaattgtagacaatgaatttttttgtctctcaacctaatgtacagttattttgaagtgaaaggaaactatatctcagggaattatatttagattgtcttcctttttctaagaaataaaaactgagtaaaaaaaagacaaaatttaaattcaaatgggcaaatatatttttgtcaaatgtatattttt

SEQ ID NO: 10044 - DNA, 461 bp, Homo sapiens
  misc_feature 197: n=a, g, c or t
ttgtctctactgatatgtcttattaacatctgahaaaatatatattttttattggwaaattctaatttgttaggccttgaaagttttgtgacaattattttgctgtgtttaaccacaatcattcaccttatggcatgctttgattactagacttcaggcagtctcattcattgtatcatacttacacacaattagcnagttgtctccatgtgtgctatatgtctgaggtgtatggagtttttatttaaaaagtgtgccagtctgaatataagcatttgattttgtaacattggacttttcttaaaagtacagaggttcaaagtataggtatgtccattggcataagaatagagtgggtgagggtctggaccaggttccaggttggtccagtcwgatgccagaacawagaagaacagtcaactaaactggtctacttcaaaaatagtgggcctgtgtgaaga

SEQ ID NO: 10045 - DNA, 135 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaad

SEQ ID NO: 10046 - DNA, 72 bp, Homo sapiens; identical to SEQ ID NO: 9589

SEQ ID NO: 10047 - DNA, 78 bp, Homo sapiens; identical to SEQ ID NO: 9745

SEQ ID NO: 10048 - DNA, 230 bp, Homo sapiens
  misc_feature 169..171: n=a, g, c or t
agaatagcttgaacctgggaggcggttgcagtgagccgagattgtgccattgcactccagcctgggcaacggagtgagactccagctcaaaaaaaaatgtatataggggcacacatttttacctctggcctttggattctatatggcttagcatggcactcctgaatcnnntctttatttaaatttgtgttttttttcgtcatggacctttttttttttttttttttttk

SEQ ID NO: 10049 - DNA, 162 bp, Homo sapiens
acaactcgcggggattgttttccacactgtggaagctttgttcttttcgttttttgcagtaaatcttgctgctgctcactttttgggtccacattgctttcatgagctgtaccactcaccgtgaagatctgcagcttcacttcagagcctagcgagaccacg

SEQ ID NO: 10050 - DNA, 391 bp, Homo sapiens
gtgtggttcagtgttctgtgggctgtagcagtgcccctaatggtggtttatacccatattaaggaggatgtgtagagtgtggtaatggtagtgactggagtgtggtaagggccttcctctgatgctaataatgtaacagtttctcggccgggagcagtggctcacgcctgtaatcccagcacttcgggaggccgaagcgggcggatcacctgagaaaagtcctccatacattttctccccaattccattccttgggcatgccatagcattttgggaaaagtccaattgaaatttctagaaatgcatatgagaagtatggacctgtatttagttttaccatggtaggcaagacatttacttaccttctggggaktgatgctgctgcactgct

SEQ ID NO: 10051 - DNA, 120 bp, Homo sapiens
aatttttataaacttttgttctttcttgtaactttttatcagtcagctattccaatgaagcaaaatctgataatatattgcttttatactaaaaaaaaaaaaaaaaaaaaaaaaaaaaaw

SEQ ID NO: 10052 - DNA, 329 bp, Homo sapiens
cccggaactgcaccggaagcctgcatgggccgcccttgtccgagggcttgcagccttacccagctttcccttttccttacttggatacttttatgaccgttttcctgccwracccccctgtctgtcctctgttgtcgccatcgtttttgccatgtccattcctgggggcgacasyccttctgcgatatcaccctcaatgtcgtcagcaatgagtccaactctggacccacccccttcagtcaccagccaaaggagagaggaggaaaagtgggaggcacaaagcgaggggcaccgttcattacttcgagaagcagctcacccttgcagtt

SEQ ID NO: 10053 - DNA, 438 bp, Homo sapiens
ccatctcccaatagaactttgaaattcactcagcttttcctttcatgctgtttgttgcctgcttgttgcactcctcctgssccagaactgcaaggtttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagct

SEQ ID NO: 10054 - DNA, 120 bp, Homo sapiens
ataaaaatggtgtgataggccgggcgcagtggctcacgcctgtaatcccagcactttgggaggcccaggcgggtggatcatgaggtcaggagatggagaccatcctggctaacacggtga

SEQ ID NO: 10055 - DNA, 227 bp, Homo sapiens
  misc_feature 77: n=a, g, c or t
agaatagcttgaacctgggaggcggttgcagtgagccgagattgtgccattgcactccagcctgggcaacggagtrngactccagctcaaaaaaaaatgtatataggggcacacatttttacctctggcctttggattctatatggcttagcatggcactcctgaatcctgtctttatttaaatttgtgttttttttcgtcatggaccttttttttttttttttttt

SEQ ID NO: 10056 - DNA, 94 bp, Homo sapiens
tttcctttcgtctcccccttcttccctcttctgtgctctcargactttccccctcttgctgccgcagggtaactggctgtgtaragaggctgct

SEQ ID NO: 10057 - DNA, 430 bp, Homo sapiens
ctggaagcatttttataccatcttgaaatttcaacaaactggcttttgccrttaatccagctgtctttcaagaataaaagttggggttttcaaggatcgcctcttctatattttaaatggattttbagtagaaatgattttkactaatcaagttaatcccaccccatcaaaaggtattcctagaaatgtcatagacctaggtaactttgaattgaatgggagctaacgttctttccaaagttttcaggtattctttgtgtgacaccttctcaaccaggaggcaagtaaccccgcctccacaatcttagtattttttttaaactgcatgcctgccccttatttgagctgcctttttaatttattgcatatcctttttattatcttattttggtattattcaatctatacaatctttttgtatttattgggg

SEQ ID NO: 10058 - DNA, 473 bp, Homo sapiens
  misc_feature 337: n=a, g, c or t
ttttttcagtctgccccatgagggcaccagctcccatgtgagggaaaagccttccacatcttcagaatccctcctgtctggggctgtgtgggccccagggcgcatgctgtaaattatctgttaattggattaaccaaaagcaagcagccctagacagggggctcagaagggattcagtgacctcagaggaagggattcagtgacctcagaggaagggattcagtgacctcaaaggtcgtgcatctccagtgckctdccatggtggacgtaaagactggtgtttatccagcccttgctgtgcaccagtcatggtggaaggaatcatgkgagtatcarntcattgagcccccaccacctccctgagactgaggtcaatgtccgcattctayagatgaggaaagtcggactcaagagaaaccgaragacccgcctaagggtcagaaccagcttgctgyaggakagtcaggattcga

SEQ ID NO: 10059 - DNA, 161 bp, Homo sapiens
  misc_feature 91,97: n=a, g, c or t
aaaaaaagtactgagaccgggcatggtggctcgcgcctgtaatcccagcactttgggaggccgaggcgggcggatcacctgaggtcggganttcganaccagcctggccaacatggtgatatcctgtctctactgggaactacagagattaaaaaaaaaaa

SEQ ID NO: 10060 - DNA, 344 bp, Homo sapiens
ataaaaaatgttatattaggttggtgcaaaagtaattgtgttttatttatttatttatttattattttttcctttgagacagagttttgttctggagtgcagcgtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaawtgcgaaaa

SEQ ID NO: 10061 - DNA, 496 bp, Homo sapiens
  misc_feature 275: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccanggagaaaggtcaggttacccacaaagggaagcccatcagactaacagcagatctctcggcagaaaccctacaagctagaaaagagtaagggccaatactcaatgttcttaaagaaaagaattttcaacctagaakttcatatccagccaaactaagcttcataagcgaaggagaaataaaagcctctacaaacaagcaaatgctgagagattttgtcacca

SEQ ID NO: 10062 - DNA, 382 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaaattsctggttttaaa

SEQ ID NO: 10063 - DNA, 272 bp, Homo sapiens
  misc_feature 125,207,227,232,263: n=a, g, c or t
attttgtggcccgctatggcgcggtgttgaggttgggtccgggatgcggggtctttgactgaaggggtaggccaagtggaggtatcagggacgtcgcgsggcacagaagaggaccagcctggacnscggggacgctgtcatgtacggcgcgasgggggccgcgcaaacccgagaggaaaagcggcgcgaaggaggaggccgggccangcggtgcgcggtgggggcanccgantggagctcttggttttcggstatgctgcaanctgttccgg

SEQ ID NO: 10064 - DNA, 530 bp, Homo sapiens
aagtatacattttctggccaggcccagtggctcacgcttgtaatcccagcactttgggaggccaaggaggtcagatcacttgagatchgbagttcaagaccagcctggccaacatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagggaaagcccctcaaaccattttgtattctgtattacacttcagaaagtgtggaagcaaaggtcatctaatctttaaaakctcttaaagtgatcctgaagactttagttctacaaaatgtgaacttcttatggaccattaaagtggggagtaatctgctgatttttgtctagcaaccctacctctgatgcaggataatttttcawaaccgttgttcttcctatagctgtataatagagatattaaagaggaaaaatacttgtgtgttgctgt

SEQ ID NO: 10065 - DNA, 473 bp, Homo sapiens
aaaatcttggtagaaatgtaaatttccatatgccatctgtgatgtgattaaaaagttttcctccaacactggtcctcctactcaaccctgtcctaaagctccaactgtctaacacacttgtaacttcattgtctaactgctaccatgtttaaaaccaagacacacacacacacacaaacacacacacatacccstctgaacdktgtccatcttcctgctaaaatcaactccccttgctacttattctatcatctttgaatatttttgcttcttacatttattgtctttcaactcttaacacagatccttaggggaaagaggatgtgtaactgtagtgttgttatcactttaataacagtagaaacaaccacaattagcaaatactgagtgcttactattggttatctaatattataagcacttgctgaaatctcacaagagccctaagaggtattattgttagccccacttta

SEQ ID NO: 10066 - DNA, 398 bp, Homo sapiens
  misc_feature 380: n=a, g, c or t
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaaattyckggttttnaaaawttaaaaaaaaaaa

SEQ ID NO: 10067 - DNA, 170 bp, Homo sapiens
ctcagcatctggagtagctgggattacaggcacatgccaccacgtctggataatttttgtatttttagtagagacggggtttcaccatgctggtcaagctggtctccaabtyytgacctcaagtcatctgcccgtgtcggtctccggaagtgctgggattasagggctgg

SEQ ID NO: 10068 - DNA, 404 bp, Homo sapiens
  misc_feature 357: n=a, g, c or t
aatgcggggtttggtgttgctcaagggaagtcgatgtgtgaacatttggaatataggaggccaaggaggaactgagatggtttaaaaaagggataaaagagaaggaaaaggaactcctactatgccaggaacagaaagccactgtcctactgcattcaccttttggaagttgtcttcactttaattctctcctcaactctaatatttgccgtctggtgatttagtaaaatgttgaccaagatgacgtcagaaacttgattagcaccaacgagagaactctccagcacctcaatactcaactgtccagcacctcaatactcaactctccagcacctcaatattcacggagcagtccanggagattggaagcattcatttcaactgggaagcttgccaggaaaggc

SEQ ID NO: 10069 - DNA, 103 bp, Homo sapiens
acctctactgcagctccagcaactgtgttggtgtttgtggcttttctgaaaacacgatgaagcatcgtgaagataaatatcaaagacagtgaactaacaacca

SEQ ID NO: 10070 - DNA, 120 bp, Homo sapiens
agcaccaccgagaagatccacaacctgattcccgtcatgctgaggcaccgtctcgtccccccacccgaggaaacctactccctgcacaggaagatggggggctccttcctcatctgctcc

SEQ ID NO: 10071 - DNA, 261 bp, Homo sapiens
  misc_feature 114,174: n=a, g, c or t
catatgttctcattctttttttttttaatcactgcataatagtccattgtttgggtgtgctcgtttattatccagtttcctagaaaaaacgaacttaaggctaggcasattgcncatatttgaaatcccagsactttgggaggcctagacttgaggccagaagttcaagrccanactggtcaatatagtgagaccccatctacataaactaaaaagttagccaggtgtggtggtgttatgtctgtagtcccrgctatttgg

SEQ ID NO: 10072 - DNA, 322 bp, Homo sapiens
agttgggatgaaaatggcggatgaggccgggcgcggtggctcagcccaaaaattttggagagtagaaagtaaactttggaataaaccraagaaaagatgccaggttacatgttagaggtacctagaccatatgacaaggatgtgatattcaaattagaatctctccttctagttcctctccctctgttcctttccctttgtartttgtagacatggttawgactttactcctaagctcattgtgtgatgagtatctatctcttttcaagggacaattaactctttttaaggactttcrtatcaagtaactcacgtggtgctt

SEQ ID NO: 10073 - DNA, 509 bp, Homo sapiens
attgtcttcaagctacactttcatagcaaatatactgttttaattaagattagatttaaggttagattttatttggaaagatgggggtgtatggccaagggatatttatggctggacccttttcaagaggctcactgacattgatggatattaataaagttgatgctataaagtttcaccaggaatggcagaaggatgaacctgtcaagtaagcacaggccgttccaaagcctagtctaggaatcattgcgccagactgggaaaagtctttctcatctacatggtacaggaactgcagagatttctatggaaaaataatgaacacatttaagaaaagttgaaatcagagttttcttctaagagaaaatgaaaacagtaataacacccagagagatggcctgaaacttggttgtttcaaagaaagctgttggcccatctccccacttcacctgactcccattcccacacaggcaacccaacacattcaaggtcatgtcggaacagctaac

SEQ ID NO: 10074 - DNA, 399 bp, Homo sapiens
  misc_feature 186: n=a, g, c or t
cagagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaanggaaccgcccagccatcctcacctaccatgatgtgggcctcaaccacaaactatgcttcaacaccttcttcaacttcgaggacatgcaggagatcaccaakcactttgtggtgtgtcacgtggatgcccctggacaacaggtgggggcgtcgcagtttcctcaggggtacagttcccctccatggagcagctggctgccatgctccccagcgt

SEQ ID NO: 10075 - DNA, 484 bp, Homo sapiens
  misc_feature 46: n=a, g, c or t
accggcaccacctccaccctcgccaactcagctcaagcccttkkgnccacctcagttyccaacggccgcctcctctcttcagtgccacagccccgagctcttatattggtctgtagctcggtatcwccgcctaaagcttccctggacagcctgagagttgagcaaargttcccggcctcagadggtaccctacaaaaakgaccagatgtctagagcattggctactctccttgcaaaatatgaaaatgaaaatatattcatatatataatttatgtgtgtgtatatacacacatttacatacatagatttgtcacatagcactgagtccattcttctgtttcacagtaccggaatttaagcccccctctccccagccaaagaggaaaggactgatctaaggtcattttttatctgggactaagtacaacgtaaaggtaataggctgggcctggtggcttatgctacaatctcagcgcttttgaa

SEQ ID NO: 10076 - DNA, 292 bp, Homo sapiens
agatcttctaggcttcagccagaagtggcacattggccagaacaattcatctgaccactcccaactatgagggtagctggggaatgtggggaagcagatggactattttttgagcaccattactgtatctgccaaggctgatacaagcagttaatcctctggtctatttcttttaaaggagagttgagaattagcttttctgttttttccacccctccccttctctcccctcctctcttctcttctcctcttggaatatctgtatctgtatgtatctccaattacagtttga

SEQ ID NO: 10077 - DNA, 316 bp, Homo sapiens
ataaaaaatgttatattaggttggtgcaaaaktaattgtgttttatttatttatttatttattattttttcctttgagacagakttttgttctggagtgcagcgtgtgatctcakctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactct

SEQ ID NO: 10078 - DNA, 390 bp, Homo sapiens
  misc_feature 384: n=a, g, c or t
ccttaattagactcaggaaacaatgggtttttgttgtcgttgttgttgttgatgttgtttttttatatgcagtcttgctctgtcacccaggctggggtgcaatggtgtcatctcgattcactgcaacctccgcctcccaggttcaggcgattctcctgcsttagcctcccaagtatctgaactacaggcatgtgccaccaakcctggctaacttttgtattgttggccgggctggtctcaagctcctgacctcaaatgatccacccgsstcagsatcccaaagtgctgggattacaagtgtgagscaccgcgcctggccttgttttgttttcttatactcataaatagagtgttattgtgggggtgggtttagtggtggggatnaacttc

SEQ ID NO: 10079 - DNA, 498 bp, Homo sapiens
atgactgacctttttgtttacctcctgctctttttctttctaaaacgttaataatctagtaatgtgttcaaataatgtattcattttgtcttttccaatgatcttaaccataattctaatattaaaatgagaaaatataaattaattattttctatgaccataactagctgactcctgattgtatgagcttatgttttaaaatacattttctagccaggtacagtggctcacgcctgtaatcgtagcactttgggaggccgaggtgggtggatcccctgaggtcaggagtttgagaccagcctggccagcagagcaaaaccctgtctctactaaaaatacaaaaaaaattagctgggtatggtggcgcatgctgtaatcccagctacttgggaggctgaggcaggagaatcgcttgaacccaggaggcggaggttgcagtgagccaagatcatgccactgcactccagcacaggcaacaaagcgagactccctttcaa

SEQ ID NO: 10080 - DNA, 223 bp, Homo sapiens
tttaattatttgttcatcagttgatggacattttggtgttttcacttttggctatttttgagtaatactgctgtgaacattcatgtacaagttttttgtgtggacataggtttttatgtttataaaacatgttttatgtttatgtttttatgttttatgtttatatttctcttgggtacattccacctagaagtggcactgctgggtcatatggtaacttttt

SEQ ID NO: 10081 - DNA, 472 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtaasacttgtgcctasctgagccaccacgccggcctaatttttaaattttttgtagagacagggtctcattatgtt

SEQ ID NO: 10082 - DNA, 284 bp, Homo sapiens
atgatgcgcagaaaatggaagcaactggcctactgtatactaaaacagctcagctccaggacctaacccactgcattaaaaggaggagcgagaacaagtgagggggccacacagaccctctcctctggttactatgaactgggctcacctcccgcagttggtgatttcaccttcaaagtgaatagcagcatggcattgtggaaagcaccctccctggaccagtctgggaatccatgaacaaattctcttgctgtaaaatgaaaaggtcagaactttgctcccta

SEQ ID NO: 10083 - DNA, 410 bp, Homo sapiens
  misc_feature 94,121: n=a, g, c or t
catagatataggacatttcattctcagaaagttctagtagagagacagtgctggtatacattgccctttttcttcctttcttcccttccttctnccccctttccttttcctccttccttsnscccactccagtcttcctksccctcccttcccctgagcttaactgatcctcccacttccccctcccaaagtgctgggattacaggcttaagctaccactgcaccagtctaccttgcctcttcatatctttgtcagcatcttctgccggggccggctagtacatgcagttttccatccttaggtttcacagaagagtttccgaatttcctttgtcatttatgtatcaccattttcatattaactaattaaactctacctctcagcccacaatggacatgttcagaatgca

SEQ ID NO: 10084 - DNA, 407 bp, Homo sapiens
aattctttttaccgtgagcttcacttccctcggtctgggcttctctgaggcggcgagagatggtcaggtctggagctcgaccgggccagactttttaaaactgtggacttaaatgttctgcaaagtcttacacaaaagcccaatacagtacatgaactacggaaaagcagaactgctctgaacaaggaagaggtgggagatctgagtcctggccccagcacccacttcaacttcagtcacctccttggaatctggggttctgcagcttgaaataatcagtttggattttaaacttatttgtaacataataataatcctaggaactttaaaataatattttgtactaaattttagaattattataataagtgatctaataaaacagtcttttcccgaaaaaaaaaaaa

SEQ ID NO: 10085 - DNA, 345 bp, Homo sapiens
  misc_feature 213,326: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccangcatggtggcacatgctgtagtcccaagtagctgggattggaggtccccaccaccatgcctggctaatttttttgtactttcagtggagatggggttttgccatgttggccangctgttctcgaactcctga

SEQ ID NO: 10086 - DNA, 136 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaaat

SEQ ID NO: 10087 - DNA, 461 bp, Homo sapiens
  misc_feature 107: n=a, g, c or t
aaggaccaggactagggcgagggcagcggtccaagaaatagaaaacaatgactgggagagcccgagccagagccagaggaagggcccgcggtcaggagacagcgcmnttggggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtggccttatatcagtatcacattgactataaacccact

SEQ ID NO: 10088 - DNA, 519 bp, Homo sapiens
attctattggccaagcaagtcatcaaggccagctcagattcaacaggatgaggaggaaattagcctacaacttctgatgcgagagtgtcacattaggaaggcatgtggaactggggatgctattgtggtcatctttggaaaatattatcttccatgccctccaagttgcctccagaaaccaaggttacctagagtgtgaacttgttccagatcctgcttcccccaagtgtaccccattatgaaagcctgttttcatcttctcttcactcaaaatgaactttttctatgtttatggcctataaccatgctttcttctgggaaactgaaaaataatgtagattaatgtgttaatgactactgagctattgcctaacactggtaacatatttgtcatcaagccataattttgtcacggtaaatgacttaactcaacataaataattaagaacaatttttgaatattttcaaaatgtatgatgaataataaataccttcttatgggaaaaaaaaaaaaaaatg

SEQ ID NO: 10089 - DNA, 187 bp, Homo sapiens
acagtcgatgtacaagagtagagtatgtttgggaagaaacttttcaacttgaatttgcctcctctatgatgacatctcttatatgcttgtgctgattttctaatttaagagataccatatctctctattcatttctatctctcatttgtatgcttatttttctgagaacaatttttttttttttttt

SEQ ID NO: 10090 - DNA, 465 bp, Homo sapiens
gtaaggtttggtgtgttcatttgagtgggtgccagacgtaacgggcccgggattgaattagtttagatcaaaatttgatgtaattatcgcagagaaacgctttcttgcgagtgtttatctcgagcctgctgtgttcagcatctttcttggtgttttgggagaagcagacaggagttaagtccaagtccccgccctcacagagctcaggtggcttgggggaaggttggtgcgcaaacattaaaattagatatcgacactagtgagtgtccccgtcaagaggtctgtgaaataaggttgagcctacgatgcagaagttaatctcacaagttgtcagattccctagttgaatttgctttggacatcagtgtgaagcagaactgatatgccacttgaattaataaaggaagtcaatggggtgcctgaagttcagccgctgagtaaattacataaagtagatttcggatc

SEQ ID NO: 10091 - DNA, 67 bp, Homo sapiens
ctttttgttgctgcsgccgccgccgagtgtcactttcagcgccgccgcctgcgtctcccaggccgta

SEQ ID NO: 10092 - DNA, 476 bp, Homo sapiens
ctgaatgtttatgtccctcccaaaactaattatgttaaaatcctcaccatcaatgtgatgttacttggaaatgaggcatttgggaggcaattaggattagatgaggtcatgagagtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaacccgtctccactgaaaaaaaatacaaaaaattagccaggcacagtggcatgtgcctgtagtcccagctactcgggaggctgaaggagaagaatcgcttgaacccatgaggcggaggttgcagtgagccaggataacgccactgtactccaccctgggcgacagagcgagactacgtctcaaaaagacatcagaaagcctgcttgctctct

SEQ ID NO: 10093 - DNA, 445 bp, Homo sapiens
  misc_feature 237,264,326: n=a, g, c or t
aggagggtagatatgttctacttcttgacatgtagtatgaacataaaccacagttgattcctgakctgtgatgactttccactgaccatactactgcaatgatgttattctgggccaaacttcggaatcaattcttgtctgctgcctgattcaattatttatcatgcaccctgtggatttttacttgctaaagtagaaagaagatcccaacatttgatgagaaaatatacagaaggnaggctgatcccgggtgcactgtggcangtggcartatagatttttgtgaagcagcagtgtgctgtgatatgagtagcagattaagaaknaaggaaattaagtcactcaattcttatatggcataattactcttatatctggaatcaacatgtggaatttctagatagatggagtctcaatatgtttcccaagctkgtcttgaactcct

SEQ ID NO: 10094 - DNA, 227 bp, Homo sapiens
agaatagcttgaacctgggaggcggttgcagtgagccgagattgtgccattgcactccagcctgggcaacggatrgactccagctcaaaaaaaaatgtatataggggcacacatttttacctctggcctttggattctatatggcttagcatggcactcctgaatcctgtctttatttaaatttgtgttttttttcgtcatggaccttttttttttttttttttttt

SEQ ID NO: 10095 - DNA, 398 bp, Homo sapiens
  misc_feature 121,125,315: n=a, g, c or t
aaaaccggctggagttccgttttgcgatgtggtttcgttcttctttcgctctttgtaataaatcttgctactgctcactgtttgggtctacactgcctttatgagctgtgacactccccangaangcctgcagcttcactcctgaaaccagcgggaccacgaacccatcagaaggaagaaactccaaacacatcccagtatcagaaggaacaaactccagacacgccgcttttgagaactgtaacactcaccgcgaggtctgcagcttcattgttgaagtccgtgagactaagaatcctccaattccgggcacangattatgctgcagtaacaaacaacccaaagtcccaggagcttaaaacaagagtttatttttcaccaaaattatctatttaata

SEQ ID NO: 10096 - DNA, 424 bp, Homo sapiens
aaatgctttgttttagaacatttgctgtkkagctctgcragttaagcaagaccaggcatagccacagagaatgcggggtctctgaaggtcctctttggcaccccagaatttgtggctcctgaagtgatcaactatgagcccatcggctacgccacagacatgtgagcatcggggtcatctgctacatcctaktcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcmstttcagcatccatggctaatgaaagataccaagaacatggaggccaagaaactctccaa

SEQ ID NO: 10097 - DNA, 502 bp, Homo sapiens
  misc_feature 463: n=a, g, c or t
aactggactggcggvcggggagtgaagtagtgaaatcggacctacgcctctccaacgctcgcgtgatcacgtggttggcacccaggcggaagtctgcggcagttctttgcggtgaagaacttgcaaagcgttgctggaaaagacgggagttctactgacactccagtccaaagctaggtgggaccgcctcctgtcgcacgtttccgcctggtcccgcgctttaggagctaggaaatgtgacagaggcggtgcctactgcctcgctaggaatggccgcggaggactggtcacgtggcgtggcttccggcctctggcgcgttcctattcgggaaggttttaaatgcggaktcatctcttgatttgtcagcgaggctttgactgtdagcttcgcgcgttcggcctcaccgcctcaccgagggtrggtctttcgcgcgcagaattgtgtaggattttccaaagggantaaaagccgatcggggcctactttttaacattccacaat

SEQ ID NO: 10098 - DNA, 445 bp, Homo sapiens
aacgattgtaaatatgtatttgcccaatgttggaacacctaaatacataaagaaaatattaatagaactgaaggatgaaacaaatagtaacacagtagtagtaagggacttcagaccccactctccacaatggataaatcatccaggcagaaaatcaataagaaaaacagctgacctgaacaaaactagtgaccaagtagacctaacagacatatgtataacattccattcaacagcagcagaacgcatgatatttttgaatgcacatggaacattacccaggatagatcatatgttaggtcacaaaacaagtcctaacaaatccaagaagattgacataatattaagtatcttcttttacctcaatgctatgaaactataataacaggaaaattggaaaattcacaaatatgttgaaattaaacaaaatactcctgaataacca

SEQ ID NO: 10099 - DNA, 339 bp, Homo sapiens
ggatgctcagggacggtgggggtggcagggcccaccggcttgaggctgcctttcccggcgttccctcgtttattggctcactcttcctttcatccatccatcctttgcgcaacaatatttgatgggaagcctgccaagttttcagattactccatttgattctcacaagaacatcgtaaatggaaaagactagaattgccctgagttcacagattggtcatcgaggtcaaagaaatcaagtgacttctggaggccacacagctaataaacagcaaggcaacgacttgaacccaggtcttctggttccaggtccagagctcttttctctatattctaaac

SEQ ID NO: 10100 - DNA, 456 bp, Homo sapiens
tatttttgaaaaaattaaaaaataatttggatattattgttttttatattttttaaaagtttgtagtaaattacatttctgaatgagttataacttctaacaaattataaattaagcaattttcaatattaaatattactgtggcctattacaaccacatttacatgcaaaattaaatagttaaggaaaggggggtgggacctggggaataggagagtgagaacttgacacatcctctcccaaaaaaagcaagaagcaacaataaactagaaaaaaattattaaaatgtttcagaaacctaaaaatcaactgaaggcataaaactaaataaaaagtaattactaaaactgagaccacaacaaaaaaggagagactacagagggtccatcttatcgacttgtccttgtttgagtatgagactttaaaccagtgaaagtggggacagctttgtacact

SEQ ID NO: 10101 - DNA, 208 bp, Homo sapiens
agaactagaattgcaaaagcacaatgcagcactccctaatcaattcatagggtgacctcacagcatcagtcaatggagaaataaaaagcagaggttaaagaatgtgctcaaggttactctgtaaggaagtaatggagccagaatgcacggaccatctgggaccctgataccatcaggaacacaaaaatggatgctaatcaaagaagcc

SEQ ID NO: 10102 - DNA, 126 bp, Homo sapiens
  misc_feature 76: n=a, g, c or t
agaatagcttgaacctgggaggcggttgcagtgagccgagattgtgccattgcactccagcctgggcaacggatrngactccagctcaaaaaaaaatgtatataggggcacacatttttacctctg

SEQ ID NO: 10103 - DNA, 146 bp, Homo sapiens
  misc_feature 25: n=a, g, c or t
tagaatagatgtttggtttcttttnggggtgtctgagtgtatatgtgtgtgtatatacacaaagaacacacatatttatatactatacacacacattttaatgtatataaatatttkctacattctgtgtgttatataatgtggta

SEQ ID NO: 10104 - DNA, 203 bp, Homo sapiens
actcaagactgctctgcctacagagaagccattcttttagtttcttctttttaaaaaaattagagacagggtctctctatgttggccagtgtagtcttgaactcctggcctcaaccaatcctcccgccttggcctcccaaagtgctgggaggtatgagccaccatacctgacattctttggaatccttttttttttttttttt

SEQ ID NO: 10105 - DNA, 466 bp, Homo sapiens
  misc_feature 445: n=a, g, c or t
gtcgtttgactaacaccaggggcggcagggggcgctccactcgtcctccgccgggtgggtactcgcagatttttcagttcgtaacttgtcttctggacataggtttctctgtccggtggtctctacgaakgggtaagggtgggagattgccattgacattcccgccctggacgggactctggtctgtgggctttgacaggtcactgcattcctgccaggtcgacgttttgcgtttattggtgagattgaaatcccttcatttgtgttttcgccatttgtatttctttgtgatttgccagctcatatttttttccatgtatgttgaaaacatgcttctcaatttgtcttttgactctgattatggtgtttgattctggtttgggctttttcaaaatataaaatttaaaatttttaggagtcaaatattttgccttaaggcattttnggctttgtgctgtgttttaaa

SEQ ID NO: 10106 - DNA, 441 bp, Homo sapiens
atttaactgttggccggaaattgccggtastgccgtggcctgaccctactacgtgcacaactccgcagcattaggggaggggtcatctgctctaattaggtaacaggggcaagtgggattaaagttttaaggcagttatattaagaagctgaggaaaggattccggaaccagcccccagaaagcaagaaagaaaagaaatatgctctttaccgtggccgatcagcaacgaaccaacactgtcctcatctaattctacgtcttccacactgcccagtaacacaaataaccagagcgcagacgccaagaatccttccaagtaacgcagctaacagaccaagcccaggagccaaagctcagccagcccgaagagccaggattagagcctgcatggatscaacagtcacgcttctctctattacgtgtcttgaaacttggagtca

SEQ ID NO: 10107 - DNA, 324 bp, Homo sapiens
ataaaaaatgttatattaggttggtgcaaaagtaattgtgttttatttatttatttatttattattttttcctttgagacagagttttgttctggagtgcagcgtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcmcccatcctggcgacagagcgagactctgtctcaaaa

SEQ ID NO: 10108 - DNA, 103 bp, Homo sapiens
agacctggggcaaggccctgtggacgaccatctgcsttctctcgttccgtcgattgggaggagcggtggcgacctcggccttcagtgtttccgacggagtgaa

SEQ ID NO: 10109 - DNA, 379 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaagkttskggtttt

SEQ ID NO: 10110 - DNA, 375 bp, Homo sapiens
gtttaacggccggtcaggaacccaacaattagtcccttctcgtccgagaggaaactctgtgagaagatgggaccgtgagcactctctttaacaaggacatttccttttcagcgaaasagcgctctgatttaccaagtctggcggaccgcagcgctttaaaggaatgaggttccagcggtcgcgccaagcagcgtacgcagcctattttaagttatgctaccttcgccacagaaaccaagaacgttgtaatggtccggcaagtgcccacgtgtaattgttctccatcacttasccactctagttcgggaacacccttgtcgccgccgttccggtaacacctctccaasgctttcgatgcttctacttcttsgggaa

SEQ ID NO: 10111 - DNA, 417 bp, Homo sapiens
cctaaacactgacctacataacctcggaagaacaagcggtggttttagatgaagggcttcctattcaaattttcctgtaggccaatggttattagtgctgtatctactgtagtgctgtgtctattagtagtgtgtattactgtagctagttatcagtagtgtgtatctactgtagctagaggagtctttctgagatccacgaccccgggccttccccctctagtctgtctccttccctccttcccctgttgcttagattgttgttagctgttatgtaggttgtaaacttttcatcctaccaaaccccatactggatcttatggtgtccatacatttcagatattggacagttgatatttttggagtaatatagtgggtaagatgtggagtactccaagaagcttttgcttcacatat

SEQ ID NO: 10112 - DNA, 81 bp, Homo sapiens
attttccaaagccatggtgaacatctctgtgctaatttcttttgttttgtttcctaatttttttttttttttggmaggtgg

SEQ ID NO: 10113 - DNA, 467 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagctctacaaac

SEQ ID NO: 10114 - DNA, 475 bp, Homo sapiens
aaaaacagttagttactcagtatatctccaggtttgcatcttctacttcttatgtattcatttagagtcctcttccagtgtgtggacctctgcagattctagataacttttcaaatatgctagattttgagctgtatattttttctcaagcagagacatctgcgcatagtgaaaatcaattctcagagaccaaaattgccaagcatacgtgacggaactgtagggaaaaagggcataactttaatcttcaaagaagcttaaaaatagctccacagttattatgcatgaggcctgacaattgacatttctcattttggcagcattcacctacagcaccctatcagcaactgaacacattcatctctggaataaatgattaatgagctgcctatcatttccactccttttgtaccaagtggtggaggcttcagttgatcatattgcagccatcaacatcattactgaaattgattct

SEQ ID NO: 10115 - DNA, 432 bp, Homo sapiens
gcaaatcatttgggtcccgtcagtattgtggaagctttgttcttttactttttgcagtaaatgttggtgctggtcactctttgggtctgtgctgcctttatgagctgtaacactcaccacaaaggtctgcagcttcactcctgaagtcagcgagasatgaagccaccgggaggaaagaacaactctggacgcgccaactttatgaactgtaacactcaacgcaaaggtctgcagcttcactcctgacgtctgtaagmcatgaacccaccagaaggaagcaagtctggagatgtccgaacatcagaaggaacaaactccagataaaccgtctctaagaactgtaacactcactgccagggtccgcggcttcattcttgaagtgagcaagaccaagagctcaccaattctggacacagcaccattattcacaac

SEQ ID NO: 10116 - DNA, 289 bp, Homo sapiens
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctca

SEQ ID NO: 10117 - DNA, 423 bp, Homo sapiens
ctaaatgtatggtgtgtttagtgtacagtagtgtatacagtaatgtcctaggccttcgtattcactcaccacttaatcactaactcacccaaagswactttcagtcctgcaagctccatttatggtaagtgccctcttaggtgtattggtttttatcttttatattatatttttactgtaccttttctatgtttagatatgtttagatacacaaatactattatgttacaattgcctgtsgtattgagtacagtaacatgttgcacaagtttgtagcckaggaacaataggctgtaacatatagcctaggtgtgtagcaagctgtactctccagctttgtgtaagtacactctatgttgtttgcacaacaaactcaccaacaatgcatttcttagactgtatccctgtcattragtgacacat

SEQ ID NO: 10118 - DNA, 89 bp, Homo sapiens
tagtagagacggggtttctccacgttggtcaggctggtcttgaactcctgacctcagttgatccgcctgccttggcctcccaaagtagc

SEQ ID NO: 10119 - DNA, 62 bp, Homo sapiens
acaaatatctgagagtgactttgttgtatggctacccttgtgatctacagtaatttattctt

SEQ ID NO: 10120 - DNA, 341 bp, Homo sapiens
  misc_feature 170,292: n=a, g, c or t
awcccgctggggtccccttcaacactgtggaagctttgctctttcactctttgcaataaatcttgctacttgctcactctttgggtccacgctgcttttctgagctgtaacactcaccgtgaagatatgcagcttcactcctgagcccagcaagaccacgagcctagcgngaggaacgaacaactccagacgcgctaccttgagagctgtaacactcaccgcgaaactctgcagcttcactcctgagccagccgagaccacgaacccaccagaaggaagaaactccgaacanatctgaaaatcagaagggacagactccagasatgccaccttaatagctg

SEQ ID NO: 10121 - DNA, 201 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagctcccaagtagctgggattacaggcgcgtgacaccac

SEQ ID NO: 10122 - DNA, 436 bp, Homo sapiens
atacacagatgatgacctcacaccaacaagaacatgcagacacccaaaattctgtatgattgattcattctaagttgatgcaagattttaatcgaaaactgccttattttgcagaagattaacaaagaggatgcggtgcagaagtgagtccctcagcaggagaagcttctctcacaccaacccatttatggctgggggaaaataccccgttagttcaaggatagcaaataaatagatggtgtgcagcctggtacagatggtagaacaaggactacatccttcacaaaagggatgtgccaacaaaaacagcctgccctcaacagcaagctgacccaacgccctgctcgctgactcctttatgccggcaccggaccgagtgcacgctgcgtttgcaagctattgttcagcaggcagattttctgctgggggttaacag

SEQ ID NO: 10123 - DNA, 405 bp, Homo sapiens
  misc_feature 312,359: n=a, g, c or t
attggccgggtcacaagcccgcccgcccgctgctggagccgcgaccatggaggagtctggcatggctcatgaatcagcagaggacttgtttcatttcaacgtagggggctggcatttctcagttcccagaagcaaactctctcagtttccagactccctgctgtggaaagaggcttcagcttgacctcttcagaaagccagagstatttatcgacagagatggttccacatttaggcacgtgcactattacctctacacctccaaactctccttctccagttgtgcagaactgaacttgctgtatgagcaancattgggtttgcagctgatgcctttgctgcagactctagataacctnaaggaatggaaacaccatctacgcgtacggcctkcagacctacctg

SEQ ID NO: 10124 - DNA, 343 bp, Homo sapiens
gccccggatggagaaagctaggaaatggtacacaggccttgggctacttaactaaaatgacctaaaaratcagtgaaaaatcaaggctgggtctttgcttgataaggaccaaaaatratgaaaattcatccacccttgtcaacacatcttcctgccttgaagctactcaagaggctgaggtgggaggattatttgagcatgggaggtcgaggctgccatgagccatgatcacktcactgcactccagcatgggcaacggagcaggactctatcccccrccaccctcaaaaaagaaggatgtcaaattagtttaaaattcctacatcaatacaaattgcaagtc

SEQ ID NO: 10125 - DNA, 473 bp, Homo sapiens
ttttctggacattattttactcttgacaattggtgggttggatttcatgatttcaaatacctgttcacatcttagtatcctaatattctttctacagtgaagaggaagggtaaggtgaagggctaaaggaagataatgtgtgtggtaaaaatactggcataaaaacctctattcttcaggccacgtggtgttacttatgaacatagtgaccttgggagcattttctgaaaatactcttccccctccttgttttgattctggaacagtttcctttttcctcacaattctaccttccttcaacagttgcatttacagataatatccttcaccgtttgtttctttatgcatcactagtgtgtgtataaagcagagatggcaagagctgccatgcattttggctgtgtgattttgcaaccaggagacgacctagtaggtatgcagcaatactgacatggagagatccctcctccctc

SEQ ID NO: 10126 - DNA, 451 bp, Homo sapiens
acagcaaatctagaagggaggaggcattatcccattttacagataagaaaacaggaatccagggaagttaagcaaattgcccaagattatacatctagaagtaaaactcattcacataacctctattcccaggatatchtgactttttggttcaggaggatttcctagtttctacccaccttgtctttcttgcctttcattatcgcctttctacttgttcttaattggtgtgtccatttgtttctttgccttgaatgtggtatatgaatgcatctccacttcagactgttgaatagatcacacttaagcaccaaagaacatgtgtattcacttatccattcattcaatcaaccagtaagtgtttattgagtattcattatgtgtaaagtcccatatttggaggagcataaagataaagatagacctgcctccttttgcttatatcctcttt

SEQ ID NO: 10127 - DNA, 342 bp, Homo sapiens
taggatagagcagccactaatttttcccaggagagggaaaatattgatacaatctgatatgaatctttaaggataagtatgattttgtcccaaaaagaaggtacaagagaagaggtaacatattccaggctctaagacaatggaaaattatatgagaacaaggggtcatgatttctagagtgtggaaggaaccatcatttcagaatccactgtcatccttgaagaagtcaggccctcattcaagatcatttgttatcagagactgctgaagagaagtacatggtaccttgaagtggttttaattaaatcaagaaactttatgaggcagtggggtagaaactt

SEQ ID NO: 10128 - DNA, 228 bp, Homo sapiens
acccatttccttgaaaatgttcttttaaaagtgaaacaaatgagcaaaaagcaaccaccaaaaatattastagatgctttasatacttgcaattcaaacagtggccccagrccagccacattcccttcacctgggagcttgttagaattgtcscacccagacctgctgaatcaractttrcttttacacaagatccaggtgactcaggggcacatcasagtttagaaa

SEQ ID NO: 10129 - DNA, 414 bp, Homo sapiens
  misc_feature 69,92,157,175,212,264,333,337,349,353: n=a, g, c or t
agtaggacgccgccgccgccgcgggggacgggggccgccgggctattattgaaaatggtggatcgcttngcaaacagtgaagcaaatactanacgtataattataatggaaaactgttttggagcagctggtcaacctttaactatacctggacganttcttattggagaaggantatttactaagttgtgcaggaaaaagcccaaagcaangcagtttttcttgtttaatgatattcttgtatatggcaatattgtcatccanaagaaaaaatataacaaacaacatattattcccctggaaaatgtcactattgattccatcaaagatgangganacttaaggaatngatngctaatcaagacaccaactaaatcttttacagtttatgctgccactgctacggataaatca

SEQ ID NO: 10130 - DNA, 107 bp, Homo sapiens
  misc_feature 106: n=a, g, c or t
gaggttgagacaagagaatcacttgaacctgagaggcagaggttgcagtgcagcctgggtgacagagggagactccggccccctcccaaaaaaaaaaaaaaaaaanc

SEQ ID NO: 10131 - DNA, 89 bp, Homo sapiens
tagtagagacggggtttctccacgttggtcaggctggtcttgaastcctgacctcagttgatccgcctgccttggcctccsaaagtagc

SEQ ID NO: 10132 - DNA, 223 bp, Homo sapiens
agattgggaatcaccggcttcaggaacttgaactcatttgcccctgagcctcccgtcagacacacctcgtactggtagctctgggatagggtcccggtgccgctcacgtctaccagatgccctggaaagggacactcgggcaccgacaagcgacccatcgaggccgccctgctcctcctgcacagccgcaccgccacgaacaggaacaccgagaagaggaaga

SEQ ID NO: 10133 - DNA, 78 bp, Homo sapiens
attttccaaagccatggtgaamatctctgtgctaatttcttttrytttgtttcctaattttttttttttttkggmagg

SEQ ID NO: 10134 - DNA, 125 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaa

SEQ ID NO: 10135 - DNA, 440 bp, Homo sapiens
caaaaagccattcttagaactagaggatttaagagggtaggaattagggtttgtatatatgtatatatgggacattttatctkctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttaagtcttagcatcatcatattgtgctgtttttggataacac

SEQ ID NO: 10136 - DNA, 437 bp, Homo sapiens
  misc_feature 220: n=a, g, c or t
agactgaatgaaagatgagcttctgcctttatatccttctctcctgctacccaactcattgtggttaaagaaaaagaaaacgcgggtggagactgcactatatgcttaggactgaaatgcaactgcagaagcaacatgtgaccttttagagatgcttgtgggactgcataaagtgaagagggaaactggaaaaaaacaatgaagtaaggaaaaaattggntagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagca

SEQ ID NO: 10137 - DNA, 257 bp, Homo sapiens
attctcctgcctcagcctccagagtagctgggactacgggcgcccgccaccacgcccggctaaattttgtgtttttagtagaggcggggtttcaccgtgttagccaggatgttctcgatctcctgacctggtgatctgsbcgcatcggactcccaaagtgctgggattacaggcgtgaaaaacagggcctcactccattgcccaaggtggagtgcattgacacgaccatagatcactgcactttgggagtccgatgc

SEQ ID NO: 10138 - DNA, 429 bp, Homo sapiens
aatcacatctcctgcgcctgcccttgtgacctgctcactggaaaggaagaaatgaccgagggagaagggagggcatttgagaggggagaagaagaggacggagaaaaaaactggatcatctcgtgacatggaaagaaaggtctgagctctgacgatcccctcacgtgattataggcatgaggactcactcttcgaattgtttgaaaattgaatggactggctcacaccttctgaaatttcttggaagctctggagtaactattccactaaagaacagcgtgtttttggctgaaatctgtgactgtttgtttttgagttattttaatctctgtgtcaagcatgaaaacctcagcagcctgggatttataattagatcccactggcatgccctctcacctctcaaacatgccacagtgctttggctctctc

SEQ ID NO: 10139 - DNA, 337 bp, Homo sapiens
ataaaaaatgttatattaggttggtgcaaaagtaattgtgttttatttatttatttatttattattttttcctttgagacagagttttgttctggagtgcagcgtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaatt

SEQ ID NO: 10140 - DNA, 476 bp, Homo sapiens
  misc_feature 462: n=a, g, c or t
aaaaaaagtcaactattcttttgaaacagggaggctaacaatctgagcaggctcatttataaccgactcaacactctgagaaaatgagagagccaaaaactctacattattaaagcaatgcttccaaggatgttatagaataataataagcaaaaaaacaaattcagcagtttatcggatccaaagagccatgtagaatgtcttgtggctgagaatgaatgaagaaagaaatgaatgaaggaagaaacataagcagctgaaaactgaaaagaccaaactccaaaaagggttcagtagaaagggaacttgatctagatgctggttttatagaaaaatcagagttacagaacctgtatcaccccacagacactgtaaaaggcctaattaatatttaagaataaaggagagatgaggagcaaatataaaacagtttaggtcagctatataacaaaaawtcaccangccagtgataatcc

SEQ ID NO: 10141 - DNA, 308 bp, Homo sapiens
  misc_feature 168: n=a, g, c or t
atttacgatgcacaaaggtcctgggaggtctcccttggcagttaactctacccaccaggaagatccagtcacacacaagcagggagggaaaaagggaagaatgaacagggttgactggaggagacattaggatggggcaagactacaagtacagcataatttcaaaancacagagcaaccagatgagggggagtggcagggatgtgcttggaaagaccggaaggagagtaagctcctgaagggacctgaatgctaagctcaggagcttgaccttcatcctaaaataaaaggcagcccaaaaagttaaa

SEQ ID NO: 10142 - DNA, 61 bp, Homo sapiens
  misc_feature 6: n=a, g, c or t
tggaanttcctctactccgtgcgtttacggggtcctggaggaggctcctgggacctcgagc

SEQ ID NO: 10143 - DNA, 173 bp, Homo sapiens
  misc_feature 111: n=a, g, c or t
atggatttcatggggcatgcaaagcaggcaggttccaagcggctaacaaggctgcttgtttgagctactttaagaataactggatgtgtaaaaatttgaatttkaggccantgggcttttgagctgatggttcccagcctgctgtgaagaaataaactaccaagtggtcaata

SEQ ID NO: 10144 - DNA, 310 bp, Homo sapiens
  misc_feature 72: n=a, g, c or t
agaattagctctttcccttttggtttgcaagcactgcctgtaaagccctcgcatgagaggccagcctgctanggaaatccaggaatctgcaacaaaaacgatgacagtctgaaatactctctggtgccaaccttccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagagggga

SEQ ID NO: 10145 - DNA, 72 bp, Homo sapiens
aaaaaaaaaaaaaaaaaaaaaaaaaaaaaaaaaaaaaaaaaaaaaaaaaaaaaaaaaaaaaaaaaaaaaaaa

SEQ ID NO: 10146 - DNA, 368 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaaccccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaa

SEQ ID NO: 10147 - DNA, 357 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatc

SEQ ID NO: 10148 - DNA, 145 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaaatgcgaaaagc

SEQ ID NO: 10149 - DNA, 444 bp, Homo sapiens
  misc_feature 71,150: n=a, g, c or t
aagggagcccagagccgctgttggccctgcccaccaactggccagagggaaggtgagctccagaagggaanggagttctttcacagctttctgtctctgtatctcctgtgacttgaatggactcagcacacagcaggcctgagtgaagkntgcttgtggttgctatggcttacatgacaacgaattgtctgtaatcctacaggactatggcacatgaaagctggaacgcttctttccgactgcatcgcccagcaccagagcccgagttctgtaaagctctgttaaaggcacatkagctgtgctggcttcaactgccctgaacttggataagctgggccgctgatggacccttcccaaccggttgttgctgccttggtttcccgacagtccactgtgctgaccctgcagcagggactcccagctttgcatcaactccattcaaca

SEQ ID NO: 10150 - DNA, 434 bp, Homo sapiens
taaaatatggaaaattatcaggtgactcattacatgcaaaaatacgtctgataacactacccaaacaagcaaatcaactgtatctgacagtcgcagctcatctcgaggcaaagtgcaataacattaaaacacttgagattttggccgggcttggtggctcatgcctgaaatcccagcactttgggagtacaaggtgggcggatcacttgaggtcaggagttcgagaccagcctggccaaaatggtgaaactcattctctgctaaaaatataaaaattagccaggtgtggtggcacacacctgtggtcccagctgcttgggagactgaggcaggagactcacttgaacctgggaggcggaggttccagtgagctgagaacataccattgcactccagctttgacaacagcgggagactctgtctcaaaaaaaaaa

SEQ ID NO: 10151 - DNA, 142 bp, Homo sapiens
aaatatatgttctttctacatcacccctctttctactaaaaataatctcagtaagattattattattattattatttttgagacagagttccactgcactctagcctgggtgacagagtgagaccctgtctcaaaaaaaaaa

SEQ ID NO: 10152 - DNA, 443 bp, Homo sapiens
agttgcgaatsagcatcggcgcttagctgcctccgcggtgcagctaaggttcgtgtcgctaccccttggcccttcgctcttgctgccttaaccccgccggtggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgasccctcagctcggctttcagcgtaagctcaacgtcaacgccaagcccttcgtgcctaacgtacacgccgcggarttcgtgccgtccttcctgcggggcccgactcagccgcccacctsccggccggctccggcagcaacgrtgaaacctgcacc

SEQ ID NO: 10153 - DNA, 496 bp, Homo sapiens
aattagaactaggagcaaggagggtgtgagagggaggtgagaaagatgtctaggacagagaaagggaggttgcagtattccacattccagtgcaagcacgaggaggcgcaggagagggagacacttaagtcaaacacctaccacattcatatctactgacacgccagcactgatttcaaggagaatatatccataccgcatacaggaagaaaatcaacaccatgtcaaagttagtattacagcccaagacgcagttattttcataattaatacatagagatcattattttcttaagtcagctctacaacatggttaatgtgagctcacactgccatatgtaaccaataggaatatgctgataattcaatctttgagctagccggggtcagttcttgagccaaggaatacgagccaatgtaatgctaccccagaggttgatttctcacgtgcagactgctttttccaagtaataatgatatgtcatgtaactgtttt

SEQ ID NO: 10154 - DNA, 119 bp, Homo sapiens
acagcacagtactgcactgaatactgaggcaactggagcatggtgataagtatttgtgtatctacgaataaaaaacgtgcagtaaaaaaaaaaaaaaaaaaaaaaaaaaaaaaaaaaaa

SEQ ID NO: 10155 - DNA, 330 bp, Homo sapiens
  misc_feature 105: n=a, g, c or t
ataaaaaatgttatattaggttggtgcaaaagtaattgtgttttatttatttatttatttattattttttcctttgagacagagttttgttctggagtgcagcgntgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcacccatcctggcgacagagcgagactctgtctcaaaaaaaaa

SEQ ID NO: 10156 - DNA, 50 bp, Homo sapiens
  misc_feature 16,30: n=a, g, c or t
acaaagcctccaaganatatgggactaggngaaaagaccaaatctacatt

SEQ ID NO: 10157 - DNA, 347 bp, Homo sapiens
  misc_feature 338: n=a, g, c or t
ctggtgagtcacggaaatgggtctcatgcttgggagggcctcagatgtcacctaggccacctccaccccagtgcaggtgtcatctgaaatctttctgttagttgggcacactcagttacggggaagcacatgtttggacgctgcatttttaacatgagcagttcaggcttttaaaatcaacatttttaacgcgagcagtttgggccattaaagatattacagtatattttaaataaataaaatggtgctggtgrdtccttaaggaagaaatggagaactcagcatctgtggctgctggggtgttggaggccggcagttctcagctgggtggctctctnggacttctt

SEQ ID NO: 10158 - DNA, 343 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtca

SEQ ID NO: 10159 - DNA, 252 bp, Homo sapiens
gccattcttgagggagtaaggtggtatcatattgtggttttaatttgcatctccctaatcattagtcatgttgagtactttttcatgtttttggccatcttctagacattggcttaggcaaagatttcatgaccaagaacccaaaagcaaatgcaacaaaaacaaagataaataggtgagacttaattaaactaaagagcttttgcatggcaaaaggaatagtcagcagagtaaacagacaacccacagagt

SEQ ID NO: 10160 - DNA, 66 bp, Homo sapiens
tttcctttatgccattttttgtttttgttatttgcaaaagatcttgtattcctttttttttttttt

SEQ ID NO: 10161 - DNA, 67 bp, Homo sapiens
attcttaagtttgttctaattcagcatatatcatctcagaatggatccccagcaggaaaaaaaaaaa

SEQ ID NO: 10162 - DNA, 323 bp, Homo sapiens
atcctactatgtgtctctatgaatttgcctattctagatacttcttgtgcctttttccataattttttcttataaccagcccttctcatccaaaggccacaatgaagtcgaagaaacctatagatgacagctttcacaatccttctcttgccttttcctgtactgacgtatgttagagatctggctggcagcttcaagacacttggaagcaagagggccactctattaaggatcgctgaagtatgcccacatgtcaggtttctctcagatgtggtatcaaaacatcattatgggccgggcacggtggcttacgcctgtaatcc

SEQ ID NO: 10163 - DNA, 486 bp, Homo sapiens
attataattttacactcaaatatgattgtagctgacattttgaacaagagcacttgcagctcttttgaatgtagtttcatgaaccatcacttgtagggttatatttttcattttctttactttttaaatttttcattttttattgtcatttttgttttgattaattgattaaattttgcctgtagccacatacccttgttattttccactactaagattaatggggatcacagttaaaactattggttgtattggtgtacatgaatatgtacatgctgaaagattactttttggtatcttaaaaagtgagagtaggctcttccaaactcatctcaaataaagctattctgctaatgtgaatggaagagaaaatgttgtagtgattcatcctgattttaggatgattgttctggcaaatagacctggatttcctttcctaggcaatgatttcttcggtaccttaggtgatatttttagctgccatgc

SEQ ID NO: 10164 - DNA, 452 bp, Homo sapiens
agagtttcccgggcactcaccgtgtgtagttggcatctccgcgcgtccggacacccgatcccagcatccctgcctgcagactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcagagctgaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaa

SEQ ID NO: 10165 - DNA, 484 bp, Homo sapiens
aactagtatctagctctctaactgccttgggccatcaaaactcccaaatcaaatattgttgacctggcttgtgtcaagtgcccatcactgaattagtcactatggccaggagcagatgggccctcactagacagaactggtctgtggccgcccatggtgcccggggtgagggcagctccacctgaacacagagagtggcaaaggcaaagtttcctgacatagacgttcctgttccatttgtcccgcaaacgtttaaacatcacacatacttggttaaggcacactacttctacgtggtggagaaaatggcacttggaaaattcagtttcaatggtcctttcagagctacagcatctgtctctcaatgtctatgttaattcctctaaaaggactcagacctgatgtggctcccagccttcttggacccctcctatctgtggtactgatgggtacagaactcacacaccctaccctgggtgtgagt

SEQ ID NO: 10166 - DNA, 375 bp, Homo sapiens
aaacatcatatgatctgtaccagggtataggcaggtgctatgatccccacttttcatcctcaactctaagttgagtcatacatcaacctctagtaaaaagtggcatgctctcaaaggggcgaatctggattgggaaagttgacattaatcaactcattattcctcccagatttgtattctccagagtatccgggtccttctcagagaattaaaaagcctgtacaggtcaagatattggtatttttaattgatgataagctggaataatattaatacacacaaagcacgtgttgtaacttttattatgcttccttagaggagtttgaaaaatcacatttgagaagaggattggatcctagccataacataaatata

SEQ ID NO: 10167 - DNA, 476 bp, Homo sapiens
accttcttggtctttcacctctgcggcgtcccgtattgcggggaaaaaggctaaggggcagcgtccccatctgccaggtcaggggaagaagactgttaggaacttaatccctatctccgccgcttgccgctgcccctgcttctaagggcatcatcaaaaacagacttggagcagagactgcggaactgggcagaggcgctcttgggattggggaggaaattggcagttacggaaggaaggggataattgccctgggtggagctaaaattcctaatacagatttttctcatttcagctggggtattccgtttggtcttcccaaaagtcatagttataaaatcgcgatgctttcgttagatggaatgctattgagatttgctcccaagtatattgtttagataattttagatcacaagtagctccatcctgtttcgctgcaatgtgcagtagtatgcagtgtttaagtcatacgtatg

SEQ ID NO: 10168 - DNA, 59 bp, Homo sapiens
atccaggtgtttgtttctaacttctgtaatacatacaatgcaaaaaaaaaaaaaaaaaa

SEQ ID NO: 10169 - DNA, 355 bp, Homo sapiens
catttagttctgctctgatctttgttatttcttttcttcttctgggtttgggtttggattgttcttgtttctccagttccatgaggcatgaccctagattgcctatatgtgctctttcagactttttgatttagacattttaggctatgaacttttcctcctagtactgcttttgctgtgtctcacaggttttgataagttgtgtcactattatcattaagttcaaataatttttaaatttccttgaaatttaaattccaatgaagttccaatgaaatcttgatatcattgttgatccaaccattacttagaagcaggttatttaattttcatatatttgcatagttttgagggt

SEQ ID NO: 10170 - DNA, 472 bp, Homo sapiens
atggtgtccctatagcaaagaaaaatttggacacagacatagacattgggagaacaccacgtgaggaaggcagagatcagaggaatgcttctagaaactgaaaaacataaagattaatagcaaaccaccagaagttaatgaagaggcatgaagagattctttctcacagagaaggaaccaactccgctgacccctccatcttggacttctagcctccaaaattaaagactttgcaatctcggaaagcctcagagcaaagckccatcagcaacactgtggaagttgaagatatgtacaagtattccatggaaaatacaaatcgagcaactttctttggggataacattgatagctgatctttctaggcttactaaggaaaataccattcctctcttctgagctcctctctggccaactttaactcatcgattggttctgccacccgcaacgttggctccaaaggcctgtagcg

SEQ ID NO: 10171 - DNA, 467 bp, Homo sapiens
tggagggaaaaacatatttaagattatatatttcttaaaattgcttattaaatcaattgttttaaaataatttaaaaggtagaagacgatatcttccaacacttctgtgaagaaattggcgtggaaaatattcgtgaatttgagaacaaacatgttaaacggcaacaagaaattgatcaaaaaaggtatttttataaaaagatgttggtaaggagcttacatatttaaaaatagttattatttcataatttagaggaattatgcctgagtttcatttcatcaagaaacagctaggccgggcacgtggcttacgcttgtgatcccagcactttgggaagccaaggcaggcggatcacgaggtcaggagatcgagaccatcctggctagcatggtgaaacccgtctctactaawaatacaatatwwwttagccaggcgtggtggcaggtgcctgtagtcccagctactc

SEQ ID NO: 10172 - DNA, 327 bp, Homo sapiens
  misc_feature 71: n=a, g, c or t
ataaaaaatgttatattaggttggtgcaaaagtaattgtgttttatttatttatttatttattatttttknctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcmcccatcctggcgacagagcgagactctgtctcaaaaaa

SEQ ID NO: 10173 - DNA, 326 bp, Homo sapiens
ataaaaaatgttatattaggttggtgcaaaagtaattgtgttttatttatttatttatttattattttttcctttgagacagagttttgttctggagtgcagcgtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaa

SEQ ID NO: 10174 - DNA, 369 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcgg

SEQ ID NO: 10175 - DNA, 488 bp, Homo sapiens
aagatatgtcctgatctcctaaagccacagaatcccagagactcaaagtaaattttctcttcggcaaatcagaaggctctgcataaatactgccaattgttaaacatttacctgcacatactgggctcatcttcattattggtaaaatgagctagatgctattttccattagctcacactccaattccaatcgacctgaccatcagaagagacaaaaagggaaaatcctggccagttctcccctacctaatcaaccagtagcataatcagatttgcaagacctcaagaaaagaaacctgaaaatgccactggaggtgtgtgttttgccaaagaaaaaagaatcaaaaacaaaacctgcaggatgaggacaaacaaacaaagagcagggacagagtctcactatgttgacaccctggacaacactcttgaagtactcttttcccagggaggacacagtcatggcatgcaaggaaggggctcagcatgaa

SEQ ID NO: 10176 - DNA, 81 bp, Homo sapiens
tttcctgggattggagtctcgagctttcttcgttcgttcgtcggcgggttcgcgcccttctcgcgcctcggggctgcgagg

SEQ ID NO: 10177 - DNA, 433 bp, Homo sapiens
  misc_feature 394: n=a, g, c or t
atataaaaccagggcacttgagccagcagcagcaacctgctcaggtgcccttccaccttgttcttccgctctttgcaataaattttactgctgctcattctttgggtccgcactgcctttatgagctataacaccgtgaaggttggcagcctcacttctaaagccagcgagaccacaaacccaccaggagagacaaacaactctggacgtgccactttatgaactgtaacagtcagtgcaaaggtctgcagcttcactcctgaggccagcgagaccaggaacccaccggaagggacaaacaactccagacgcctcaccttaaaagctgtaacacttacagtgaagctctgcagcttcactcaaacccagcgagaccacgaacccaccagaagknagaaactcggaacacgtccgaacatcacaaggacaaact

SEQ ID NO: 10178 - DNA, 246 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaa

SEQ ID NO: 10179 - DNA, 108 bp, Homo sapiens
atttaggggcggttggctttgttgggtgagcttgtttgtgtccctgtggaggacgtggttggtgattggcagttttcgcattttttttttttttcsttttttttaaaa

SEQ ID NO: 10180 - DNA, 492 bp, Homo sapiens
aggttccagcttgaatggtaactgagcagaagagcgttattactgattgcgattacagaagactatggaaagccaatgaagacaaccagatgatgtgcaaagttgctaacacatgaaggagatgtaatttctttcatatgttagaaatttcatattagagatattcatgttatagatactcacatgcagcaaacttgtttggagcacaacatatacactaagtgacaactgggactactaacagaatagaaggctcatctgaatatatttttaatattagcgggtttttagaaaaaaatacgtccttgactccaacttgccagttacacatctcatctggaccagagtcggtaactacacggcagaaaacttgtaagaatttagtcatgatcaggaagattttcagcttattgatgtttcctcacagttcttgtccaaaaatgcgggtttccactgtattgaatcacttcttaaataaatattgattatgtg

SEQ ID NO: 10181 - DNA, 77 bp, Homo sapiens
tttcctttatgccattttttgtttttgttatttgcaaaagatcttgtattccttttttttttttttttttttttttt

SEQ ID NO: 10182 - DNA, 188 bp, Homo sapiens
  misc_feature 151: n=a, g, c or t
gagattatgcatctggagtgggaagaagcaacacatcaaaaatatgaccagaccatccacggcggctcatgcctgtaatcccagcacatttggaggctaagtgggaggatacgtkgagcccagagttcaagactaccctgggggctatatngcgagacatctttattaaaaaatgataattaaagttc

SEQ ID NO: 10183 - DNA, 116 bp, Homo sapiens
accgtctctgtcttttcctccttccagtgcccggcgttcctcccttccccctcgccgccgaccgagttcttccttttcagaccgggtcgccttgctgtcgtcgcggtgattttcct

SEQ ID NO: 10184 - DNA, 191 bp, Homo sapiens
  misc_feature 123: n=a, g, c or t
acagtggcttctcagcctcccctggcccaactgaggctgttgctagatatgtttttcctgtatcaggtggttcatttctttttttctttttttttttgcctcttgatcttttttttcttttgnccctaaaggaaaaaaaattaaaataaataaataaaaggttttaaaaaaaaaaaaaaaaaaaaaaaaaa

SEQ ID NO: 10185 - DNA, 255 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaaaaaaa

SEQ ID NO: 10186 - DNA, 326 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcacccatcctggcgacagagcgagactctgtctcaaaaa

SEQ ID NO: 10187 - DNA, 503 bp, Homo sapiens
agtgcttggacctctacatcagataggtcctaaactcgagttactccaatgacacctatcattagggcagtatgtgtcctaaaaagaatcccaataactgaccccaattcttggcattcagaaacattctcaggaaggtatggtgtttacacggtttctagacaccctccttgaagaattacatctaaaaaatgaagaccttgaaagtctaaccatcatatttagaaccagctgtttaccagagtgatatattccatgaagacaaaatagaagatgaacttctattcaccgtttctggaattctagccgccatgatggtctggtggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtattttta

SEQ ID NO: 10188 - DNA, 161 bp, Homo sapiens
aaatatatgttctttctacatcacccctctttctactaaaaataatctcagtaagattattattattattattatttttkakacagagttccactgcactctagcctgggtgacagagtgagaccctgtctcaaaaaaaaaaagaactagttcacacccat

SEQ ID NO: 10189 - DNA, 72 bp, Homo sapiens
caaagatttggctggatctattattggcaaaggtggtcagcggattaaacaaatccgtcatgagtcgggagc

SEQ ID NO: 10190 - DNA, 314 bp, Homo sapiens
attcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacatgtgaagacaatgaaaaatcaggcagaaatatttagtatctagtcagtatctgtagctacactgtataactgttcttcaataaaatggttcatattttatagaaaaa

SEQ ID NO: 10191 - DNA, 486 bp, Homo sapiens
  misc_feature 71,282: n=a, g, c or t
gcagctccgcgccaacgccttcgcccaggggtagttggagcggtgcaggttcccaggctccaggtactggncgccttacgggctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcgncgaccgaggcccacctgcctccctgcctgcttcgccctggactcgtgactgcgtccgcrtaagaaatcacaacagcgctggaattgctagtttgctaggcagcatcttttggacctgcgaaccatatgcatttcacctcaaatttgtttccaagttgaaaacctttgggtctttctatgcgaacggattgaagaaacgcaaaaa

SEQ ID NO: 10192 - DNA, 337 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcmcccatcctggcgacagagcgagactctgtctcaaaaaaaaaaaaaatt

SEQ ID NO: 10193 - DNA, 271 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaaaaaaaaaaaaaaaaaaaaaad

SEQ ID NO: 10194 - DNA, 418 bp, Homo sapiens
  misc_feature 357,394: n=a, g, c or t
cacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataarattttwctatagaaattaaatgatttaaaaactcacctatatgagacatttaatgcttttcagcctgctttctggctgattttgttatttgatgtgctaatttgggcacttaatttacattctggcagtcggtgtagataactanaagcccagttaagtattttataatttcaggctactgnggccatgcttgggatgttgtttga

SEQ ID NO: 10195 - DNA, 130 bp, Homo sapiens
aatttcgcscaragcgaacactgtggctgcacccttaaattcctcagactccctctttccttgtagaaactctgtggctgctgcttgacttcatccctgaaactcaacggggcctctcctgtaccgtaac

SEQ ID NO: 10196 - DNA, 77 bp, Homo sapiens; identical to SEQ ID NO: 10181

SEQ ID NO: 10197 - DNA, 76 bp, Homo sapiens
acatcgctgcgggctcacaaagcggccagacgctcggcggcggcgtgtggcaggagcgcaggggcsagcggcgatc

SEQ ID NO: 10198 - DNA, 398 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaaattycgggttttaaaaatttaaaaaaaaaaa

SEQ ID NO: 10199 - DNA, 452 bp, Homo sapiens
aaggaggcgctgtcctggcgtcggatggggacggggaacgcggcgagggckctgcgacctctgcccacctggcccggccgcagtctcggagttcctgttcctcacaggagctaattatttatgacagctgcatggttcccctcccccagttactcagtgcttggcmtcggcaccccttactcagcactcagtaccgcactcggcctcaggggacctgggcagagggaagcagggagtctcccgcggaaactcttgctctgccaaagtgtgatgtgatctgactgctgctcagggcctggacagcaaatgaggaagacttattgcagaaattcagagcctagtgacctggaccagggtggaggcagcagaggagagaaacagatgatcaagactctgctagcaggagaaaaagagagaaaagagagatgaaaaagtcttgtgtgaccagaagc

SEQ ID NO: 10200 - DNA, 476 bp, Homo sapiens
aaatgagaggataaatacatcaaatttcttctcaggtcatcctgagttcactasacctggaatggagcatggtgcttattctcactgttgagttagaagtgtaataactagtctgttagatggtgcccagtgggccacatgtcttagtatgtatccttttctcttctctcccgcattgaacctggactggacctgtgactctctttaaccaacagaacttggcagaatctagtgctggtcctggagctaagtcttgagaagacctggaggcttccacttctgcgcttttggaaattctgagcttccgtgttagaagagttgctacccttctggagatactacatggaaagacctcatgaagaggccatatggaaagggagaagccttgtccaaccatctccaccaaggtcccaggcatatgagagagccaacttggacagtctggtcctgttgagcccccagatgccacagtctca

SEQ ID NO: 10201 - DNA, 78 bp, Homo sapiens
agtgagcggagatcgcgccactgcactccagcctaggcgacagagggagactccgtctcaaaaaaaaaaaaaaaaaaa

SEQ ID NO: 10202 - DNA, 365 bp, Homo sapiens
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatcaggctggagtgcagtggcatgatctcggctcattgcaacctccaccttccagattctcttggaggctgaggcaggagaatcgcttgaacctgagaggtggaggttgtggtgagctgagatcttgccattgcactaca

SEQ ID NO: 10203 - DNA, 257 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaaaaaaaaa

SEQ ID NO: 10204 - DNA, 215 bp, Homo sapiens
attgggtaaacgcaagggaggagaaaaggatacttcctcccaagaggaaagcaaatttaaggagaatgataatatgcttagtttgaattttgaattttaatttaagatgcctgagagcattcatgggggtttttgtccaagaagtcatttgaaaggtctattgctcaagaaagtggcttgtctgagagatcaagatttgagattttttttttttt

SEQ ID NO: 10205 - DNA, 379 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaacccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaargtscgggtttt

SEQ ID NO: 10206 - DNA, 419 bp, Homo sapiens
catttcgtcgggagtcacaagtgtgcctatcaggagagctgaccctgagaggactcctgcagtgcacaggagggcatcaaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctagaagagttggtacagaaggccatgcacatgtccagaatattcaagaatgcttattctcttagatgataccgcacccataggaattgagaattgggagtgggaagawwacctcaaagtggttcatacttgcctgtaa

SEQ ID NO: 10207 - DNA, 487 bp, Homo sapiens
acctaaagatgctccagggccccgtagccaccgtcttccagaggggaacggatcaactgctggtgtgcccaaccaaattcaactcctgagtcctcagtctccggtcccgggaaggtatcaagggagccactcgaaaacccatgaatctgtcgaagmactgaagtggtccaggggcccgatgagtcaccaggagcgtttctagaatgcctccaagaggcctattggacttataccccttttgacctggcagctcccgagaatagccgtgccattaatttggcatttgtggctcaggcagcccctgatagaagaaagttacaaaagctgtagggatttgctggaatgaacaccagccaacttttagagatagcccagaaagtttttgacaattgagaggttaaaaagcaaaaacaggcagctcaggcagctgaaagggctgctgacaaagcatcaaaaagacaggcaaaaatcttcgtggctgccatcc

SEQ ID NO: 10208 - DNA, 51 bp, Homo sapiens
gaataggattggtgaaagagtgaaagagtgttgtgtgcttttgctgagttt

SEQ ID NO: 10209 - DNA, 367 bp, Homo sapiens
atgattcttaggaagaccctggcctccatcttgaaaacggaaaataaaaacagcagacctatgaaggtcgaaggggaagaaaagctgtatcgattgttgagatctggcgacttgtttaaatttcatcagcctcacttctatgaactctcaggcctcacgtgtaccagctctctgctctcctttgccttgggacgttccatccctggaagtttccctgcccacatctttgtagagagtccattctccaagcttcagtgtgtcatctgtgaggaccgtgacccacctggtacatcgcctcagggcattcatttcaggctccttctaaatggccaagtcatctatgaactgactctgtctcaaaaaaaaa

SEQ ID NO: 10210 - DNA, 88 bp, Homo sapiens
aactctgttttagagaagatctcaatgttttagtaaagtacaaacaccatcaaaaaaaaaaaaaaaaaaaaaaaaaaaaaaaaaaaaa

SEQ ID NO: 10211 - DNA, 299 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatmaggagcagcgggaaccaagtgcagaggatggccttaaaagcagtatgggaaccaaatttttgtaaagtaaatattttcaacctttaaaaaaaaaaaaaaaaaaaaaaaaaaaaaaaaaaaaaaaaaaaaaaaaaaaaaaaaaaaaaaaaaaaaa

SEQ ID NO: 10212 - DNA, 435 bp, Homo sapiens
tgcactatagaacaactggacctaatagatatttacagaacatttcatccaacagctgcagaatacatattcttctcctctgcacatggattattctcaaagatagaccatgtgttaggtaacaaaacaagtcataaaatatccaaaaattggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccaaaacctataggatacaatgaaagcagtaggagagaaattgtagcaatatgtgcctacatgaaataaaaacaaaaacaaaataacttcaaataaataa

SEQ ID NO: 10213 - DNA, 77 bp, Homo sapiens; identical to SEQ ID NO: 10181

SEQ ID NO: 10214 - DNA, 322 bp, Homo sapiens
  misc_feature 19,313: n=a, g, c or t
cactcaagtatcttggtcntttcaacctastcaaaaataaatttcaggtaasaaaaasattcagaatatatssgttttcattagatagaaaactgaaaaagttgsttctagctgrsatttgagagagatatacagtaggtatatatgtataaaatggaatgtcagaattgaagtaaacattgttaastggagaaattaatttatattacaaatcatatctgaaaacatgtaaatgctgctaacatataagataaaaatatttgaatacatttcttaaaatgtctgattcctctactgcactgcagatgagggncagttctag

SEQ ID NO: 10215 - DNA, 288 bp, Homo sapiens
  misc_feature 105: n=a, g, c or t
ataaaaaatgttatattaggttggtgcaaaagtaattgtgttttatttatttatttatttattattttttcctttgagacagagttttgttctggagtgcagcgntgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgc

SEQ ID NO: 10216 - DNA, 391 bp, Homo sapiens
aataggactcaatatttacactttcccagacttatcattagtagtacttatcctcttaccagttatctagagccgtcaaaactgttgctcttctgacattaaggaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccwtcagcctcaagcagggagaacaaaaaatcaagaacttggcaagttttctccatttgttgcaagtatgtttactagctgaatctcaataacaatgt

SEQ ID NO: 10217 - DNA, 490 bp, Homo sapiens
  misc_feature 177: n=a, g, c or t
aagacaaagcaaaggagaccggggaagtccaggtagacagagtcaatggaaagcataaggagctgctggcaggctcttggggcatcacctggagaggtaaagaaagaaaagcccagaataccctcttcataacaataacagagcatcttggtagctgcagtccaactgagaaaggantgctcatcattcatttttgttattcagcatataagaaaagatgcagagaataaatacaggtacagcagacctaaaaaaatttgtgattaaagagagtgaaaacagactcccctaatgtggagagcatcaaaattaagagtagcttgtgtttcctgtggctgctgttaacatattataatacacctggtgtcttaaaacaagagatttattctctcacagttctggagtctggaagtctgaaatcaaggtgtcagcagggctatgatccctccaagaggctctagggaaaaatacttccttacatctttcagct

SEQ ID NO: 10218 - DNA, 448 bp, Homo sapiens
tagacttgcctcagttcttaacaagtgtctaaagacagtaggctgtagaagaacaagtattaggttttaaattttataatgtgccccatttattcacattgattgactatccagctgttacaagagcagtcgatctttattttgtgtaagttagtttcatttcatcagatgatctgcacagaactcagaataaaccatcaattttaggtataggctgttttgttgttggcattatcttttagatataaaatcatagctagggtgaactgtagacaagaaagtcttccttgaaacagggataatattcaggttattataaatatttaggcttgaagcatagagctactgtagggtgaaaaatctctgtaggactttctggggcttcagtaccatttacacccacgatgaagggcttaaatagaaaataatggaaaattaaatattactt

SEQ ID NO: 10219 - DNA, 455 bp, Homo sapiens
atcttgggagcagccggccccatcttgggagtggcccacaccatcttgggagctctaagaacaaagacctgctggtaacactatctctggccacctatctctggcctatctatctctgtttcctatctctggccatggcttgagccatttgggtgcagtgaacaggaaactgtaaagagtgacagccctgcttctacaaaatggatgccaagtatctctgactaaatgcaattcacagaggtcttctgggtcaagggagagctatctttcctcaaaatcctcagatgacttgaatgtatgaagatgacctggcaattcatccttgctcactgttccagtgctcctactagtgaaagcacttaggtgtttgaaatgacaccaaagaagctctttctgagttgggaaaaattggtaamagtataasacctggtgaatattatcatcattattattgg

SEQ ID NO: 10220 - DNA, 279 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaaaaaaaaaaaaaaaaaaaaaaaaaaaaaaa

SEQ ID NO: 10221 - DNA, 477 bp, Homo sapiens
  misc_feature 395: n=a, g, c or t
acactcctcttgtaagacagcgtaaacaattgcttttaaaacttcattaggtttttgtgtgaacataaactttcgattcatttggataaacaccagggaacacaattgcaagatcatgtgaagagcctttcgcctcctgccatgattctgaggcctccccagccatgtggaactgtaagtccaattaaacctctttttgttcccagttttgggtatgtctttatcagccacgtgaaaatgaaataatagataaataggtagtggagaggtgagaaaatcaaggtagatatgtaaataaaagatatgttaatatgttaatgagtgggcaattgaagcttggttttgctagaaacctcggagaccctaagtcacacctcagaatagctccaaagggncaagaaagtttagatatttgttttccaactcacgcctcttagtggttgagagttgttcctgggggtattcattcctaggcac

SEQ ID NO: 10222 - DNA, 386 bp, Homo sapiens
aataaatatggttttatgaagcaattgtgcatcgtgcattccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcatta

SEQ ID NO: 10223 - DNA, 395 bp, Homo sapiens
  misc_feature 343: n=a, g, c or t
caggaaaattaagctatgtcttttttttggcctgcagttttggtctgaggcgctctgggcaccatcactcacattgttttgttggtattatttcacctagtgtctgagcaaggaagaggctaaggcttcctttcaacattctgttctccaacctcatttattggattcccctctgctactggtgacaaaaagaatggattatacctttgtgtaattgtgcttgttccagtacttcatgtgaccaaatctaggaaagaataggaatttactgagtttgttaaaagtgggaatggcccaattgttttagtctttgcagcatcttaatcctagagagcagtgaccngtkagaagaggtcaggattttctcagaaatgggggcatgcgttacatggctg

SEQ ID NO: 10224 - DNA, 359 bp, Homo sapiens
ttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgactcagtgatcttctcattgcatcttacctgtgaccctacagttttgatttgccctgttactggtaatgttagcattgatcactaacagaggtatctgctgaatttctcctctgtaatgttattttttcaccttgtggttaattagtattttacagggaggtaatttgagactatgtacatatcyctactccccatcgaaccct

SEQ ID NO: 10225 - DNA, 107 bp, Homo sapiens
atctaggttttgctctccaaatggtagaagcaaccagaaataatgtaattaaagttttgaaactgtaaattatctagcatcttggcctasttcaatakactttatct

SEQ ID NO: 10226 - DNA, 283 bp, Homo sapiens
aaaaatagaggcctgtggtttagaaatgagcaagtgggtttgaaatctcccacctgagatatttctgaagtgtttgtagttaaggcttttgcttttcttctccccacacccttcctgccctactatctatggttccacctccccagcgactgctgaacaggtctctggaagcctccttgatgttggaggtatgcctttccaaatgttggagatgaaataccgagaccgagctgcagaaagacgggagaagtacggcattccagaacctccagagcccaagcgc

SEQ ID NO: 10227 - DNA, 271 bp, Homo sapiens
atttttaataaagtgttcagaatggactgagcaggtatgggtgtaggacaacaatttaaacagaaaatccatttaggtgacaattagtatgttagatggctttgtatttttctaagtaaggaatcatcgtgactttaactaagtaggtgccattatgaaaggagatgaagtgataaatgtgattgatatgtatgtgatggttaattatatgtatcaagttgactggactaagaaatgcccagatggctgttaatacattacctataggtgt

SEQ ID NO: 10228 - DNA, 570 bp, Homo sapiens
  misc_feature 524,528: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcaccaccaggcctgccttacaagagctcctganggangcactaaacatggaagtgaacaactggtaccagccactgcaa

SEQ ID NO: 10229 - DNA, 252 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaacaaatttttgtaaagtaaatattttcaacctttaaaaaaaaaaaaaaaaaaaaaaa

SEQ ID NO: 10230 - DNA, 488 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaatcctacaagctagaaaagagtaagggccaatactcaatgttcttaaagaaaagaattttcaacctagaatttcatatccagccaaactaagcttcataagcgaaggagaaataaaagcctctacaaaacaagcaaatgctgagagatt

SEQ ID NO: 10231 - DNA, 328 bp, Homo sapiens
agaatccgttccagggattggggtgagtccgacttcgagcagcagctgccccccaacatcatgtaaccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcsagggcctataatgcaagaaccaaggsgagtcacgccctgtctgggcaaaagaggagtaaagacccctcagctgcagmccggmagcgcattcctacccagggtccgccgc

SEQ ID NO: 10232 - DNA, 485 bp, Homo sapiens
taaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgtttctttaagatggactgttctgg

SEQ ID NO: 10233 - DNA, 429 bp, Homo sapiens
agtcgacttgcgccagcccagaggctggggaggcgtccgagcctccgtcccgcctcgtcgttgaagaaggttaaggacaagcgccagctcacctgcgctggggcagggaagggcagagtggccgagcccgggagggcgcgacaggggcgaggcgaccccagtccagaggctgacttcctcaccgccctgggtcccaatcctgatctgggctaccctatctgtgcttctggtgaagtgggcccagaaccatcgtgtgaataatgattgacctcagctagtggttctcatggagtgattgattttgcttcccagaggacatcagcaatgtctggagacatttccagttgtcactacttgagaggaagcgtgatcggcctctagaagggagagaccagggatgccgctgctcaatatcctataatgcacaga

SEQ ID NO: 10234 - DNA, 361 bp, Homo sapiens
aaaaagagctttggagtttgaatcaaatttcagatgcggagattcccctctagaggactgcccaatctcaaggagcaactaaggatttgctctgaataaactgcctttggacagacacagtcccagatataaaggaagaaggatggtagcccatggatcccccaatagcaactgcagattaagccaacaggcaggctgctgatagaacctgctccccttcttaccttggaatgcccacacagggctgtgagggaccaaccaaatatgaagctgttgatttctccaaaataaccatcaaaagtctgatgagataaagagcacactggaaactgggaatgctttgatggaaattctgcaagta

SEQ ID NO: 10235 - DNA, 306 bp, Homo sapiens
agtcacctcccctcttctggcctgggtttccacacctgcacaatgggaacagcaacctcagctgcctgccgtctctgacgtgagggccaaataagaaaagctcttacaaacttaaggaaaggatacctgtttatgtataatcttgtgcaattcttgggattctcctggatctttgtcaacctgactgtgcgattctgtatcttgggaaaaggcaaagtccttttatgacacattccatactgtggctgacatgatgtatttctgccagatgctggcagttgtggaaactatcaatgcagcaattgg

SEQ ID NO: 10236 - DNA, 407 bp, Homo sapiens
aaacttttggctcttttgccttctatttgcagcacattgtggctatgtttattaattactttgtggcctaatactataaaacacacatctatcctgtgagctatgtaccctagggaaagagtccttcataccctccagttggccataaagagaggacagagtctcaagatttgccctgatgctaaggattaataccacctcctccgggagccatcaggttaccactctctagcacagagctaccacgtttaagactccttcagcaccatccccccttttcctgcacgaggacacttgcatgctgtttggtattaaaagccctctgcaactgttcccaacctacagcaccaaagtagccccccaccatgctatgactscactctagccagactgatgatgtagcacaa

SEQ ID NO: 10237 - DNA, 250 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaa

SEQ ID NO: 10238 - DNA, 252 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaag

SEQ ID NO: 10239 - DNA, 432 bp, Homo sapiens
accaaggtctctcctaccccggggcctgtgcacctgctgtgcctctgcttggggtgctcttcccagggcttgcccacctcctcagagaggcctcctgaccccagacacggccttgcccttcacctctatcgtcctttagaacagcccccacctcccgcacatcatgcagttgcaggttcaatggctactgcttgtcctccagactcctctccacaagccaacagctctctcctggctttgattttcaaccatttaagttgaaaaaaattcaaaacaaatgaaatgcacttaagagaaagccttgaggagttcagcaggccacccaaagtgaagggactcctttgggggtctttgttgttatcaattatttattgagccctgatgtgttcctggcgccaccaagaccgaaaggagacagggtccctgccctgg

SEQ ID NO: 10240 - DNA, 207 bp, Homo sapiens
actcccactctcactgtgtgacagccctgctgccccttcaccttctgccatgattgaaaacttcctgaggccctcaccagaagcagatgccagtgccatgcttcctgtacagccttcagaaccatgagccaaaataaacctcttctctttataaaaaaaaaaaaaaaaaaaaaaaaaaaaaaaaggaaaaaaaaaaaaaaatgcgaa

SEQ ID NO: 10241 - DNA, 315 bp, Homo sapiens
attccgagattgtgtgctgagggttttcaactgcatctctaaagggaaggccaaagaaagagcaacaggaaaggatggtaaaaagggggtagaaaggaagaaggaagggaagaaaaaagggaaaacagcaagctctctttccagagccacacatttttttctgtttgctcagtggcagtctgttaaagaaatacttcattgtcactgaacacagagtcattaaaggcaccttggaaatttggaccctwttactagaatcagggcttaaatagcaacttaatttatgacacttctcgaggctgatggcgtttttgm

SEQ ID NO: 10242 - DNA, 312 bp, Homo sapiens
aaagaggagacgtttggamttgagtttttaaggatgagttgaagttgatcaggaacatgggcctgttaggcagcgggaatgttggtatcaatcgacatggtttgctcacaatattctcattgctagtttcatggatgtatcctgtggcttctccatgagataatgaagttcttgaaagtgggagtgtcatttacactcctacctgcagacagcacctgatacagagtataaagcattggctgaatgcgtgaatcttagytcccgctttttcaccttagcatcctgactaccgatgccctgaacacacatggt

SEQ ID NO: 10243 - DNA, 378 bp, Homo sapiens
agttcatcggtgaacagggagtagaatatggacagttttgaataatgccagatactaaaggaagaaaacgtgcgagaaaccctcttgtttatacaggatagtaacattttcttagccccatcttcgtatggtgccgtacacctgaaatgaaactagatatgtctttaatttgaagtcaacgattatgttacaaaatagaaaatcagtcgcttaaaaatcaaatgccaaggtcacacagcaggtggagagtcactctctgaaagagaacaaagtaattttctgaagggaagctgcagaatatggaaaacatatattggagctacatggatagaggatcacatgaagccaagagttgaagaccagcctgggtaacacagt

SEQ ID NO: 10244 - DNA, 341 bp, Homo sapiens
attccattcccggccccaggccatgccccaggatggacthactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgag

SEQ ID NO: 10245 - DNA, 247 bp, Homo sapiens
aatataacccagtgacagggtaatggcaacctgggacttgtgactggcatctgaagtgggggacactcttgtgagactgagccctcaacctgtgcgatgcgacactatctcctggtagatagcatcagaattgagttaaatgataggacacccaccaggtcacagctgaagaactggttgttggtgaagagcaacccacacacattttggtgactaaaggkgaagtattgtgttctgtggtgactgt

SEQ ID NO: 10246 - DNA, 331 bp, Homo sapiens
  misc_feature 113: n=a, g, c or t
ttgctatagtggtattctatgatatgaatatgatactctttgcttattcattctcctattgataggcatttggggtgtttccaggttttcactattattaataaagctgctgngaacattcttgaacaagtctatttgtagacatatttttcatttctcttgagaacaaacataggagtagaattgttgggtcataaagtaggtgaatgtttaaatttatcatttaaaccatttttaactgccaaaccatttttaaatgtgattttaccattttatactctcaccaatgacgcacgagagtcctagttgctccacatctttgktcacattt

SEQ ID NO: 10247 - DNA, 318 bp, Homo sapiens
tctcatttttatgaggtcctctaggtctaaacacctgcataagcgatgtctgtgagagggtgaacacaagaaatcacactgagtttgtcatgcttgtggcctacgtaccattctgtggctttctggtttccttcctttttggttctggtttcawttttcttgggtgcgatgcctctttgtttttgcatttgtctgtgctagtttatcctaaataaagttccaaatgcacagggaaaaaaaaaaaawwaaaaaaaaaaaaaaaaaaaaaaaaaaaaaaaaaaaaaaaaaaaaaaaaaaaaaaaaaaaaaaaaaaaaaar

SEQ ID NO: 10248 - DNA, 248 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaa

SEQ ID NO: 10249 - DNA, 460 bp, Homo sapiens
  misc_feature 159,162: n=a, g, c or t
taaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtggngtnctgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtggdacctaccttttcgttcagtaagtttgaactatatataaactgtacaatctgtaaagtttttatagaataaatattcagctgtgaaa

SEQ ID NO: 10250 - DNA, 136 bp, Homo sapiens
acagcactttaggaagccaaagtggaggagcatctgaagccaggagttcttgagaccactgtcggcagcgtagtgagacctccatctctatatacaaagaatttttaataaattrraaaaaaaaaaaaaaaaaaaa

SEQ ID NO: 10251 - DNA, 267 bp, Homo sapiens
atagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcmaatttttaatttttttaatttttttattttttattttctttttggtttggggagggagaaaagttcttagcacaaatgttttacataatttgtaccaaaaaaaaaaaaar

SEQ ID NO: 10252 - DNA, 400 bp, Homo sapiens
  misc_feature 297,329: n=a, g, c or t
atctacctaaggagccccaaagactatgggtgaaaaaaaaaagcaaaaacaaagtcattctaatggtctccaaaaattctgaatatgagatctgattttggagaagagaaacatttgatagaattaccaggggaatatagtcaattgataatggtcataacaaagatacktaatkttatttccctttgattacttaatgaagacagaatgtctggaccagtaatgacctcctaagatactgacactctggtgaggtactatctggaggcaaacaggacttcttgggacatctctttngaccacaatatgggcaccataccaggaatctngaggaagcagaggttccacatgggtttsgctggaaaattcaaggggaaaacaacatctggaactggaaaat

SEQ ID NO: 10253 - DNA, 414 bp, Homo sapiens
  misc_feature 342,380,398: n=a, g, c or t
ttttagaaaagcagaaagtaacaacttttacaatagtatgttttacaataaaaatatagtttttcaatagttttacaataaaagtgtagttttacaataaaagtgttacttttattagtcacctttaaagagtgaatagtaaaagtgtatttcccgaagttacaaaggttaaaaatattaaaatggccgggcacggtggctcaagcctgtaatcccagcacttcaggaggccgaggtgggcggatcacgaggtcaggagcccgagaccagcctggccaatatggtgacactgcatctthgttaaaaatacaaaaattagccaggcgtggtggcacatgcctngagtcccggctacttgggaggctgaggcagaagaatcngcttgaacccaggaggcnggaggttgcagtgagc

SEQ ID NO: 10254 - DNA, 147 bp, Homo sapiens
aactctgttttagagaagatctcaatgttttagtaaagtacaaacaccatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 10255 - DNA, 55 bp, Homo sapiens
gaggtctttgctgtaattccccttgagcaggcgatcagttgggtcttcattcctt

SEQ ID NO: 10256 - DNA, 397 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcgggcagaaaccctacaagctagaaaagagtaagggccaatactcaatgttcttaaagaaaagaat

SEQ ID NO: 10257 - DNA, 425 bp, Homo sapiens
ctttctgttccctgcactgggtcccatcccctccatgtacaatagctgcctggcaggtctcttccttctagcaactccctgctcctgcagtccctccgtgaccttcctgatggggagatcctcaagacttttcccatgagctcggggttcctgaggcccagaagaagtgcgaagatggtcttcagctcaaacttccccaatttattccaacttctaaagcagtagtctaaggcactaggacaagaagcagatgaacatgtatagccagtattgggccaccatgcccgtcccacctagactcataccttgtctcatccactcgacctcgtcctcggtgacaaagctgcacaaggcttttgccattgccagtcgtattgctccagcctgggctgacctcccgccccctgagactgtgcaggtcacgc

SEQ ID NO: 10258 - DNA, 319 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaagaaaaarrgggrgggggggggggggggggggggggrraggrgggggggggggggggggggggggggggggggggtkgggggggggg

SEQ ID NO: 10259 - DNA, 423 bp, Homo sapiens
aaaaaaggaactcgcaggccagtgctgctggtgccggagtccggaagctgacggcgttgcctaggctggattgcagcggtgcgatcaggactcattgcatcctcaacctccccgactcaagcagtcctcccacctcagcctcctgagtagcaaggctacagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatggaatctaattaaactrargagcttctgcacagcaaaagaaactaccatcagagt

SEQ ID NO: 10260 - DNA, 381 bp, Homo sapiens
ccttccggtgggctcctggtctcgctggcttccggagtgaagctgcagaccttcccggcttgattatctcctaactttaaaactttggatgaataattataaagcagcaaattggtgttgcaaagagaagacatgaaaagcagagtttagtagatattttctatgattcactcttgagagagataacagaaactgaagtgaagtatccttgatcttggaactccattcctcccctgctgagtgagaggagtctcagactgtggaaaataaatggctgacagaacaagatcatagagttttcctatattctgtaagttactgacaaaaagcaggttgagttaaaactaagtccatgtaacccagcatgttgagaaagatctt

SEQ ID NO: 10261 - DNA, 433 bp, Homo sapiens
  misc_feature 377: n=a, g, c or t
gttagataaaatgaatatgatctagtatgtgatagcataacagggtgactacaatcagtgataattkattgtatatttaaaagtaactaaaagagcataattggatcatttgtagcacaaagaaaggataaatgcttgaagttatggatacctcatttaccttgatgtgattayyatatattgtatgcctgtaacaaaatatgtcatgcacttcacaaataagtaaataaatctatatctactatccacccacaaataawammtarawaragtaaratawacaaattaatttaagagaaaaaatggacttgttgcccagctgctaggagtgctctcagaagataacctgcagctgtcagtctatcagattwtgtcdnagctgcagttaccttacccacagtcacaaccttcctgggtcgtggatccagtagga

SEQ ID NO: 10262 - DNA, 336 bp, Homo sapiens
agctgtgggtatttgagaaaacatcagggctggggtctagtctattgagctkaacttcactcacatttctatttctagacatttcaaagtcaagggagtcataaacagctgatattctcatacttctggcctctgtacatgctgctgctcctgttggaacactgccctccaaatctaacccattcatcaaaacttaacttagataccagcacttctaggaagctttctgaaatgtgccgtgcttccagtgatggccttaaaagaatctacagcccaagatgctcttttggaatgtgaccctgttgtttcatcatcaagamctaacactgtgatcaa

SEQ ID NO: 10263 - DNA, 110 bp, Homo sapiens
ctgtttaagtttgtaggtacctcttggacttctgaattgatccagttgtcatccassacagacatctcacatcagatacagacagttccaagattgacaacagagaacaa

SEQ ID NO: 10264 - DNA, 170 bp, Homo sapiens
gttaacatttccaagctcctggcctccataacgagcaccctgtgacttttgagacgttatggataatccttctgaagaatctaggttgcagtgagccaagattgtgccactgcactccagcctgggcgacaagagcaaaactctgtctcaaaaaaaaaaaaaaaaaaaaa

SEQ ID NO: 10265 - DNA, 493 bp, Homo sapiens
  misc_feature 280,292,308,321,334: n=a, g, c or t
tccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaatkgccttgttaaagacatgtgatttgtattttagatgcttgtttcctattaaaatacagacatttctaccctcagtttctaaatngtagactatttngttgggctagtacttngatagattccttngtaagaraaaatngctgggtaatgtacctggtaacaagcctgttaatatattgargattgarraagtaacttctatagttactccttctaaaatatttggcttcctaaattccccccacccaaaatctttcccttttgaaaatactaaaaactaagttatgttattataaag

SEQ ID NO: 10266 - DNA, 498 bp, Homo sapiens
tttatctctgcgctctgcagtgtgccatgggcaataagttttgtgtggtctgtttgaagaacctggataatacataaccaaagcaaacaaatacattttgtatggcctatttgaagaacctggactaatacataaccaaagcaaacaaatacagctgactgcatagataaaagaacaagagggtcaaatccattaactgggaatgtcagaagtcataaccatgcctgatgacaacagtttcctttggcctggtgtggtattgtaaattgtcgcttttagaccaactttttagtgatagaccctctctatgctttttgttgtaagctactgcagattcttgccacaggtatgaagtaaattctgttaatagccttgatttttcacctgtgccaccatatatatctttgccatggcctcatgatggatggaatatacttccctgccccttgacttgatacttgaccatgtaacttttttggaacaatgaaagatgatgga

SEQ ID NO: 10267 - DNA, 532 bp, Homo sapiens
atatagctttcattttattgctatttgaagcagatgttcaccartgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcacttcaaagcagactgaatgtgacttcatctaaaggcagcattaggtactgcatggraataggkcattaacttgaaactcttatca

SEQ ID NO: 10268 - DNA, 563 bp, Homo sapiens
atcgcacgccaccgcaccccatctctcgaaatctgcagacatcttgatttttcccacgctgtctgtcaggtctccgccgccactcgacgccagggcgccgggccttgtgggctgtgctgcacctcggacggcttcgcaccagccagcgccctctctctcctgcagcactctgatctgcaccccctgagggscttccactgtccgcggggtgagaatgcccctgggagtgtcacatgactgccgccccatgtgtgtgagaggcgtcctctgggagagcatggatcctgaggtcccaggattgtcagctgacctctgtcctgtgtgcccagtggcaggtgacgtgtcttcaagaagaggctgagctgcggtgcttgtaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcc

SEQ ID NO: 10269 - DNA, 266 bp, Homo sapiens
  misc_feature 181,266: n=a, g, c or t
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttnaaagcagtatgggaaccaaatttttgtaaagtaaatattttcaacctttaaaaaaaaaaaaaaaaaaaaaaaaaaaaaaaaaaan

SEQ ID NO: 10270 - DNA, 519 bp, Homo sapiens
tttcagcttttctgtggcaaacagggccgagggctggtgaagctgttaaggctaaatgtcgcatgcatgaggcgggctgcaggcctccttaggcctttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccatggcctcccaaagtgctgggattacaggcgtgacamccatgctcggcctaaaaaacaattttcttgaagaatccgattttgtgcatagtaatgacacagcaccattcctgagaaataggaaatatatgtgtgtggtatga

SEQ ID NO: 10271 - DNA, 157 bp, Homo sapiens
atacttacctggcaggggagatassatgatcacgaaggtggttttcccagggcgaggcttatccattgcactccggatgtgctgacccctgcgatttccccaaaaaaaaaaaaaaaaaaaaaaaaaaaaaaaaaaaaaaaaaaaaaaaaaaaaaaaa

SEQ ID NO: 10272 - DNA, 452 bp, Homo sapiens
  misc_feature 375..377: n=a, g, c or t
ttcaaataaatccctaataggtaacaagtaaaatacaaattcttgtctactttcatgtggttttaaatggcagggacttcgctgagtcagtaagtataatcactctagtttattcaaggatgtgtggcaactttcaacttccatacgtatatatgtatgtatggaaggccatgtcaatactagtatcattggatataactttgattcttaatcagagggcaaattcattagagaagaatctttagtagatacacagactaatatttgtgtggaggttcttttgaccaattttattcctaagaataaacaaacccctacagttaaaatgcaaagatgcctgtcatctaagtattgaaagaatttttgcctttcaannndargttttttaaaaatttaataaattcataaaaaagactcatatctttgcaacaaaagaagggcagatactgggc

SEQ ID NO: 10273 - DNA, 352 bp, Homo sapiens
aacccttgtactcaagaggtttcsrgtacactatctaatcaactaatagactttaggacagcgaatatgaatgacatgaaggtgccttgagaaccatcgagtcctacctcttattttgrgactaattgaagatactgaggcccagtaattgratcmtatagattgctaaaagaagttctgagaagaaatgaaatacaaaagcttggtttctaaggctgaatatcatgagaaactatcatgttatcctgtgtgagtgagctccacgaggccargttaaagraattatgraaactgaaagcctgtctttatccaagaaccaamastgcctggacaaacaacttatgaatacatc

SEQ ID NO: 10274 - DNA, 429 bp, Homo sapiens
aagtccttcttaatatcacaaccctcacctccagccagtgtgtgtcttgccagcacaccgatgggagccacttgttcacgtcccttcactggggtgcacggactgccacccaggtgttcagctttctggcattttcctgttatttgcgtgctttatttggtgcacgggattcttttacaagttctatgatcctgcggacaagccactacttccatttcaggtgttccaacctttctagacaagaaccgaggtgtcacaacagtgaactttaataaatgaatccagcgtatttccggagttctgaggatctctggtctctgcctctgtgagctcaaccagccattcatgaaataccctcccaagaccagcagcatcagcatcactgaaaatgcagatgctcaggttatttaaaacaagtaaaatctgaga

SEQ ID NO: 10275 - DNA, 397 bp, Homo sapiens
aattctgactcagaaatgtctgccttccctgtctgccagcagtcttacccttggtttctggtagatccatttccattcttttaactatttacttgatcctgtggagtctttcttaaaaatacagtctttagatattgtcagttctaagcattcacagtgtgcaagagataaaagagggataagacaactgcaattcaatgtagcatcaagacgggaagaaaaacacagcccttgaagattccaaggagaaagatctaactcactggagaaagatcaaactcatcgtgatatcaaagaagcctgaggaaggaggtcgcatttgaaatgggctttgagtggcggatgagcagtggttacaggaaagggaaaggcatttcagatgggaacagcagcacca

SEQ ID NO: 10276 - DNA, 441 bp, Homo sapiens
acttgctgcgtgctgtcaaagtctttgtaaaagtgacgtgaagagattttcatgttggaaagatgactaactgcatcgtagaattaatgtgaaagggtggcccaaggaagcaagtttcttcacagctattgcaataaacagggtctactggagaccttggctttttatttccctgacacaacttcacactgctggagcaatgcttggattgctctggaaacactggcaaatctcaagatgcagttcaggcttctccatgatgagtgtgagtccctaggctgtctctcaaactaaagattccccagccaggcaactctaaagagtcttcgacaaggcaacacaattactctgtgtgcttagaagaagaggggtcataaatgtcagctgwtgctctttgagtcctgctaattcattcattgattcactcatctttcccacagg

SEQ ID NO: 10277 - DNA, 237 bp, Homo sapiens
gagatkatrcatctggagtgggaagaagcaacacatcaaaaatatgaccagaccatccacggcggctcatgcctgtaatcccagcacattgggaggctaaggtgggaggatacgtggagcccaggagttcaagactaccctgggggctatatggcgagacatctttattaaaaaatgataattaaagttcaaaaaaaaaaaaaaaaaaaaaaaaaaaaaaaaaaaaaaaaaaaaaaa

SEQ ID NO: 10278 - DNA, 252 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaaccaaatttttgtaaagtaaatattttcaacctttaaaaaaaaaaaaaaaaaaaaaa

SEQ ID NO: 10279 - DNA, 437 bp, Homo sapiens
  misc_feature 49: n=a, g, c or t
attatkctataaaatcccaccaccttacaaacacaaaatgttacaagtngcccagtcaccccggcttctgagatgaagrrdagdattgaagtcaaatctggtggctatcacactccatggaacttggggcaacatttaggtacctctacccaggaaagaatctctgagaaataggtggcagtttctctagcagcataagaagaaccttgataagcatcatccttaagtcctgacagcagtggatgactagtcaggaacctgtccaggaggacattgacatggatctgccagctttctaagactttccccagattcaagtccagtcacatcaagttgccttattaaagggtctgcccactcaaaaggagaaagtgcaaaagatgctcagcaagggtagcaaacgsatcagatgatacttcctgacagcatccaagagc

SEQ ID NO: 10280 - DNA, 438 bp, Homo sapiens
  misc_feature 171,175: n=a, g, c or t
atctgagccgtctggagaccctgtggctggcaggcgacgcgtccccccgcccagggccaagggggagcagggctgtggagagcatgacccccttgttaaaccacgtctgcctttatgcctcgatacaccacacagagagatgacgggagataccaccaagatgagatgcmnaccngggagaggctctgcaggtcccctggtgcccacgtctacctggcttgtccccacaggtgggttttctgagacaagggggcttttggacacaggtctgtccccagagccagccagcagctccagagaagagacagcaggtgcccaggacgatgcggcttagttgccaggttgccacgaaacatccaatatttgaaagtgttctatggacctcaaagggcaagagacaccttaaaatgtttgctggatggctgtaggagggtagag

SEQ ID NO: 10281 - DNA, 343 bp, Homo sapiens
agaaaaagtgtttctttagccctctccctgacttgcatcctcatgagactcttaaaccccctcctgaccttcagagatgtttatcatcagagatgggttatggaagtgatcctatagaacctgagagattgcttaactcaaactctgcttctacattagagtgtcttctgaaaaatgacctcaacaaaatttgctatctacctatttactaacataaatgaggaaaccaaaaaggtcaacggtgaggcaggaaggtttcagttcagtggagaaaagaaaatcttgatgaaatgtcattaacttccatatttggaataagctataaaaggactacgtgtctttc

SEQ ID NO: 10282 - DNA, 402 bp, Homo sapiens
ataaaggcwggttccggctctggttctattgtctctacctgaacatcatcactaaattgtaccgtcttcttctctgttttrsktattcaacttacactattacaaaatttgaatctcacaataacccactgaaaaagccaatgaatcttcctttattacaaaagaagaagaagcctcagaaaaggttgaaatcctaacccccaaagcaatggtatcagaaggtggggactttggaaagcgattaagtcatgaatgagattagcgaccttataaaagagaccccagaggctcatttgcccctgctgccatgggaggacacagcaaaatgacagccttctacaaaccagaaagtgggccttcaacacacagtcaatctgtctgtgagaaataaattcctgttgk

SEQ ID NO: 10283 - DNA, 377 bp, Homo sapiens
aagtgtgtgccacagcctcctttctcatcactttaccagaagatgtgatttgaaaaacatatgaaaatattgccactgaasgsscacaccaattcctgaagagctactgaggattttggtgtcactttagaagtcactctatttgtgaatagcccagcaagagaatcaggtcaagctattagggagagtctatggaaagcaatggaatcaaatttccagccagaatttcagggtaaaattagaagtcttcaagaagtaaactatgagccaaccagcatccctasttggacactgctccagctgcctgaatgacgtaactaacatttagagrtaacagtgaatagaaagacacacacgacaccatctgratcacagta

SEQ ID NO: 10284 - DNA, 386 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaa

SEQ ID NO: 10285 - DNA, 440 bp, Homo sapiens
  misc_feature 263: n=a, g, c or t
gacactatggcaggccaacttactagctttcaagtaaggtaacatctcagaccatcataggttttgacaggggaaactctgaaggaccacaggagttggaggttccacgtatctctaagtagtaacatacgatgggtccaaaacagaagaaagagaactcaagattcccgagccacagagctgttgattggaggctgactcagagaaaccctggattcagtgacatacagagacaacagggacttaatcgccttctggacaancataatctatgcgacctcctccccataaggtacaggatcagtatgggttttaattgaggggctcggcaccaaatgacagacttgacacatccacccccaccatggatgctgtccgtccactgttgcacaatgtccttcagtgtctaatttacagatccagctgtatttcccttccac

SEQ ID NO: 10286 - DNA, 247 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaacaaatttttgtaaagtaaatattttcaacctttaaaaaaaaaaaaaaaaaa

SEQ ID NO: 10287 - DNA, 422 bp, Homo sapiens
tcacgtttctaagtattatgattaaactttatttatttagcatcaagaagcagggaaaataaatataaactggattagtggttactagactaaaaacagagtagattataggcatataaataaaggcttttaaacccttctataagaaattgattactttctacagaataaaatgtktcctatgcttccagtgtagcttaagtgggcactcagcaaacagaggtaaaaattaggtgtttaaaatgaaattctttaaaaaatacattaatttgtcactaaagttttttcagatttattcttggggtggggataaaagacattgaatgccatgtatttcatctcatcccaatacctcaccaggacaaatgcaggatattacattgaaagatacatgcctggaatttaaacaggcacttaatttg

SEQ ID NO: 10288 - DNA, 135 bp, Homo sapiens
tgactaaaaaattagcaggcatggtggcttctcaggaggctgagagatgggacaattgcttgaacccggkdsatccaagacagcagtgtgccatgatagtgccactgcactccagcctgggtgaaggagtgagac

SEQ ID NO: 10289 - DNA, 430 bp, Homo sapiens
  misc_feature 135: n=a, g, c or t
gataagagaataaaagcaggctgtgccagccagcagtggcaaccagctccagtccccttccacactgtggaaactttgttctttcactctttgatataaatcttgctgctgctcactctttgggtccacactgcntttatgagctgtaacactcactgcgaaggtctgcagcttcactcctgaagccattgagactacgaacccaccgggaggaaaaaacaactccagacgcgccgccttaagagctgtaacactcaccacaaaggcctgcagcttcactcctgagccagcgagaacacgaacccaccagaaggaagaaactccaaacacatccacacatcaaaaggaacaaactctggacacgccgcctttaagaactgtaacactcaccgcgagtgtccacggcttcattcttgaagtcagtgagacc

SEQ ID NO: 10290 - DNA, 427 bp, Homo sapiens
aatgttcttgtgaatcttagacaacccccacaacatcattccctgctttatttgcttagtccattcttggtggattttatgagatgtcaacactcctcattaggattccctccttctgaagcctttgggattttctacccacccagcaaccaccagaggtgcagaaacccctgcagacatccttcttgcgcaasgcagttgtaccatgaatgcggtcgtcctgctgcagaccacgcccaccaagggcggggccacatccactgcagctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttt

SEQ ID NO: 10291 - DNA, 422 bp, Homo sapiens
ctcatggctctcggcggccttcccaggccccgcttttgacttttggcagcctcttcaggcgcagaacttgatctccaggcggcctttgcaggcccggcctcctgcctctcgaaggcctgcacgggcccggcctcggcctcggcctcacagcggactctccacgcccagatagctctcgcctcactgcggtctccccagtccaaagctcctggctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttggtaggtaaaaaaaaar

SEQ ID NO: 10292 - DNA, 75 bp, Homo sapiens
attttccaaagccatggtgaaacatctctgtgctaatttcttttgttttgtttcctaattttttttttttttggm

SEQ ID NO: 10293 - DNA, 477 bp, Homo sapiens
aatgcatatttccatctgggtgaaaaaaaaatcacaagcctctctctcttcctactgagcacctgtgaacagtgacctgcagtttgtggctgcagccagtcctcttgcagcctggwgttcttacatttcattctgaggctcacattctcagtcaccatgcagaagaacacccgccccatcctgggtcattacagagtgggtcaatccatctgctgcatctgaagagctgggtccagcttctacagtgaatccatatatttctgtatttcctggataaggaagagcaaaggagctgagctggtggaggaagaagagctaatattaactgactccttattttgtgctagtactgtgctagttacatattttgtctaattcttaccaaactgtaagggggtttcggagtgatggagacaatattgatgttatctccattttagggtgagaaaataaaggctcagaaatgttaaaaaaaar

SEQ ID NO: 10294 - DNA, 469 bp, Homo sapiens
gtttccaggagtgatcttgctctgaaagagsccccagaagtgaatcttccttcttttgaggcccaggaagattgctatcttgctgctaccagactgagtgtgagaccgacacatggaggagagtggattcaagagaatcacaggaggtagattccactggatgaaatcctccccaaagcccatctgactccttgacwkctagttatggttcaaggtttctgggttgatatttacaaaaagagattcttaaaaagaaagatcttcaaagagctacacctagctctgtttctgactgtgtgaccttgataaagacacttagcctctcagaaccgcaatctgctcacagctaaaatgaaggttaaaaaagattactatctcaaacatttctcacagaatttttgggaagataaaatgtaaagtaactgcaaggagttgcaaatctcagtaaagatattattatctttaaaar

SEQ ID NO: 10295 - DNA, 1211 bp, Homo sapiens
tctttgcgtctgcgtagttcgctcacctccctttctaactccgctgccgccatggctcctgtgaaaaaagcttgtggtgaaggggggcaaaaaaaaagaagcaagttctgaagttcactcttgattggcacccaccctgtagaagatgggaatcatgggatgctgccaatttttgagcagttttttgcaaggaaaggatcaaagtgaacggaagaagctgggaaccttggtggaggggtggtgaccatycggaaagggrcargrscarggwtcaccgtgtacatccgaggttgccttttctccaaaagmgtatttgaaatatgctcaccaaaaaatattttgaagaagaataatctacgtgactgggttgcgcgtagttgctaacagcaaagagagttacgaattacgttamcttccagattaaccaggacgaagaaagaggaggaagacgaggattaaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggrtacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatggg

SEQ ID NO: 10296 - DNA, 481 bp, Homo sapiens
tgtcacgtgtaagttcagaaagcactttggtcttaattggtgacttgggggttatttggtataaatataggttgtttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagacacttttgtcactttaatttttagattatctcaagttttcactagatttcaatgtgccacttgtgctatgagtctttaagaagctttaaaaaataaatgcacacctgtagccttttaccattcagacaggtagattatatttacctgtcattagggaccatgtat

SEQ ID NO: 10297 - DNA, 259 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaacaaatttttgtaaagtaaatattttcaacctttaaaaaaaaaaaaaaaaaaaaaaaaaaaaaa

SEQ ID NO: 10298 - DNA, 74 bp, Homo sapiens
cagaaagggctgtgtagagtagggccctgttctccttaggatgttgcttcttgattttttttttttttaggggk

SEQ ID NO: 10299 - DNA, 519 bp, Homo sapiens
aaaagcttctgtaactagggtgaaccaccatcattgaaaaggtggaacctgggaccttcggatatgagggcagaaccttgggccccagcatgctatgtttaggacatttggcctcttactaaacccactcagctatgttcctcctttttttctttgtttcttcagcacttatatattcagtttgcactgtattaatttgcacttgtttgcatgttgctttcaccttttactgtgagagtgggcacacagtatatgttgtggaatgacatcctgagtgatccctccctggctgggcctcagattaaattccctgaaatggaacagtcctaaccaacacaggacaggcgagtctgcggacaccagaactgacctgggagcgagtgagatctcaagttgaccatgtgatatggcctgatggcaagaggatagtactgctggcagaggagaaacaaactgaaggagaagcacaaaaatcatcacagctatggtgaaacctgtctctacaaaaaaaaaaaaaaw

SEQ ID NO: 10300 - DNA, 310 bp, Homo sapiens
gattataactctaagtatgactaggaacacaccccacaacctggatatctacttcagcagacaactgcagaacagtagttcaccatagaaaacgaatttctgatggagtctctctctgtcgctcaggctggagtgcagtcgcgcgatctcggctcactgcaagctctgcctcctgggttcacgccattctcctgcctcagcctcctgagtagctgggactacaggcgtccgcamcamacctggctaattttttgtatttttagtagagacgggatttcaccgttagccaggatgttctcgatctcctgac

SEQ ID NO: 10301 - DNA, 323 bp, Homo sapiens
agttcttaacccatttcctagcctaaggacgttcagagtgtatggattggtcctgttcacatcagacacctgagccctttctaacattccccactttaaagtgacttgaagtttgaatctctgccaaccacaatgacttcttcttagaagtaaatgtaggaagctgctttggtcatttttcatggcgagtaatcaaactgaagatcttaaattcacgactagtctgaagacagcatccccagtggactagatgcagaaataaggaaggagctattaaaatcrrccacttgtcccgatgaagtagaagatagcttcttctctgc

SEQ ID NO: 10302 - DNA, 290 bp, Homo sapiens
acttccggttctctatggtgcgcgggcaagctttgctccgcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaactatgtcatcagaatcgagcaaaaaacggaagcccaaagtgatccgaagcgatggagccccagctgaaggaaagcgga

SEQ ID NO: 10303 - DNA, 359 bp, Homo sapiens
ctcttaccggccgccacctaagatgtaactttgctcctcactcgccttcctccatgattgtgaggcctccccagccatgtggaagtattaaagcaatgaaaggggtcagaatctattggtgttaagaagtcagcctcagcactaagagaaagaaggaaagaatgaaggaaagaaagaaagaacaatgaaagcattgtaagaaatatttatacagcaaatgttacagagaaaaccccaaaccaaaatgtatttcaaaaaatgttggaggaaatgttatatctttttatgtgcttaagaaaaacagttaaaaagaacttcacagcattgggtctattaagcacatttattccagtgatttc

SEQ ID NO: 10304 - DNA, 303 bp, Homo sapiens
aatcgcgcccgcggagtgctttccgcaccgcctccggtgcgtgggcgggagacataagcctagccaagcccatacagcccggctcgggtggctatggataggcgtactgcagagacacctggacgcgcactgtgacaggcgccattctgacacacgtgctctctcactcccaaacaccacgggccgcaagcgctcacacccacactcacctgcagggaccacgtgggagaatttgaagggctgatactgtcccggtgcattcgcagtagcaatgatgcgagaattcgttttaacctcgtcack

SEQ ID NO: 10305 - DNA, 462 bp, Homo sapiens
aaaaaatctccatacagttttccatagaggttgtactaacttacgttcccagtagcagtctataagtgttcgcttttcaccacatccacagcaacatctgttgtttttgactttttaataatgagaggtgccttatattaaatgaaattcctcttgtaatgaatttcaacttctccwagagaaaatcccttgaaaatctaaagaactgaccagctcttccctacatgyctgttttagggcaaggttaagagaagtttgtttcaggggattgctgaactgwrggmcyctgagaaaactggtccgctttctaactactcctgagtcaggttttcagaggacgagaatgacgtcttkatttactttaacattatgactctttacattcagatgcatattgaaaaaacacaccccaaaagaaattattattgatttatgtaatactttgcttccttgtatgagaaa

SEQ ID NO: 10306 - DNA, 249 bp, Homo sapiens
aattcctgattcagactgatttgctctaactgtgatttggggcaagtcccttcccctgtctagaccttagctggctgccgcatctaaaaaatggagccaataatcttttcctcgtctttggggtcatccatctttcaaccacatcaggagcagcgggaaccaagtgcagaggatggccttaaaagcagtatgggaacaaatttttgtaaagtaaatattttcaacctttaaaaaaaaaaaaaaaaaaaa

SEQ ID NO: 10307 - DNA, 344 bp, Homo sapiens
tataacatacagatttgaamtrtaattcttcctaattaagacttccaatttggctaagtgcagtggttcatgcctgtaatctcagcactttaggaggctgagcttgagcccaggagtttgagacaagcctaggcaacttagtgagacctcatctctgccaaaaaaagaaagaacgaaaaagaaaattaggcacgtctgtagtcccagctacctgggaggctaagttcacgggaggatcacgtgagcccaggaggctgatgttgcagtgagctgtgtttgtgccactgcactccagcctgggtgacagaacaagaccttgtctcgaaaaaaaaaaaaaaaaaaaa

SEQ ID NO: 10308 - DNA, 468 bp, Homo sapiens
caaatgccttatcacagtgtgtccaaacttcttgtagggagcaacggggcctctatttaagcctcttgtgagccgatccaccagccaaggtcatgttgctttcccttaagaatcagagccgcggggatcctgttctatctgttctttccacagcctcctgtctttcagcagggcagatgcctcccagaaggaaaccagatgccaggactgtgggggactcttgagcagcatcagccaaactgtaggagctgagaagaggaagctttgctcagggtaagcgccctgggataatgtctttaatgtcaagaggatgcacgctgtgaacgtggaaagccctccaggctgaaagagggagtcacacaggcggggagtgttgccaagcatttgcgagcactctcttcggtggacagacagccggcttgctcatgattccgccttctctgttattggcaacaagccgtcactgga

SEQ ID NO: 10309 - DNA, 486 bp, Homo sapiens
  misc_feature 141..142: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcnnggcaggccaacattcaaattcaggagatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagat

SEQ ID NO: 10310 - DNA, 391 bp, Homo sapiens
  misc_feature 353: n=a, g, c or t
gtctttctgcgtactgcactaactgagcgaccaattgatacctaagtttagctgaactttttgttgaattaattaaaactgttttgaaatctattctgtaagagcctgagaaaaattgcggccacagaagctgttttgaaatgcgcttggcttccgacttccgcaaggggaggcagctgtttcttgtagtcttgctctgtcacctacactggaattcagtggcacagtctcagctcagctcactgcaacctccacctcccgggttcaagtgattctcatacctcagcctcctgagtagctgggattacaggtccctgaactttagctggccccaaaacttgagcaagctctrngaagcagaacatctcccacttaacagtttattctgaga

SEQ ID NO: 10311 - DNA, 72 bp, Homo sapiens
attttccaaagccatggtgaaacatctctgtgctaatttcttttgttttgtttcctaatttttttttttttk

SEQ ID NO: 10312 - DNA, 367 bp, Homo sapiens
  misc_feature 23: n=a, g, c or t
caaatctgattggttttctactngtttatttttttaatgtagttaataactggaagtattttattttgcaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagct

SEQ ID NO: 10313 - DNA, 426 bp, Homo sapiens
atgatatcaccgttcttgttgtagcaacaagccagtctctgaaatgttttccagaggtttgcatttgttgactccattgactattttcttgataatgtagctgggataaactagaaaacaagtttccccatggtcagctggaaatactcatattgcacttggacggagcagattgtttctgaagagggccagtgatgagcaccagttccctccttgcccaggccaacagcgtttcacaggacccctgggatcgtcctgatggttctcttccaaacaatgatctagaaagatgccccgtgtcaagttgcttgcctttcgaaggtcttcaaatcattgttcctccatatcatattcagagctagtgctttcatgctggtgagctcttgggggatttttttaggactatgaaagaaacaaaaaactarr

SEQ ID NO: 10314 - DNA, 444 bp, Homo sapiens
agtatgaagagtaggaggcactcacagaaaataaacaatgcacagagttatcaaggaaacaccctgatatcaattagatgaagagctataaggaatctatttatcttggagagatttcactccaagggtcccagtacccctcagtcaggtgaattggatggataacatacaccttccttctcactccccgttacagaagacgcgaaacccaacagtgaacccgtacctgaaatgtcaacgtgggaagccaggctaattagagtggggccaacccgcccaaccgcatagctgacatgcacccgctgaascttcttgtaacttgactacccgaagcctcatccctgattaacagagcctagctgcaaactaaaatgcagttaatttattggagaagagaagatggtgaacctgcaaggagaatgggtggagccaagtccagatgac

SEQ ID NO: 10315 - DNA, 348 bp, Homo sapiens
aacttggactcccttgaggccaccaaagggcaactcagggtgcaggccactttctcatgtccaccatctgcctggagaatccagactgcacagggtggccagctcccctcttcacagccgtggattcagctctgcttacgtactcaattccagacttccttgtttaaaaacagctgaaaagacatcaacaagcaatgttggtttcttagttttgacaggtacaccatggcaatgtgggatgttaataactttataggaaaacaggtgaagggtagatgaaaactctctactatctttgtaacttttatgaaaattgaaaatattctaaaatgcaaaaaaaaaaaaaaw

SEQ ID NO: 10316 - DNA, 430 bp, Homo sapiens
ttaaatttattttttaccttgagtgtctgatacataaaacccttttctaggaaaacattggaagtagtacatatttactctaaatgtctcacctgcatgacagtcttttcaaatgaaagacatggtaattgcaatttttttttaaagattgctattaagggtactttttccagccttcatttgagtaaatcttaattgatttcattttattaacatataccctttacctttaatatttcatttgaagtgttcctttcaaacttactgtcttaaatatgaaagtcagctttaagtaatgtcagactcatatgcattttcattctcattagctaaagtaaaatgtaaaattatctcaaatagttacaagttttggaaatacagtataaaacatgaatgtaaagtctattatgtaatatgcttatttgtaatc

SEQ ID NO: 10317 - DNA, 440 bp, Homo sapiens
tcttctttctgatataatccccccactcgctccatgtcaggctttgttctctagcggattgtccttcttactcttcctggaacgaaggcctgcatcgagccatttgcactgatgcttccaaagaggagggtcccaaagctgtaagagagaaaactacttgagcagaggccccagctgggctggtggccccgaggctgactgcggtgtgtgctcctccctcaggaggccattgccttgcttgacatctcctggrcaagtctccacagaacctcttatcaaactccaaagtcatcttcttccacacgttgtgctattagagattagaggagttaatgtaggtgcagcttcctcacagaaaatgcaagacacacaagggctgctttcagcattctgcttgatcgtgcacagctagacgcagagcactcaggagcacacaggag

SEQ ID NO: 10318 - DNA, 433 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctarcaaggcaggccaacattcaaattcaggabrtacagagaaggtgacaaagatactccttgagaagagcaaccccaagacaaataatcatcagattccccaaggttgaavtgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagct

SEQ ID NO: 10319 - DNA, 283 bp, Homo sapiens
atcttaagaggcgttcctttttgcataggccacaaaatctctcctaggaactacatccagaaccatttacctgttggatatgcttcttcctgcacactacctaataagatgaaacttcctgaagttctcctcataattagtcccctgctcaagaacctccaattgcatttaaaagtgcaacctgcttttctagtcacaattcctgcttcttcttgcctttaaaaagtttataataaagccaaactgggtgctttcttcactgaaaaaaaaaaaaaaaaaaaaw

SEQ ID NO: 10320 - DNA, 505 bp, Homo sapiens
atctggttgctgcatttgaagcatggcattaatttgkatttgccctgttctttgacctaaagttgaagggtttagagtttttaacctgatctgtagagcagagaggttgaaagcacttaactcttgtttagtatcckcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccmgggtatcttaaaagcaagttgttctcccactactttcctttccctctgccctgccattcctattacaatgctaaaaaagttctgcttcttaggtgaatgggtactttctattttgtttctaaacgagcaattttgaggatgaaatgggaagatatcattgcttcctttttgcacctattgggtatgtacactctggc

SEQ ID NO: 10321 - DNA, 157 bp, Homo sapiens
atagactacttttctaatttggtaactatactgtagttagagtttgttatttgattttagaaagagacaagaagattaactcgacatttttacgtatttcatttgcttcagtttgaagtgcatagatttgaagattcttgaatcacaactatgtggt

SEQ ID NO: 10322 - DNA, 436 bp, Homo sapiens
  misc_feature 340: n=a, g, c or t
acttctgattctctggatcagtttcttagggtgggcgtttttgttccaagtaatggtgactttaattagcatgagtatgaggggctggtgatgagaagaagtatgaagtatgaagtgtgaggggctggatgatagccagccttccctctgagctacagaggtacatatccaccagtctactcggcttctccacttggatgtctaatagcacatcctgtttaatgtgtctacatcagaacttctgatccagctccccacctgcaccccacctgccagggtctccatttcagctgaagccttgttgttgctcactcggctgtctaggcttagagcgcagganscatccttgtttcctctcctctccacttcatgcctcgtcatccagtccatcagctgtttgcagattttgttccacatccagccatttctcagtgct

SEQ ID NO: 10323 - DNA, 445 bp, Homo sapiens
agattttcctgggtagaccttccacaacattcctccggggcattgtttggttcctgtgatgtcaggggtgtacctctggttcgacctgtcaaatcctgtgcactctgtttgttccaagttgtttgctctgtgcccacagggatcctcccttcagttgtactcccagctttgggtctgcagagtctggctcacacctgtaaccccagcactttgggaggccgatgtgggaggatcacttgaggccaggagttggagaccagcctgggcaacagagcaagaccccgtttctacacatttttttttttaaattagccvggtatagtgatatatgcctgtagcacagctacttggaaggctgaggtgggaggcttgcttgaggccaggagttcaaggctgcagtcagtgagctatgatgattgtgccactamactccagcctgggtgas

SEQ ID NO: 10324 - DNA, 450 bp, Homo sapiens
gatatatccacctcctgtatccaccgagcagcactgagcaacagaaatgtaacccaaacccagcatatgatctgtgtcaagggagagagccatcagtcattctcatctcttgaatttcatggcctcattgcttccttcccacctgtaatcacagctgtgcctgtgtgacaaacactagagtgctagtgatggtttatgggtttcaaggctacagtgttgcagactctgcctggctcccttggattacctagactgggggaagccttaagccctctcatgacgacatggaagtagccgtggacagctacacatggaaaaactgaggttctcagtcaacaactggtatcaacttgccagccatgtgaatgagccactttgaaagtatagctcccagctcagccaggccttcagatgactgcagcccccacatctggcatcaatcacctaagc

SEQ ID NO: 10325 - DNA, 445 bp, Homo sapiens
attctggcaactgaacgttggcagtaaatgcagcttagttgtctcagaggactcacaatgggatgtgtttatagttgttgccttgaagtgtgttgtggcgaggatgaaatagtgtatcctaggatgccaggggaatccaccgtctgccaccgcgagcgtgagaagccaatcacctatcactggtatcactggcatcccggccatatataccctagaattgcatcaatggaagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggca

SEQ ID NO: 10326 - DNA, 342 bp, Homo sapiens
tgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctaaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggctt

SEQ ID NO: 10327 - DNA, 362 bp, Homo sapiens
  misc_feature 34: n=a, g, c or t
cttttggtataggttttaaacagaggttcatacngagtcaaagatcctacctgcggctggcttagcaagagaaggaactagccatacacctgagttccccttacggagtcttctgttttctcaggaggtgggcacagctgggtggtgttcacgaaggctgcaaatgtgagctctgataagatcgcagtgctgcctgccatgagggaacaatccgtttttcatgtgtaactggtaatggaagagagagacagatatgtcaatcttgcacctggaaaggaggcagagcaaggccacctcgaggaggacactttgctgatgcccaccatggatttggtccctgtggcctggccattgctaggagm

SEQ ID NO: 10328 - DNA, 304 bp, Homo sapiens
ttaagtattggttaaactaaaaatrataagcaaaatggacattatctataaaagcttttgtggaaatggctagagctagggtaaggraacaaatttgdttccccatacctgccctccaagaaaataaagctgtcaaggaaaatctgggctaagagtaggatatgagggatgatggataaggcatgagacatgagaaataagggggattaaattattattactattatacaaatgatgcctgagtagatttttaaaakgattaaatmcccaatgrkgtaaaawacatttataggataggaaagtc

SEQ ID NO: 10329 - DNA, 308 bp, Homo sapiens
  misc_feature 198: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccanaaaaaatttagccaggcatggtggcacatgcctgtagtcccaagtagctgggattggaggtcccaccaccatgcctggctaattttttgtactttcagtggagatggggt

SEQ ID NO: 10330 - DNA, 278 bp, Homo sapiens
acaaacttttttgtattattatttttacatctagaataaattatttaaattatttcacagcaagggagagggataggtaatttttatcagatatttttttaaaccatctgttttttaaattacatttttgtttatgttcttgagctgatgtagtggaacttgcctagcacattcaggtcccagccagttggcagagcatgctctcatctccttattccataccctgggcgtcccctttctgttgactcaggaactttctgagaatgaggacagcacta

SEQ ID NO: 10331 - DNA, 259 bp, Homo sapiens
  misc_feature 228..230: n=a, g, c or t
tacctgcggttcatctccgcacattccacacgcggcccaaacggtctctctctctctctctcaaacaccgcctttccgtctttgttttatcttgagtagcttagaaagattggagaagaaagcttacgtggaatgaaaatcaacttttatggatattttgaggactaaaagrataaatagggcgtccgtactgtagcgaaagtgcgactaaggttaggcatctggatnnnvcccgtagccctctttcaccccccccccc

SEQ ID NO: 10332 - DNA, 656 bp, Homo sapiens
aagatgagttcagcccctttcctttctctctcgcacacatatttgctcgcctttttgtctgccaacatgggataaagcagcaagaaagtgcttgccagatatgggtccttgaaccttggactgcccagcctccagaactaaggactcactgctagcagatttatgggatcaaaagatggaatgtttcctatgtgccagtgtatagatgctttgcagcatcccttacgccatactttggtaaatactgttcatggtcttagaaatgccaagcaagcagacagcaggaaactagtgatctagaatcagcaagaaacctctaagccttttagatcaactctagaagacagtctccctttggtgctgggacacatttacttacaaaaatgtgctaagataaagaaactgaagcacagttaagtaatccatccaagatcacacagctaatgggaggagtgaaccccatacactcaagtaccaataccacactcttaatcactaagccaggatcaatctgatcatccacaagtgttctcctggagggactcagaaatgagttgtgcagagcgatgcagaatcattccttggagcacttscagcagaaatwagacmcagaaagaaggttctacttcactgatctcaacatgcatatgtgtaca

SEQ ID NO: 10333 - DNA, 445 bp, Homo sapiens
  misc_feature 65: n=a, g, c or t
aggatgaggtagtggcgaggataggcgtavagcggctcagctaccccaggaaggcgtcttcgcgngagcctcgggtttgatggggtaggcgtcgaccagcgcccccaggtagacgagcagggccaaaagcaccgtggccatgagaggccacgacctgcgaaccgacaccacctgggaaggcgacattggggtgtgggtcattccgagcvtcgaccctccacggcgggaggctgcggctgccgtcggggccgtgctccggtgctctccctggggctggtagcggaccaaggttcagccaccagcttgccatatgttctccggcactgcaccgtctcctgcctcagtttcctaatctgtcagagggacataagccctgcctgacgtaaccccasccccacccccgctgctgtccagagaggtagattaaagagggttgtgctggcaa

SEQ ID NO: 10334 - DNA, 589 bp, Homo sapiens
  misc_feature 589: n=a, g, c or t
atttttaaaggctgttagcatcttttgccattcattgcaattattactttggatctgtctgatctttaatcattcaaaatgtgctgctcagaaaatgtggtattatgaggaagatagaatatgcaaaatgcaatgtttcttatgcaataaagtttttttttaaataaacatagaattccatttcagagattgtaattccatctggtgaagttcctggttctacttgtatcagccttcttaccatgttcttgtttcttagggagaaaatcctccacctccgggtttcataatgcatggaaatgttaatccaaatgctgctggtcagcttcccacatctccaggtcatatgcacacccaggtaccaccttatccacagccacagcgtaagtagtgtgaccccaaagtcctttcagagcagtatttatgatctaatttagtaactttactttgaagccccaaagtcattgtcaaatcaataagtaagaaccattgtgcataggattcctgagtccctgctacaaagagacatgtttttttaggaggtggcctgaatcactatgctaggaagtagctcctttgtcacactgtn

SEQ ID NO: 10335 - DNA, 160 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10336 - DNA, 498 bp, Homo sapiens
taggctgtcctgagagccttacaagaagcacacgtgtgaaggacactgtgcaggagacctgaggcccacagccccgctcctcacctgcacgttctgtctgatgcgctgctcattgtagctcttggccaggaccacaaccccacgctgtagctggtagcgcagggcaatcagggctggggttcgcttgtgcttttttgccaaggcacaaaggactgggtcctccaagagcaccggggagttcgggtccaccctggaaggaaaggcagaaaggctgaggccctgaggctggggatacagtttgttaggcggctccctaaacagactaaggcgtccactctgcaccggagcttctcaagcgaggcccccgaacagcagcctcagcatcacctgggatctcgtcagaaatgcaaattcttccctcaccccaagtcagctgtgagtgaactccaggaaacagcatgatctgattaaattttttttaccaaaaaaaaaaaaaaw

SEQ ID NO: 10337 - DNA, 517 bp, Homo sapiens
atcacaatattcctgaaaggacaaaaggatgaaaggatgacttccatagccctgttttctttagacgctgactcctgctgtctaccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcagctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcamcccamcctctcgatactacaaagcccctgcttgttccctagtgcactcccatgtggtcctgtggagcatatggtatcttcctcttctgggcagtgagcatatgtgactaataaactatctatc

SEQ ID NO: 10338 - DNA, 493 bp, Homo sapiens
attccagatgctctgatcctaataatccttttgatactctgttctaatttactaagaagagtcaccaattttgtttctgtggtttggtatgaaataaggtggcagaaacagcactctccaaatatccatgcactcctgacatttttcagcagcccacattactaattctggctgagggattgggagcagaagagacacgtgtcatctctgagttgaggctgttaagagctggtgcaactttccattcttctcttcccctcttggagcctgcattgctgaatcacaggatgaaggcgaatccctgccagcctccatccatctctggggtgcttagcagaatcctcagctcacaagatgaataaatgcagactaaatgatgcacaaataatcttcacacacaaccatcaacacatggaaagactgcaggacggccagatcccaagctaacaaacaggggaagatgatgtttcaaatgatcatctgaatgctgggt

SEQ ID NO: 10339 - DNA, 525 bp, Homo sapiens
aaactaaatactaccagacatgtatacaaacaggaaaatgtaacttatacttgggaaaaaatggcagtcaatagaaactgatgctgaataaaagcaaatttagtaagaattttttacccaaagttttcaaatcaaccattgtaaatatgtccaaataattagaagaaaagtgattttaatgagttaatatataaggaatttcaacagaagaaaaatgaaattaaaataaatggaaattctacatgcaaaaaggataactatgtaaaattaactagaaatgctaacagattagacaaggcagaatacaaaaccaggaaacttgaagataaatcaataaaagtaaccttccctaaaaaatagcaaaaaagaaaaaaagactgccaacaacaacaacaacaaagccaccaccawcagcaagaagactcaggaacacatggaaaaatatcaagtggtccaatctaagtacacctggattcctagaacattgaaggctgaagacgtaagcaatgatatactgtgtcttct

SEQ ID NO: 10340 - DNA, 293 bp, Homo sapiens
gtttaagttgttctagtgaaaggtatctcaattcagaggtacccgaattagaggtacccacttatgggtgggtaaattactgcaagagaaggaatgctctccgactggaaaaagcctaacagacggcagatcaaggaagtcactcgccatctgtgagggaggcagcggascccagaggcactggggagaggcagctgggcctcgamsttgtggttgcagattggagctggccaggtgctcctgaatgctttcatccatttaaggaacatttacggcactgtgagagaggatgc

SEQ ID NO: 10341 - DNA, 447 bp, Homo sapiens
attgtgtgatttcaggaagtagggcaattgccttgaattatgaattaaatcatgaattgcatcatggattaaaagtctcttattcctttactatctgcttctcaaaggagctactagatgaaaataaacatccacttgaggtgcaatatttctcaagaatcatgatcaaaaagacactttgattggaccaaatattgactgtgttcagcatgatgaatttcccaccgcagatccacatctcaagtgacagctttagaagacatgaagacatggctgaaactttatccagtgaaacctagttcagcagccagaacaagaactaccacgttttcaagagatcttcatggctgatcacaggtctagaaatggcatgtcttcaggtggtagtatcataaattgtcttaaattaataccaaagggaaggatgactaatttgtaaaagttgga

SEQ ID NO: 10342 - DNA, 399 bp, Homo sapiens
  misc_feature 316: n=a, g, c or t
actctttgggtccgcattgcctttgtgagctgtaacgctcaccgtgaaggtctgctgaagccagcaagaccacgaacccacttggaggaaccaaaaactctagatgcagtgctttaaaagctgtaatactcgcggtggtctgcagcttcactcctgagccagcaagaccacgcagccaccagaaggaacaaactctgaacacatccgaacatcagaaggaacaaactctggacacgccacctttgagaactgtaacactcaccgcaagggtctgcagcttcattcttgaagtcagtgagaccaagaacccaccaanttctggacacacttctctagtgactaacaatgttgagcatcttttcatgagcttgtttgccattaaaaaataatcaagctggc

SEQ ID NO: 10343 - DNA, 523 bp, Homo sapiens
agagcacagggagtatttgggtcagtaaaactattctgcgtgatactataatggtggatacctgtcttatacatttgacaaaactcagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtaga

SEQ ID NO: 10344 - DNA, 332 bp, Homo sapiens
ttatattacagcaaggaaaccagagtctttgaatctgctaactgtgcagaaaagaksctgagacatggctgggcacggtggctcatgcctgtaatcccagcactttgggaggccaagacgggcagatcactggaggtcaggagttcgagaccagcctggccagcatggtgaaaccccgtctctactagraaaatacaaaaattagccaggtgtggtggtgggcacctgtagtcccagctactcgggatgctgaggcagaggttgcagtgagctgagattgtgccaccgsactccagcctgggtgacaagagcaaaactccatctcacaaaar

SEQ ID NO: 10345 - DNA, 370 bp, Homo sapiens
aatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaaga

SEQ ID NO: 10346 - DNA, 330 bp, Homo sapiens
agaaatcattggtcattggtgactgaacthcatccctagccactgtccactccctggaggtcagagagtgaggctgaaagttccaactctctcatcatcaatcatggcttagtctttctgatcagcagcctgtatccagaaactatttagggtcctcattaacataagctcaggtaaagtggtctcagaggacatgctgaaagcccatgaacttctcagggacctaaataaatgtttaaaacctgagaaaagtcttggctccaaaatgtaaaaactacagaatcatccaaattaataaatgtttaatcaaatgccaaaaaaaaaaaaaaw

SEQ ID NO: 10347 - DNA, 75 bp, Homo sapiens
atttttttccaaagccatggtgaaacatctctgtgctaatttcttttgttttgtttcctaatttttttttttttk

SEQ ID NO: 10348 - DNA, 557 bp, Homo sapiens
aaactaaatactaccagacatgtatacaaacaggaaaatgtaacttatacttgggaaaaaatggcagtcaatagaaactgatgctgaataaaagcaaatttagtaagaattttttacccaaagttttcaaatcaaccattgtaaatatgtccaaataattagaagaaaagtgattttaatgagttaatatataaggaatttcaacagaagaaaaatgaaattaaaataaatggaaattctacatgcaaaaaggataactatgtaaaattaactagaaatgctaacagattagacaaggcagaatacaaaaccaggaaacttgaagataaatcaataaaagtaaccttccctaaaaaatagcaaaaaagaaaaaaagactgccaacaacaacaacaacaaagccaccaccaacagcaagaagactcaggaacacatggaaaaatatcaagtggtccaatctaagtacacctggattcctagaacattgaaggactgaaagacgtaagcaaatgatataactgtgttcttactaaagcaaaagttgtaaggcagttcat

SEQ ID NO: 10349 - DNA, 428 bp, Homo sapiens
aaaaaaacggatggaaaacggtttaactgcgtgcttagaaggagagcagaggttttcctaatcagctagcactctcttccamaacctacttattagttcagcaaaattatggttattctttcaagcccagcttacatgtcactcctaggattataaattcgaatgtccccatgatatactattttacgttctttgctttttctagtgcatattacggtatgattagttatggcataaaaatcattttttccycatcaatttctgggamagttcctgtatagacaggatttccacatgtcacccaggctgatctcagactcctgacctggatcttcccacctcagccactgaacgtgctgggattacagttgaaggtctggaatggaaacycctattgkgatcttaagggctgtaasccagagaatctg

SEQ ID NO: 10350 - DNA, 445 bp, Homo sapiens
agtgacatcacagactaacccttgtaccttgggaccttgtatctgtctgcctacggaaggctccagagtccctgacgcatatttatatctccacttcactgaagtcacaaggaacaaacacgttcacaggaagcacctggcacacagtaactattattaatttctgcactggaggcatcaggaaagccttcaccctatagggggcccttttaagttaagaagttggagagcaagcctcggggaaagcaaagagataacttagtagaatggagcaaccatacgggaacagtgagagtccatggatctccctgggctaagatcatgtatggatttggcaatctggggtggaagccacatgtgctgttattaagtggaaatgtctcgtgaacatgtggaaagtgatgactggaacttcagatgaaagtcaaagctggagataggagat

SEQ ID NO: 10351 - DNA, 397 bp, Homo sapiens
aataaaacaggatgcagtaaagaggccagccaaaacccaccaagaccaagatggtgatgaaagtcacctctgatcatcctcactgctacttatttgctaattataatgcattagtatgctaaaaggcactcccaccagcatcatgacagtttacagatgccatgcgatgtccagaagttaccctatgtagtctaaaaaggggagggaccctcagttccaggaaatcactttcccagaaaactcatgaacaaccccccctggttttgcatatgatcaataagtaaccatgaatatactccgtccagcagcccatgccacacctctgcctatggagtaactactctcattcctttactttcttaataaactcctttgataaactttaaaaaaaaaaaar

SEQ ID NO: 10352 - DNA, 451 bp, Homo sapiens
cccgcttgggtccccttccacagtgtggaagctttgttctttcgctctttgcaataaatcttgctactgcccactctttgggtccacgctgcttttatgaggtgtaacactcaccgcgaagatctkaagcttcactccagagcccagcgaaaccatgagcccaccgggaggaacgaacaactccagacgcgctgccttaagagctgtaacactcaccgcaaaggtctgcagcttcactcctgagccagcgagaccacgaacccaccagaaggaagaaactccgaaaacatctgaacatcagaagggacagactccagacgcgccaccttaagagctgtaacactcaccgcgarggtccgcggcttcattcttgaagtcagtgagaccaagaacccaccaattccggacacactgggacctctggtcamcctatctctggatctgaagtact

SEQ ID NO: 10353 - DNA, 417 bp, Homo sapiens
taatggatgtttttatattttaatagaatcatttatttctatgtgttatgaaattcacttaatgataatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcat

SEQ ID NO: 10354 - DNA, 485 bp, Homo sapiens
tataagattatccacgttggccaagtaaactgtactgccaatagaattggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcastgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaagtgcacctgttctgta

SEQ ID NO: 10355 - DNA, 458 bp, Homo sapiens
atgatttgaaggtgttacatgatggggtaagaagggaaaaacattgaagacttgcaatggccactgaagacacagggtggcgaccattagggagatatgaacctgttgtgttattctttggaagaccttttagacatttttcaacactatctgccctttcagggcatctttcagttgcctgggccatttactgatatcttaatggagttgctgctaagctaagcatcataatagcttatataggcaccaccaactgagaaaccaccacaacaaaattgatcctgttttctctctcgcaattcccattatgatcttatttccttggacctctagaatttgcatatctctgcttcatgcataactacggcaaattattcttgtaaagtaatcagttaatatgggtaaagcatttagtacttctgtcatattcgacaccatgtatgtgtttttttcaataa

SEQ ID NO: 10356 - DNA, 293 bp, Homo sapiens
  misc_feature 293: n=a, g, c or t
attctggcggctgggcacagtggctcaagcctgtaatcccagcactttgggaggccgaggcgggcggatcacgaggtcaggagatccagaccatcctggttaacacggtgaaaccctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaan

SEQ ID NO: 10357 - DNA, 220 bp, Homo sapiens
aaaaggtgaaggaaagctgggatgaacacaagtgatggatgtagtacaaacacctgaaatgtaaacgtgaccctcatgttaagatagaagggaaggacactgatgactggctgtgcgtggattttggcagcatggtgattcatttgatgcttccagaaaccagagaaatctatgaattagagraattatggaccctacgttcttatgatgaccagttagc

SEQ ID NO: 10358 - DNA, 73 bp, Homo sapiens; identical to SEQ ID NO: 9590

SEQ ID NO: 10359 - DNA, 431 bp, Homo sapiens
gagctaactatctgggttgcaataaaatgtcttgatttttatccatggttggacagattgagttttctgataaccccagtccatttccctagaaatgcaggatttctccgcggacaaataatctctacagtggacctcaagacttcatactaggattctgaagatgattgagtcaatggatgagtgtaacgaacttttggaaacttcaaggcaattaaaggaaactgcaggaggaccagaaaagatcaagaccagggcacgagggctgatccaaacaacgggggccggcatttgtgatcttgggtagagccaccccagtgtgggtcaactccacagcattaggaaaaccagtttatcagaattaccttctcaagcaatagatctgttccttgtcacattcttagaactaataaagacttatctttattact

SEQ ID NO: 10360 - DNA, 447 bp, Homo sapiens
  misc_feature 114: n=a, g, c or t
attatgattgttacaggcaaagagtcattaatggatgctggaaccagtgggtgaaattgcagctgtttcaacaggacccctctgcaagactccttcaaccacatgacgccttcnmwrctgtctgcccagacaacttcattgtgtccaccagaagtcagtatgacgcaacttcccagatcacactgtgaaaactgccgaggagctgagactttgcctgtcctcccttcaagacagtgcacgccatagtgcctgctgggtcctcgcatctgcccctgcaatccatccctcctcctgaaccatggcccatcctctgtattatccttgtggcatgagcccacaccgctgggacgtgagatctgttgaatacatttatctttgtgtgtatagccccatttaggcgctgtggggcaggatctaaatgaggtatcttttggcatctcraartaa

SEQ ID NO: 10361 - DNA, 360 bp, Homo sapiens
acaactggcctcatgcttccataacttcactctgcctcccacttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaaggtagaagactcaaaagcgtaccatgaaaccgagaagtggcctcttcgagggtgagggaggctaatttataagatcaagatcactagtggaacgcaaccttgtatgtgcatttgaatcacctgggaaactttttgttaaataaaaccaatactgttgccccar

SEQ ID NO: 10362 - DNA, 460 bp, Homo sapiens
aagatggcggcgcaacagcgggactgcgggggtgctgcgcastggcggggccggcggggaggctgaccccctaggacgcttcacgtgtcccgtgtgcttagaggtgtacgagaagccggtacaggtgccctgcagacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcag

SEQ ID NO: 10363 - DNA, 401 bp, Homo sapiens
agtagttctctaggttggaatgacaagacactagttagtaattctaatccacaaaactaaatgcagtaaataaagagcacagcatctcatgctgkgttacagcatcaattgtgatgaatataggatactgagtccctcctagaaatgacttcaggaacttcaccccccaactccacaatctgggaatggcagacagattcagcaccaggagaacatcacataaaggacaagtgtgtatgtttaaaaatggcaagtttcggcctggcatggtggctcacgtctataatcccagcactttgggaggctgaggaaacctggattagaagcatgtgctgctctcagacctggcctacagagaagaactgacacagacttccttagatgtgttgtcttcstgtcac

SEQ ID NO: 10364 - DNA, 188 bp, Homo sapiens
acagcactttaggaagccaaagtggaggagcatctgaagccaggagttcttgagaccactgtcggcagcgtagtgagacctccatctctatatacaaagaatttttaataaattaaaaaaaaaaaaaaaaaaaaaaaaaaaaaaaaaaaaaaaaaaaaaaaaaaaaaaaaaaaaaaaaaaaaaaaaar

SEQ ID NO: 10365 - DNA, 496 bp, Homo sapiens
  misc_feature 240..243: n=a, g, c or t
aaacccgctggggtccccttccacactgtggaagctttgttcttttgctctttgcaataaatcttgctgctcactctttgggtctacactgcctttttgagctataacactcacagcaaaggtccacagcttcactcctgaagccagcgagaccatgaacctactgggaggaatgaacaactccagatgtgccgcctttatgagctgtaacactcaccgcgaaggtctgcaacttcactnnnnaaggcagtgagaccaggaaaccaccagaaggaagaaactccggacatgtccaaacatcagaaggcacaaactccggacacaccatctttaagaactgtaacactcgtgagggtccacggcttcattcttgaagtcagcgagaccaggaacccaccaattccagacacactagttttgttaggataaaggaccatactgtcatctgctgaaaatttgccataataaaatataaaaatccaaaaaaaaaaaaaaw

SEQ ID NO: 10366 - DNA, 496 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgttgcccagggtggtgtcaagctccag

SEQ ID NO: 10367 - DNA, 449 bp, Homo sapiens
ccacacttttgaaatttgataagtcaaaacgttttattttgacatttttaacattgtgaattattcgatatttgtaatctatgtatatgaaactctgccatgtttttcaactttgcctatgtgccactgtatataagacaggacagctatttggatcttcatcagcattgccttcagctgamaatttgggaacagttcacagtaaacctctcagtagtttgcaaactgaggtacctgcagaaaccatagctactcaccaaaatacaagattaggtgcatggtatcgtggaaattatttggtaaaaraacacacacacaaatctatgtgtactgtatttkaaggaatatctacaggtgcagctttgattttgaacagaattccaaataatttactgttgtacccaccagaatctagaaaatgtgaattaaagtacatgtttctgcaataa

SEQ ID NO: 10368 - DNA, 337 bp, Homo sapiens
actctgtccctggcttggcacaaacttgaagcccccttcccaaacggtatattctcttgtctctgctctgcttactgccacctctctaagaatctgtgttctttgaggtggggrragggatctcaaaatactcacagctattaatagcccagccagcytcaaacagtccattgaaagctggcatgagtgcctcaaagcagaaaagctttcaggcttttagagtggaacaatccccctacccaagatagggcgggactgatccaggacagggacctccatgttaccgcggttggttagcccctcacagggagctcctgtcaagctgagttgttgtcat

SEQ ID NO: 10369 - DNA, 448 bp, Homo sapiens
  misc_feature 111: n=a, g, c or t
atcctttgaccaacgtctccacttggcccatcccaactgccttccccgatccgttggtaaccaccaatatgctctcagctcattcacattgaacttctctcgattcgwhanrtacgaggaacwattctgtgaaaattattgagacatatttgggacccatcccttgggggaaagtcgtaagtggtaactatcaagtgattggagtcttggcggagtgccagaaacaactttgaacatgtagaggttgaggaacataacaaatttacatgckgtgaacagcccaagtgttaaaattgaaattctggaatggcaatcaaaacgcttaactcatttccacacccagatgttttaggaaaagttgaaaaaaactgaaatagacaaaggagattcttggttgttctgcctagtgctgttctgctttctctccactgttcattgtctttgaacc

SEQ ID NO: 10370 - DNA, 116 bp, Homo sapiens
agaggggatattgtatgtaactggtgacatttgaaagagacatattggacagaaatgacatacgtgaaagctaagatacaatatatttaattttctaagtaaaaaaaaaaaaaaak

SEQ ID NO: 10371 - DNA, 453 bp, Homo sapiens
gcgaagtcaaactgttgctgtttgctgatgatgtaatcatgtacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccasagattcaatgcaattcccaccaaaacaccaccatcattcttcacagaactagaaaaaacaaa

SEQ ID NO: 10372 - DNA, 450 bp, Homo sapiens
gacttggactttgaggaaaatgagaaaccattggccagtttggggtattgggagaaggagaggctgtcaacccatgccactatgctatctctaattctgccatccagaccgagcaaacgtacttaagaccattgtgtaagatcagaaaatcataagacagcattaaaaagtactatacaggaggagatggaacaagatggccaaatagaagcctccagcaatcatctccccgaaaggaattgaacaactatcaaaacaaaattgaacaactatctaaacaaaaaagtaccttcataaaaaacaaaaatcaggacaatatcagaacggcacatacaagtgtccccaagtcatatttggaataagatcacttgggaacacaagtcaaagaaggacacagtgttctgcctctcctgagtaagcagcaacaacgcaccatcttgaaatcagaga

SEQ ID NO: 10373 - DNA, 427 bp, Homo sapiens
aataatgggatggcaacattcattcattcatttatacctctaaccagtctttcctcacatactggttgagtactcaatacgtgccctgtgcttagctgagtactgttcaatggtgaacaaagaagacatggtcttaactaggagttcctatttcaacagagtagcccaaggaacttcaaccacttttgctacaggtgtattagttactgccaagagtctgtaagtgttcatgggcctcattaagctctgccttccttctgctttttggagcctggccttttgttggccttgaatgaagagtggggccccaaaagtaccactgtcagcactctccagaatcatctggctgtctggcaccatcaaagaattgcatttctgacccaagaagagcttatgggtggatgggggtgggatggaagctggggar

SEQ ID NO: 10374 - DNA, 323 bp, Homo sapiens
atattgttgcttggacacgcacacagctgctcctgctttagggccctcacactagctattttctctgccaaggctattctttcctgtcttactcaagtctttgttcaaatggagtccaacgaaccttgggcatctctacttaaaattgcaactgttctccctctctgtcccctaacattctgtactccgtatctcccttcccctctttcttctttttatcttttaaaattatattatatataattaaaaaaaaaaaaaaaaaaaaaaaaaaaaaaaaaaaaaaaaaaaaaaaaaaaaaaaaaaaaaaadaaaaaaaaaaaaar

SEQ ID NO: 10375 - DNA, 426 bp, Homo sapiens
tcagcttgcgtctccttccacgttgtaggagctttgtktatktgctctttgcaataaatcttgctgcttctcgctcattgggtctgtactgcctttatgagatgtaacactcaccacaaaggtctgcagcttcactcttgaggtcagcgagaccacgaactcactgggaggagtgaacaactctggactggaggaatgaacaactccagaggcactgccttaraagctgtaacactcaccgcaaaggtctgcaccttcactcctgaagccagcgagaccacgaacccaccagaaggragaaactctgaacatgtttgaacatgagaaggaacaaacgccggacacgtcacctttatagaactgtaacactcaccgccagggtccgcggcttcattcttgaagtcggtgagacaaagaacccaccaa

SEQ ID NO: 10376 - DNA, 489 bp, Homo sapiens
  misc_feature 441: n=a, g, c or t
aaaaaattatgtatgtggaatcataaagcaggtagtatttttggtctggcttcttccactaagcaaagttcttttgagattcatctatgttagcatcaatagttcattctactttttaaatatttattcatatatacaaagaaataaatttttaatttattttaaattaataaatttcatttatttaatgaaataaatttttaatttatttcattgtatatatgcgctataaattgtccattcacctgatgatggacactttggttgttcgaactttgggcaattacaaatgaaactgatatgaacatatatgtacaactctttctgtggacgtatgttttcattacttctgggtcttccttaatatatgtcagcagtggagtggtgtgcttaaggagagagagacttggaaaaatacagaccgagaacaaggccatgtgnagatagaggcagagactgaagttgtaccaccaaaggcaaagaatatcw

SEQ ID NO: 10377 - DNA, 327 bp, Homo sapiens
  misc_feature 113: n=a, g, c or t
tggaaattattggaagacaaagtgaaattccagttacatgactcatttgtgatattcaaagtcttagaaattatactgcatttattcttttcctccattcttctttttcatgnmcctcccctgagccatcccccataccccctacctatgttataaattagtaaacttttatagcagccaagggagtgaaaggggatgtcgtgaagatggcaagaagaacacagtttcaaatttctggaaaagagcctgtggtggagatctaaagatgtttagggaagagctcgactaaagaacaatgaaataaatggtccaaggggaagtcaaaaa

SEQ ID NO: 10378 - DNA, 444 bp, Homo sapiens
agttgtagtccagcgccggtcgsgggggtcggaggggcgggggcccccaggaatggggaaggccagtactagaagggacaagatctgggcaggacaagggaggatatttgcaaaaacttaaaacttccaggaagatggggggaggggaacctcctagagagatttttaaagtgaggtttttttaggttaatgccattttcttcctgtcttactcgcttatgacaaccccaatgaagttttaagctggactctggcagtaatgttaagtagagattttctcggccaacttcatattatttagggttctattcttccttcaccttgaacacagatgtgccattctctgcttggatgcacacagaatattcttgctcacagaataactcagttgaagccctgagcatgtaaaaggaggcctctcttagcagctgggaagagagagtg

SEQ ID NO: 10379 - DNA, 574 bp, Homo sapiens
ccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggraacccattctctttcattacaagagagcatcacttagcgtgcagtact

SEQ ID NO: 10380 - DNA, 271 bp, Homo sapiens
gagattatgcatctggagtgggaagaagcaacacatcaaaaatatgaccagaccatccacggcggctcatgcctgtaatcccagcacattgggaggctaaggtgggaggatacgtggagcccaggagttcaagactaccctgggggctatatggcgagacatctttattaaaaaatgataattaaagttcaaaaaaaaaaaaaaaaaaaaaaaaaaaaaaaaaaaaaaaaaaaaaaaaaaaaaaaaaaaaaaaaaaaaaaaaaaaaaaaaw

SEQ ID NO: 10381 - DNA, 539 bp, Homo sapiens
aaaaactagcttttctaatgaaaaggaagttaagagagtcagagaaggagatgtgaccatggaagcagagattacagtgatatagggccaggggtcaaggaatggaggcagcccctagaagctaaaataggcaaggaaacagtctctcctagagcttccagcagggcacagttctgccactttatcctcttttttaatttcgtaagatccattttagacttttgacctccagaactataagataataaattcatgttgttttggctgggcacggtggctcacgcctgtaatcccagcactttgggaggcagaggcgggtggatcacttgagatcaggagattgagaccagcctggccaacatggtgaaacccatgtctactaaaaatacaaaattagctgggtgtggtggggcacacctgtagtcctagctactcgggatgctgaagcaggagaattgcttgaacctgggaggcggacttgcagtgagccgagaccgtgccactgcactcacacctgggtgacagagcgagactcgtac

SEQ ID NO: 10382 - DNA, 431 bp, Homo sapiens
attagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaaaaaaaaaa

SEQ ID NO: 10383 - DNA, 147 bp, Homo sapiens
aactctgttttagagaagatctcaatgttttagtaaagtacaaacaccatcaaaaaaaaarraaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 10384 - DNA, 417 bp, Homo sapiens
tactatgtaatgatattattaatataaaatgtataaaataccataacactttgcagctcctgagaggtaagttttgtggtcaccccatctccatgtcccatccagtggctccacagggtaatactctgaagttttttcacagccagagaagacagctaacgaggccaacctcagccattggctgtgacgccttagttttcacaatgggaatttctctcctgctttaatatcagaaatagctgataatcatgcagtggttacctctccctcctgacattggctcctaggaaactcaaatctaaatctgcagccctggccaggcacagtggctcatgcctgtaatcccagcactttgggaggccaaggcgtgacactgcgcccggttggtaagtcaattttaaaaaaaaaaaaaaatgs

SEQ ID NO: 10385 - DNA, 478 bp, Homo sapiens
atagtccatgctcaagatcgaatggcatctctcagactggaagacctttctgaagtcagttccagacatccctggaaggctggataatttgggaaaaggctgactcaatgtaaggactctgcctgagaaattttatacattcctccaaagaggaagaaactaaaatcgagagaggttaataattgtgcccgaggctacacagctactaagcaaaccagatctatgctcaaagcccatgcaggactgtaaccacggtgcaagatcaatcctcctgcttggagaactgatccaactccacacctgtatcttcaggttggactcgcttcttcaacccatgtacatgtccagtattccttcatcattgacaaataccttcctttgactttactgattctctgactaccaccttttcaatgaagaaagacttccctggccaggtgscatccctcggtgcttccacggttactgacgcgtgtat

SEQ ID NO: 10386 - DNA, 583 bp, Homo sapiens
aacacctgtggggcattcctttttgaacagtaccccttcccttgatgtccgcaatatcacctttcttatagattagcatatatgtggccaaaggaacaactccatgtttttgtaaaggcctagagaacatatatccagtgcctttcctttttgcctttgtattcatcattttggcaaattactggaagatgacggttctggccaaaaggctggttttgtttttgggtcacattttcttgcttctctgcgttagaatcttggattagatgatggacatggtgaaggctgggctcaactcttgggctcaagtagtcctcctgcttcagcctcctgagtagctgggactacagacatgcatcaccatgaccggcttaaagatggaaaatatgaggtgcagagaagtgatggaaaaaagagaagatcaggatttcagtttttttctgcatttctcatcatcccatgaagtctcttgataacataagccaagttttcatataccttgacgtgtgtgatacttacgtggtgccmagaacaagatgcatactcaataaatattcatcactataggcaaaaaaaaaaaaaa

SEQ ID NO: 10387 - DNA, 450 bp, Homo sapiens
atataaagaaaattccagggtcgttttggattttgtataaatagctcccatgtttacatgtgaaaaaaaattatttatgaaagaaaaacagagctttcaatatcctattttggttacgtctccataaaaactctaggaaacagtgggatcatctgtgaaacagtggaatcaccccaagaacaaactgtcagacagaccgtcctgtcgtggcatgacttgaacataaccgtcccacgtggggacgcattccgcaccggttgctggaactgacgggggctgcagtgctgaatacctctgggacgcttgggaactgtgcccctgtttacagacggcaagcccttagtggtagggccctgagattctgagaaacataaggtctgctttatttaatttcctctcgtttaccaagagtcacaacctattttagtaaataaattcaggaaattggta

SEQ ID NO: 10388 - DNA, 418 bp, Homo sapiens
tgaagtaacttgtaaggaaaaataatataaagataccattggggcagtggctcacgcctgtaatctcagcactttgggaggctgaggtggaaggatcacttgaagccagagtttgagaccagcctgtgcaacacggcgagaccccgtctctacaaaaacttaaaaaattagctggctgtggtgttgctcacccgtagttccagctactcgggaagctgaggcagtaagatcacttgagcccaggaggccgatgctgcagtgaactgtgattgttccactgcagtccagcctgggtgacagagaaaagaaaaagaaaacattacataatttggctagagcataataatttgattttctggtttttgaaaatttgagttgcaataaaaggatatttcagtgtgcgaaaaaaaaaaaaaaw

SEQ ID NO: 10389 - DNA, 593 bp, Homo sapiens
ttacccatggcttttataaatgggttgttcaatttctcaatatttggaggtttcttaggtatctattattcatttctaatttagtttcaatgtggttagacaacagactctgtatgatttcagtttttaaaatttgagacatctttcatggtccagagtatggtttacccttaagacacatactacatgtccctgaaaaaaatacatattctgcaattgctaggtgggtggttaataggttgttcaggttatctttctcattactgattttatttagcttttctatcaggtaatgaaaaacagttctgccaggtgtggtggctcactcctgtaatcccagctctttgggaggctgaggtgggtagatcatgaggtcaggagttcgagaccagcctggccaacatggtgaaaccctgtctctactaaaaatacaaraattagccaggtttgatggtgcatgcctctaatcccagctactcgggaggctgagggaggagaatcgcttgaacctgggaggcagaagttgcagtgagctgagctcasrccattgcactccagcctgggcaacagagcaagactccgtctcaaaaaaw

SEQ ID NO: 10390 - DNA, 113 bp, Homo sapiens
  misc_feature 113: n=a, g, c or t
gtttgtttgttttagatggagtctccctctgtcacccaggcggaggttgcagtgagctgagattgggccactgcactccaccctgggcgacagagtgagactcggtctcagan

SEQ ID NO: 10391 - DNA, 354 bp, Homo sapiens
  misc_feature 195,280,300: n=a, g, c or t
acttacaatcctgagtcccctcatctcacaggcaggaatgaaggcttgaatgttaaataaccgaaatgtgacaccctgcctgggccaagggacgggtcttctccttaccttggaaggaggtgatgatgctgaaaaggtagaggacgacaagctggaaggtgccagaagcaaaggagaagaagatcaaggcccagngcaggccaaggaccaggctgaggcccagcagtgtcagcacatgtgaccacttttgggtgtgggggcgcacgcaaggatctgcacnaccatggtgctagcatggcnatgttgaacagaaacacccaggctgaagaggcccaggttggtgatgtagctgac

SEQ ID NO: 10392 - DNA, 395 bp, Homo sapiens
aatatttagaactttcttgaaatcatggtgtatttgatgtattcgcttgcctgaagcagggaagttgaagcttttcagacacagagcactttattttaataagggttttaagtgcctaaagtcagggagagaaaaggagacagtatttaaggaatttaagatcytgaaagtggaaaaggcctagaagagcccataactgctgagtckaggaaagamaatgaaacagagtgtctgcatgcagtttccttaaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaa

SEQ ID NO: 10393 - DNA, 586 bp, Homo sapiens
aaaaacttttcctcagcagtggcaggacccaggcgcgggtcctccttcctcctcccgccccctcgcggtcagacaacagaccccccatctgcaaactagggatcatcataatgccctaaagggctgagtagagttgacccagctgcttgtgttccaaaagagagttcagcagtggaatcccaggcatcttcataccgtcagtgaagccatccgaactttggcatgcagaagttccactttcgtaacgaagggaattatctcaggtccccaataatccttcaaggtctacctggagaaaatgttgagcattagaaagagcaaaagcttcggagtcgcccagctgcagatccaaatcccagctcccagctccactgttccattcattcgctcgctgggtatttgttgaacatctgctacataggaggcactgtactttgtgttgagtacatcattgatttggatgaaaatccttgctgtcacagagctcacatcctaatggaacattttatttgctacttgacctcagaagactttatgccgaggagtcctggaatatctccttttctccatcttgggacatctgtgg

SEQ ID NO: 10394 - DNA, 483 bp, Homo sapiens
  misc_feature 154..155: n=a, g, c or t
tacttctctctgaggacaaacwgcctggmaaaccagcagggccaggcaaatgaggccaattggcagcaagggctggratggagatgtcagaratttaraggctctcagggttggaagggggacctcaaatttcatctaggtcaatgctgtgtcnncdkacctgagtcctgtctataatatccctcccaatagtgggctaacctcagcttgaatgctcccgatgatggagcactcattacctcctgggaccacgaactcatcaatgggtggtgctgactgtgcaaaaaccctccttcattttgagcctaaatctgttttccaacatgaagagagaagacccccgcagtgggttcatccttcttctggctccagccctcagtgctgcgaaggagccgcaagtcactcttcatgaggaaacatgcccggtgtcttgggtgggggcagaggcaccactgatccacaaagatgtggtgtgattttttc

SEQ ID NO: 10395 - DNA, 541 bp, Homo sapiens
aaactgaatgcaaaggctatacaaatgccaagaatgtactatgtttactcagcttgttctcctaactcattagctgaagaaaggatgggagagggagaggaaggagctgatctggtaacaaagagcctctgggcatagtgggggcagccaaggctttagtaagaacctgaggagagatttctaaacataaaagtggctgagaatgtgccagagacagactgctttattcaaaaatttatctaaagttgactctgctccaagggaagatgcaggaaactgtaactcctcctgaatagcatgattgctgttctaaatcccctaaatccagctagcgctattgtatgaatgaactgtgctacaggggctgcatcagaacaaagctgcctgccaaagacaggatttttgtttttgagaaaaagtgtactgtgggagactcctattcattcttgaaaaccctgaatagtctttttcttcaaggaagacttccttgatatttactttcactgscccttcactccccatcagatctatttcbgtttad

SEQ ID NO: 10396 - DNA, 510 bp, Homo sapiens
  misc_feature 274: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcntggctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgttgcccagggtggtgtcaagctccaggtctcaagtgatcc

SEQ ID NO: 10397 - DNA, 535 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcaccaccaggcctgccttacaagagctcctgaaggaagcactaa

SEQ ID NO: 10398 - DNA, 606 bp, Homo sapiens
  misc_feature 274: n=a, g, c or t
aagaatggttctaccagtttgcacaggaagacgttacttaaggctgctttccaaagcagtgaaaaaataagtcagaacagctgtgctgatggctgggactctctcaggacagcttggaaggcccgacctggcagctctctgggcccaccggagctctcctgccttgtcttgtacctgcctctctgtgctccagccacactgccatctctccgtttctcaaatgctacgtaaagccgcattctcttcccacagatagaaaatgctgtgctcgccnttgaaaagcctctctctccaatgaattcccactcattcctcaattttcagttgaagcatcattcattcctttgggaaaccttttctagcccctaacaccctgcattggtcctaacataccttggcatgactgctgtagctctgtatctgcgtgggtactgacggatgtgactccaggagggagggtgtgcagcctgtggtcaccacggtatccccagcacctgtctctctgcttgcctattaacttcctaaattagtgcattttcccctgtcatttaaaaaaaaaactttaattttttcatttgtatatatcgacagagcacaagtacagat

SEQ ID NO: 10399 - DNA, 486 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagat

SEQ ID NO: 10400 - DNA, 416 bp, Homo sapiens
ttggagtcagtttggagggtggctgtcacagttttgtaaaccagattaccgggcccacccctagtgtttttgagttgccggagttgtgagaatttgcatttggaacaagttctcaagtgatactgacactgttggtcctggggccacgctttgagaaccattctttcagctttttggaatcttaagaactttagaagtctagtccacaggctccgtactgatggaggtaccagcaaggtgatatgcatttggctcagtagaggacacaggaatcttgaataactactaatcatgtacttattgcaatctttaatcccaagtgggataattatttttatttgtatttagttaaaacaatgtaatgtattactaaaaatataacatttttgtatatttccaaaaaaaaaaaaaaatgs

SEQ ID NO: 10401 - DNA, 503 bp, Homo sapiens
acgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttrrgctttgaaaacacctgttattaatgaaatactcttttattttggatattatgattgc

SEQ ID NO: 10402 - DNA, 481 bp, Homo sapiens
tctaaaaattaagtgattttggaattggcattccatgtgactttaaaagataaatgataaagtaaatgttttattcagctctctctctccctccccacccaccttcttccctccattcttctgtttttaatggggatgtttaaaatccaatctcacattaattttttcttaagtgtaaataatgggaaaacttcacttcgagaggggactcctcagtagacctccataatttcctggcttttactgccagttagtcatcaggaatagccacggctaagagagtaccaactgggcaagccagtgaattataccagtgcatctcagatttactgatttgtttaacttttgttttttgttcttttttttttycagagatagaatctcactatgttgaccaggctggtcttgaactcttggcacccaagsgatccttttgcctggaatcccaaagtgtcagatttactgaagaatatttcattgd

SEQ ID NO: 10403 - DNA, 485 bp, Homo sapiens
aatgtgttagggctctccagagaaacaaaaccaacaggagagagagagacagaaatagagagagaaagggagagatttattatgaagaactaggtcatgtcattacaggggctgggaagttccacagtccaccatcggccagctagagacccaggattacctgttgtgtagctccagtctgagctagaggcctgagaaccggcagaattgatggtgtaagtcagtccaagtacaggagaagaccgatgtcctggcttgacagcagtcaggcagagagaacaatgctcccttaccccaccttttgtcctattcaggcctcagtggcttcgaggaggcccacccactctggggagggacaactgccttgctcagtctacagattcacgtgttaatctcatccagaaagaccctcacagacacacctagaataacgtttgacctaacatctgggcacctaatggctcagtcaagttgacacttaaaat

SEQ ID NO: 10404 - DNA, 293 bp, Homo sapiens
attctggcggctgggcacagtggctcaagcctgtaatcccagcactttgggaggccgaggcgggcggatcacgaggtcaggagatccagaccatcctggttaacacggtgaaaccctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaar

SEQ ID NO: 10405 - DNA, 423 bp, Homo sapiens
tcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagtyctattactcaatttgtttttctcagcattgaaatgacttaatagaacccttgtgtcc

SEQ ID NO: 10406 - DNA, 427 bp, Homo sapiens
gaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggasttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaatt

SEQ ID NO: 10407 - DNA, 478 bp, Homo sapiens
aagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagrtaaatatttttatcaaaaattttataaacacagcctttctttagcattgatttaatttcagaacatcttcatattgattattagccataaagtttctaacatgr

SEQ ID NO: 10408 - DNA, 536 bp, Homo sapiens
ttagaaaatttaaataacattctttttgcaaaaaagtccaataatttaacagttgaagaaaaacttactacctctttaaatatttgagaaacatttttcaaagttatcagctgtagtccaagctaaatatcttttgtaatctgcaacattttccttactgtttttgggcagtgataaatgctgttctcgaaatagactttattcttacctaggcttcagcaacagttttatagagcagttactgtaatacaatataaaggaaatatgctgttgaaattttaaaggtatgcccagttcctaacttttaaacgaattaccgttcttcctcttggctgatcttggcagagatgacaaaaaaaaccccaaaacaacccatgcatatataatgtgtgtatacacatatacataagtatacatatactcccacattataacttagaatatttagttttttacctgttactaggtttgagttacatggttgagttgcaaattatttacatgctttgtttaaattcttcatcacctagcaactg

SEQ ID NO: 10409 - DNA, 473 bp, Homo sapiens
  misc_feature 414: n=a, g, c or t
acaagcgaggagtgtgtcagcagttctgcctgccctcccacaccgatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaactcctgaccttgtgatccgcccacctcagcctccgaaagtgctgggattacaggcgtgacmaccacgtccaactgccttattttgttctgaataaatttacagtattgggcagcaattctggattctagacttgagaccacagaatcaaccatttcatgaggttgtactgtaattatacactggaatattcaggwngtcatctttgatttttcattcaagtaaatatagccataagaaaatatctgctatacagr

SEQ ID NO: 10410 - DNA, 481 bp, Homo sapiens
  misc_feature 169: n=a, g, c or t
ttcccacatatttcctggcccttgtcaacacacctcctgtggccgacaggagatgccagcagcttgctcacccaggacagagaaggagagacagacagagcaatccttaagatgcaggatgatgcaaaggctaaaagccacagtcagaatccaagtcaggaactcagandtgatcttttggtccatcaccaccagagactcttctagaacaggccttctaagactgaattacatcaccagctttcctgggtctccagcttgcagatggcacactgtgggacttcttagcctgcagaatcattgaagcacccattgattgccccttactctagggatttacagctttgtgcttgtcgtggccactgctcccaaagtgactataatccggagattcccacgacccttcagagcaggcaagacaccagcaccagaaactctgaaaacctaaaagtcaagaacaatgcttttgcattttcctgtc

SEQ ID NO: 10411 - DNA, 468 bp, Homo sapiens
taggatcatattcattcgaagcaaagtccgttacaaaggttcaagatttccatctcaaaacactacgctcttttatgggaactgtgtgaactgaagtggaaagcatctaccatgctgaggctaaaagaaaagatgaatcattttagtttgcagatggatcgtaaatataattgttggtatcagctttagctcaaaaccaatattaggtgttttaatttccttttaaggtttggaagacagccctaatctcaggttggggagctcatgttagtagcagtgacttaaggctaagtgtagaagataatttaagatacattttctttatatattagccaacaaattatatttattggttggcttgcttttccgttctgattttgagagtgcccagtttggtttagttgaccaatgaatgtcaaagctacttagttgagagaatttccttgttcataaatgtagagcagtgat

SEQ ID NO: 10412 - DNA, 445 bp, Homo sapiens
  misc_feature 321,323: n=a, g, c or t
attaatgaatgttcaaatatgtttaccggttttttattggatggcttattttcttatcattgaattttgtgatgtttctaaaatatatatacatattttgaatttttggccaggcgtggtggctcacgcctgtwatcccagcactttgggaggccaaggcgggcggatcatgaggtcaggagatcgagaccatcctggctaatgtggtaaaaccccgtctctactaaaaatacaaaaaatatatatatatattagctgggcgttgaattttttatcagataaatcatctacaaatattttcttctactctgtagctgcttntntcactctattcacaatgttttcgaagactagaatttttaaacgtttgattatcttttgattatctgttgattctactaaagataattaaaagtagtatactaaggtatacaagtaaaaaaam

SEQ ID NO: 10413 - DNA, 505 bp, Homo sapiens
agtgcttttatgtgctgagcctttcccttcaacctggactgaaagaggatggcaatctcgctgaagctgtttctttttcttcacaacatataggaaagtgttgcccctttttggagtggtgcataggacgatgactatagattttcatctgtaactcctaaaaacttactcagaaagtaacaacctccaccaacactacttgaatcagtactgaacgaatgtcaggtccttgggaaattctccaatcctgtctcctgtcctggccgggtgtgctcctggtgcaccattcgactaagtcaatttgaactatttgggagacctttgtacctacgtttccttctgcttggaagatcctttctgttttgtcagctcttacttccatgttgtggaaaactgatctgacctcctagtcctgaatcaggggccataaagaaaattgatgaggacaactggcctcccaatatgtggattcagtttccatatgtcaatttaccaaactcccact

SEQ ID NO: 10414 - DNA, 510 bp, Homo sapiens
agatttccccaaggagacgattcagaatagaatgtgatgtggtgcatgctttccttccttccccttctcccttgtttataggcagaggtcactacagagtcaaccatcgtggtttctgacaagccttttccagctctgcagtccagagatcctgaacacgatcatcttctctatgtaatttcccattcccttaaaattcccttggattcactttgcggagggcagagaggtgtgcttgatatggtgttttcttcatctgaggccaaaagatggagcatcagggtagaaggagaaattcttagaggaagcaggaaagaggagtccgagttgaccactggatgtttttttctcctaataatggtgcccaaacttctttttcaccaaggctgaatggccatccgcaaaatctccaacctaagagacggtttcatctacttccaggcaaaactgacaatgtgaaaataccggagtcactgagcaaattcactccagcctgtgctgactgagact

SEQ ID NO: 10415 - DNA, 461 bp, Homo sapiens
  misc_feature 395: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatscctggctaattttttgtactttcagtggagatggggttttgccatgttggccaggctgttctcgaactcctgagctcgggtgatccaactgtctcggcctcccaaggtgctgggattacaggncstgagccactgtgcctagcctgagccaccacgccggcctaatttttaaattttttgtagagacag

SEQ ID NO: 10416 - DNA, 358 bp, Homo sapiens
acttggacttggaatcctggaaggctggccagtaggctggagcagacaagatgagcagaaagtggcctcgtgtcttgctgggacctgagcccttgatgctgtccacacaggtgaccctcaggagtgcagagcagggccaagaagagtggtgtgtcaagaaggtttcaggcacagctgagcagcagtaacatcgacacagagacctgaagactgacaacagactctggcagtaagatacagcaggctctgaaagaaactgaagtattttactatcaaacagatttctttgacatattttgaaatagctctgcaaagctgtctcttatgaggaaaatctacattctgtgaagaaaaaaar

SEQ ID NO: 10417 - DNA, 547 bp, Homo sapiens
  misc_feature 484..486,488: n=a, g, c or t
tagtctttgtggtcaatagttattggtaatactactagtaatatggtacatggctataagatgcttagcttagtgtcagttattattctaagagtttaaatctaaaaagcttccctcttgtgctctgaaaaatgcttactcaattgctttgaaaaatgtttatccttttccacagaaattcaagatgtaaatacaacaaagccttgtcatattagctatcttttttcaaattagacagaaaaaaattcgtgacactatttaatttcagtgctagtgagcagatgttttagggtgcaagagccatgttgctatttcagttatgatgtaattaagcaacaactgtctggcctgggtctacttcggtcccctttgcaggtcagttgcttggtgtttctttgtaaaccagaaaaaactgagcaaaacattcattcatgtagctgtagcaccaatttgctggcatcaatattatggtaaggaaatgrcnnnwnttgaacattagcctaataagctctttgctactgctatggtaagatatcaaatgaaaaac

SEQ ID NO: 10418 - DNA, 522 bp, Homo sapiens
attttatttactctacaagcacccttaaggtctcattgtcctgaggtcgtcaaaataaccgttgctttggcatcatggctgtgcacacctaacttggaattacttaattcattatgatgcttccaaagaaaatccttttggttgatgaaagcaggagataaagataataatggcaaccatcgactgaagtactaggcactgaatgaagtgcctcatatgaactatccacttagctcctgcagtaaacccttaatggcgctattagtatccccagtttagggatagagaagctaacgctcagagagagaaagtgatttgcccaaagccacagtgttagcaggtgacacaaccaagattcagacccagtttcttcgtctaccctaacagtattgccaaagagagattccaaagttaccgcctggccactgggtaaacctccgcagcagagagacctactttatgtttcattttcaagctcctatggagccagcagagagagctgacaaggaggaatactgcgag

SEQ ID NO: 10419 - DNA, 73 bp, Homo sapiens
atttccaaagccatggtgaaacatctctgtgctaatttcttttgttttgtttcctaatttttttttttttggc

SEQ ID NO: 10420 - DNA, 77 bp, Homo sapiens
atttccaaagccatggtgaaacatctctgtgctaatttctttwgttttgtttcctaatttttttttttttggcaggk

SEQ ID NO: 10421 - DNA, 425 bp, Homo sapiens
  misc_feature 310,419: n=a, g, c or t
tacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgsagtgttgcccaggcgtctcgaactcctggcatcangcgatcctcctgccttagcctcccagagtactgggattacaggctcttyctttttaaacataaaagttttaaattggtatwamctctgtactctgccctagatkgtttnagcttc

SEQ ID NO: 10422 - DNA, 535 bp, Homo sapiens; identical to SEQ ID NO: 10397

SEQ ID NO: 10423 - DNA, 357 bp, Homo sapiens
aggtttatgacctggcaggtgcagtgagggcgggggtgggaggttgcgcgcgggaagsgagcgcgcgtgcggccgggggattggtaaggctgaagctcagccccagtggccgaagaggcagaggggcaggcagggcaccggctgggctcaggcktcttccctccttcttcgcggtasacgccgcctcgctacacctgtggagggcccacactctgcttccacattgtcttcagaaatagatcctaccggctgggcgaggtggctcacgcctgtaatcctagcactttkgggaggctgaggcgggtggatcacctgaggtcaggagttcgagacccgccagccaagatggcgaaaccs

SEQ ID NO: 10424 - DNA, 72 bp, Homo sapiens
attttccaaagccatggtgaaacatctctgtgctaatttcttttgttttgtttcctaatttttttttttttb

SEQ ID NO: 10425 - DNA, 441 bp, Homo sapiens
attcctgcttctccccggcctacgggcgggcccgcgaagtatgggacgctccgtgattggccctagctaggcgactggaaaggaccaatcttccgatcgcctcaccgcagtggcccagtctcagatgccgattggcttgcgagagtcgaaggggtgacactcgtttcgtgacagatctggggaacttgcagcagagtcacagtcgcttaaaatttcactgcaaattacttcatcagccatctcagcttcagtgatctgggataactaaagttgagcaccgaagacaagctctaaatgattgaataccctggaagaaaggtcttttatactaatcttaacctaatcaagatttgttaatcttattggtacccaatttaatcaagccaacaaaaggaaatgtgatttttaaaaatggctttgaatcctaaaaaaaaaaaaaaa

SEQ ID NO: 10426 - DNA, 544 bp, Homo sapiens
acacgtttccaagggcatgggccagccactggacaggccctcttcgggtgagcgatggcaaaatatagggtccctcctaagaacagtcattaggagagcagcagctgtgagggctgattagcctaraagggaacatwrgatgtgtcagccaatcctctagcacaacagaattaacataaaacaagagaagcagaggaacagactgtctcattgaaccaccatgacagcagaggtcaatatggactatgaccagttcttcttaacccataactaaagggaagcagatatattgacctgagagagcttgactccaaattatacaccctcctctgagatcctcagacactaacaagaggaacattctgaacatctggaatgagcaggaccacagttaatttgctcaaattgggagcaagtaagggccatgtgttgcaattgcttgatgggagatgtgtctctgaagtcttgttaaatttacagaccttcttcggtgacgaccgccttccctgtggccctagatgagcacaagggcagtctgtgtgtg

SEQ ID NO: 10427 - DNA, 198 bp, Homo sapiens
taatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcggtcaaaaaaaaaaaaaaaaa

SEQ ID NO: 10428 - DNA, 517 bp, Homo sapiens
aacaacgtactgtagttcccttccgtgccgtggtaggtttgttgttttgctttttacaatgaatcttgttgttgctcagtttccattcgtatttccttcatgaactgtaacactcacagggaaagtcagcagcttcacttctagagccagcaagactgtgaacccactgggagggatgaacaattctgccacctttatgaactgtaacactcgttgcaaaggtttgcagcctcacttctgaggcctgcaagaccacaaacccagtagaaggtaggaacaactccagacatgctgcatttgagagctgtaacactcaatgctgaaggtctgcagtttcattcctgaagtcagtgagaccacgaacccaccagaaggaagaaactctggacacatctgaacagccgaagaacaaactctaggcacaccatgtttaagaactgtgacaccaccagggtgtgcagcttcattcttgaggtcaacataaaccaagaatccaccaattccagatacagttcac

SEQ ID NO: 10429 - DNA, 80 bp, Homo sapiens
aacagaatataggacgttatataaacataaatttatagtttataaatactttgaagcaaaaactcaagtaactaggactc

SEQ ID NO: 10430 - DNA, 550 bp, Homo sapiens
atgattttcaccatgtttcagaaatctggatgctaagaaggttatgaaaaaactatgcgtataggaaaatggcaacaaccaaaagacttaaggaatgtaaggagattccccaatccagagtgcttgggaataagagtttctggatggccaagtttacccagatacctaaagtaaaataagcaagaaaagctaaagcagacatttttgtttggtgtttcatcagagactctctcaggaatggggccacctcacagagtcacacacacaacccttctttcagaggttggaatgcagaaaacccagcagcaccagctctctcttcagacaaggaagaagatagagacaaacagggagaacaacatgtaatggcagaggcagagattgcatcgatgcagccgcaagctaataaatgccgaagactgacagccaccaccaggagcaaggaagaggaagtgtactgaagatgcaagtttttttcatctggagttctgcctgaccaagaattaagcctataaatctatcttgccattcaagcagagagcactggaca

SEQ ID NO: 10431 - DNA, 317 bp, Homo sapiens
agaaataactgggggcatggagaatgcggtggctgtaaagggccgctgaggcggtggaggcctggcagagagcgtccccgcggtcgcggcttctggcttctctgtggagcttggttcttccgtggtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaaaaaaaaaaaas

SEQ ID NO: 10432 - DNA, 587 bp, Homo sapiens
gaacattcttgaacttcagtttcattcctacaatgagtgctgggataataacctgaagatctttccattctctgtttttaatgcaacataactttttgaaagaatgtgtaaaataggttggattttctattttactaaagccttacagaagcacctctgagactcaatcagtgaaacaaacccaaggccacgctgtaagtgtgctttacagcttacttgaacttgctattcttattagaaccttgatttattagataatagcgaaggcatcctatatgttgcttatacttgtggtatctcctccaggtacagaaaaaccaaacaaaccctacattgtttaaaaatagcccattttcattttgggtcttcataccaggcatgatactgaaaaatatttttttgttttctttttgttgctattattttttagtaagaaaagcagattctttttataaaagctaattaaatcctaaatcttgtatatttttaactggacatagagtggaccaaaggaaataaaaatgtgttcttatatgtttgttttatttctaataaagctctttaatcaaaaaaaaaaaaaatgcgaa

SEQ ID NO: 10433 - DNA, 435 bp, Homo sapiens
cgttaattagagtcttatattcaagtctccttctcagagtgatttattggcttaggtctggataatttaatatggtgtccctaaaacttttttagaaattatggggaatgacaaagggtatgagggggcaagagactttgtactaagaagtgacttagactgagtgtggtggcacacgcctgtaatcccaacactttgggaggccgaggtgggtggatcacaaggtcaggagttcgagaccagcctggccaacatggtgaaatcccgtctctgttaaaaatacaagaaattagctgggcatggtgtcaggtgcctgtaatcccagctactcaggaggctgaggcaggagaatcacttgaacccaggaggcggaggttgcagtgagccgaggccatgcactgccctccagcctgggcaacaacagtgagactccac

SEQ ID NO: 10434 - DNA, 237 bp, Homo sapiens
aatctgttgtttagctcgtggttgtgatgaaggatattggtatcccaaactccagccctgtggaaaactacttgcatttttatgacctccatgttcctcctcttcatcagatgaatctgcagcataagccaccaagccaaatcccttctctgtagttttcatcttcttggctggataatctagaatagagaaaaaacaaccccaaccccatccccgccaagggaaaaaaaaaaaaaw

SEQ ID NO: 10435 - DNA, 333 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcg

SEQ ID NO: 10436 - DNA, 469 bp, Homo sapiens
aatactaataacgccgagagcccattccagcactctgccaggaggtccttctcgttaaagtaataacagcagaaatgggacccttaaagcctgctgatttttgactaagtccttgtcaagggtaatctggggcatgttaaataagccatggctttcctgaaagacgaaaatgatgtgatatcgaaagaatgacgtacagtagagacgggagttcaccatgctggccaggctggtctcgaattcccgacctcgtgatcctcctgccttggcctcccaaaatgctgagattacaggagtgagccactacacctggctctgatgtactaaaatttctatgccaatatggaatatgtatctttaatgcaacgcacagtgctttgctaacagtagttgcccaatagatgttgtttcttttaaagttaactaacaaataaagtccttctaaataatcaacaaaaaaaaaaaaaaw

SEQ ID NO: 10437 - DNA, 306 bp, Homo sapiens
ctatttttcctgatactgtgcctttgccattttgataatgctattttgattgagtgaattttatttcctttgtattcccatagtgaacaatatattaaggtagatgccctttatctgggtactcctggtagattagctgttacacctcccttcccttttttacagtgaacctgtattcagttattgtcactctgagaactctccaataacaatttcttttccacagttaacaacacagctgttacacctcccttcctttttttcacagtgaacctgtattcagctattctcactctgagaactctc

SEQ ID NO: 10438 - DNA, 500 bp, Homo sapiens
atttcctaataagcacgtgcgcaaacatctcagaaacaggattttcatgtattcaaacttgaaataatgttgtgtgctatgatagcaaacactattattatataatcagaactgaaagagttgttatcttcaagacatcttcaaatcagccttccttcaatcctaaggaacttcatttccgtaaagttctttacttcaggatgaagttggctgggagcggtggctcacttctgtaatcccagcactttggggccaaagtgggaagatcatgaggtcaggagatcgagaccatcctggctaacacggcaaaaccccgtctctactaaaaattaaaaaaaattagccaggcgtggtggcgggcgcctgtagtcccagctactcgggaggctgaggcagaagaatggcgtgaacccaggaggtggagcttgcagtgagccaagatcgcgccactgcactccagcctgggtgacagagcaagactccgtctcaaaaaaaaaaaa

SEQ ID NO: 10439 - DNA, 486 bp, Homo sapiens
  misc_feature 381..384,405..406,408,412: n=a, g, c or t
aagtttactaataatggccccaaatcataagaatagtgaagctagcaattcagatacggcaaagagaagccataagcactacccttaagtaaaaaggtgaaagtttttgacttcttatggaaagaaaaaaaaaacttataccgaggttactaagatctacagtacgaacaaatcttctatccatgaaaatgtaaacaaggaaaaagaaattcctgatcgtctgctgtcttgcctcaaactgcaaaagttgcgaccacagttttaaatgcttagttaaggtggcaacggtattacatttgtgggtgtaagaaacgagcagacacatgttccaattgacagcaattgggtttggtactacccacagtttcgggatccactgrnnnntcttggaatgtatccccwdmnndntaangtgggactactgtatatgcaaggatacacttccccattaacagcaaccatgatgcattatgccagcataatcgr

SEQ ID NO: 10440 - DNA, 360 bp, Homo sapiens
cattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctctttttttttcctaaaaaam

SEQ ID NO: 10441 - DNA, 452 bp, Homo sapiens
attattctgtaagattgggcttagactcaccagtcacactgtctgtctgctgtagtctactgtattctgtagtctactgtattctgtgcactgtttaaactttctggcagctgcttacatcttttggatctagaagtaaaaaacaagatgatattcactgaattgaactatttacatatatgaaactacctcttaaagattagttttcctttttatatgcaagttttgtgaacttacagtattacattctttttcattcatgtatttaatatgtatgctttcttcagggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaaga

SEQ ID NO: 10442 - DNA, 75 bp, Homo sapiens; identical to SEQ ID NO: 10347

SEQ ID NO: 10443 - DNA, 466 bp, Homo sapiens
agaatgtggtcaacatgcagaagtagagagcagctggagagacggagaaagagaaagcatactggtgtaatatgagatgatctatcctgttaaccttaaggatgtctatcctggttccacgctgtttacctgtcaaagagaatgaatagagcatccttagcgcttgctatttgcccagaaaaatatgttttcagtggtcatggaaaaaaaaaattactttgagggccttaatgtgattgaaaacaacacagactggcaggtcatccctcctccttactggactatttctaactgggctcattacagagcctctaaacagtgagagtgaaaagcctcgaacacaaagctcgttaaggaattcattttggtcttcccctcactcctcaccacaatgctctagtgattatattcagtccaattatgtatgttctacatgtaattaaaatgtacaagatgatcagattgc

SEQ ID NO: 10444 - DNA, 463 bp, Homo sapiens
  misc_feature 241: n=a, g, c or t
aagaggatttcctgtcgcgtctgtttgcttattgcttctcagataagttttcatttgaaacagtggtctgaggctctaaatcatttgaaagtcttctctcccagtgttcagacaattcccctggttctaacatttggtgattctgcaagaagccttcatgctagggcaaacaactctcccactttgcccagcgccgtggggtttctggacatgggacttctagtgctgaaagtcccaggwnaaccaggccaattgttcatcctctcacattctcacttgagtagcttatattttgagccatgcttgtttagagaagggaaagacaccatttagaaagccccttcaatgcctaagtgtcaagaaaaatgggatccatcacctagtcgaatagtaacactggatgagaagggagggaagctggtgcccatatgttttgaaaaagcagcatttactttaactttga

SEQ ID NO: 10445 - DNA, 474 bp, Homo sapiens
gcaggaatgaaggagagcagagaggagaggcttggaggttccttgaatttctacgtgaattttaggatcagcttgtccatttctgcaaagaagccagctgagcttttgattggaattgcattgaatctgtagatcaatttggagagcatttgcatcttaacagtattaagtcttctcatccatgaacatattatatttttccatgtatttagatctttaattgccttcaacaatgttttgtagtttttagaatataaatcttgcacttcttttgttaaatgtattccaaagtatttcttttgacactattgtaagtgaaattgttttcttagtttcattttcagattgttcactatatgatatcacttttgtggcatagcatgtgattgctcatgaatggtgctgatacactgatttttaatgacttgtttagatagacaaaaacttcaaaataagatctgccttacgcacaaa

SEQ ID NO: 10446 - DNA, 431 bp, Homo sapiens
tcttagataccccagagatgcccttggaaatcacccgtagctttatccagaaagagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggscccccttggaccagcccttggaactggsccctctgaccactattactttcccttaaagcaaaacaagataataatcttttgctgcttaatttgcacatc

SEQ ID NO: 10447 - DNA, 483 bp, Homo sapiens
agatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgta

SEQ ID NO: 10448 - DNA, 505 bp, Homo sapiens
taatttgaaattcatctttcttagcaataaccttgagataaccaaagttcttaatttgtccccaagcaggtcatgttctattttcattcatggataatacttaatgtattttaatttgtttaatgaaatttttaattgaatctatgaaaatgtctgagttttatgaagcaaagaggggaataagtatgagtacatgactgatgggcagatttagacaaatggtcacagaaagtgggaaatggaagagaaaacaacaaatggtacagagaagggctcagagggttaggtggagaaactgagtaggatcagatgaccagagattcagaggaaagagttttttaaagtggatgtcgatcagtatcaaaagctggctgcagaaactaccagtagacttggcatttaagaggtgattagtgacatttttggtgatgtttcaagatagtgaaggcagaaaccagtgtactgatttctaaggagtgagcacataaagcaggtgagcattaat

SEQ ID NO: 10449 - DNA, 559 bp, Homo sapiens
actgactgaatgaacccataactcaatggccacaggctggacagggagagggccaaaggggtctgaagctgctgggtgaatgagaacatcctttgactttgatgcaaaagtcaccggcacttcccaggttacgtctgcaaggagtgcattttccactaaggagggcagctggcaaagcacagccttgtccttttgggtttaacgtccttgattttccctcttagcctcctgtggcaccaccaggcctccagggacaccaccgccctctaaagtgctgtcgcaatgagagaaactctctaggtctgttccagagaacacggctgaggccactggagcttgccccctctgtgadkvgctagtgagatatctgactggaaaagtggtccctgtrmgtgtgattctggtgcatgcttcaaaaggctgggacctcaaaagcagcgatgactcgatagcccagggaaggaagaactcactgtacaaaacaagactgagcatggaaaacaagaggactgcacagtcaaccaccaaagtgatttgaaatcaggtgcgttttgtttcy

SEQ ID NO: 10450 - DNA, 226 bp, Homo sapiens
atccacactgctgagtgacgttggtatcacctaaactaataagccctgtctccatgtctccctgccccaggagttcccttttctctttagctttctccatagtggcccctgaaagatccccagctgtgaaggattttccccatcctgaaaccctgtccaaggcccaccaataaagtttgttgtaattcaaaaaaaaaaaaaaaaaaaaaaaaaaaaaaaaaaaaar

SEQ ID NO: 10451 - DNA, 515 bp, Homo sapiens
caaacctgattattcctcttagatactgggaacagaatttcacagtcatcagagaatataccttttgtattttcgtattaaatatgtactcctattacttaacaattgtagtttaactcgttttttaggtaaaattctaatttttctcttctgttaaaaatttccagttccaacacgaagataataaagaatattaattttatccttattaacttgaaggaagtaatatttatttttgtatttctgtacttaagtatatcacaaatacagttttctgtagttggagaattaatataaagtaacatagtattcaataagaagggatttttctttattaaaaagaggtctgaattataaactaaatatctgtgtaactttgaacaatttatttaactttttgaagatatttgaaacttatttctaaaatgagaaaaatacctatcatgaggagcttttgtaaatactaaatgagacataacatgtaaagcagttaacaaaattctaggcatggtatg

SEQ ID NO: 10452 - DNA, 533 bp, Homo sapiens
  misc_feature 366: n=a, g, c or t
acttattctgggtgataggatcatgggtgtattatttttccctgtttacttatctatatttttaattttttctacagtaaatatatattatataattattagctattgccacaataatactgcataacagaccagccccaaatctcagtagattacaacacaaggatttattctcaagctcacagttctgcagatcaactgcaatttgactgacttaggttgggcatggaagggctgctctgtctcagccccgccctgctaaatcagtcaaattgcagttggactaggtctggctcctcactgcaggtcaggctgtatgccccacgtgccttcattctggggctctggctgaaggggcaacagtdngadtagcttgcttcgcttcaccttccagcttgtcagagcccaagagacaagccaaaatgcacaagcatgtataaatcctctgtttacctcatttcctaacattttattggctaaagcaagtcctatggccaagcccaacaccaatggggcagggaagtatatgccac

SEQ ID NO: 10453 - DNA, 77 bp, Homo sapiens
cacagtttctaaagcagccccacaaacactcacctgatttcggcgtcagacctatgaggcaggtagggaggggttct

SEQ ID NO: 10454 - DNA, 474 bp, Homo sapiens
acattccaggcctgtgctccagttctatgggaaacaccattcaatccagaaatagacaagaaagagggttgaaaccttcatgacaatgctagagaattaacagtgagagatgcattaagcaacaacacagttttgccttttacaagctccctgaggtttttatttcagtcagaggaccaagatttcagttcaagtcactggaagaaaagagctgtcatttatgctctctacttacaggtaaattgtcttgtgattatttccacagaactctgacttggataagacttgtatccattttattacgatgttcttcttttttacaatttagttccccagagggcaagaccaagctacctaagatcggaaccctctgataatttgtgctgctattttaagatccagttccattctacaactggctgaagcatgaagtcaactaaaataaactgaattgagtggaaaaaaaaaaaaaaw

SEQ ID NO: 10455 - DNA, 500 bp, Homo sapiens
atatagtgcatggcacgcacagaaagaaacagaaggggccaggaagcctccggggaaatctgagggcagtcattggctaacatggaagggctcacaaaacaggcttcctccagaggttcctttaagggcagtaaaatttcccagaacttgaacccataactccacactctgagacaagaatttcctctactcctttcaaggataaatgaggcaagaaagcttcaagttgagcttttccaatctgattgcgaacttgatgacaactgaagatacaatgcctggtttttctcagtagttctgctccaacagtctaaaacgcaatcacaaaagacacgttgtttcaaatggaaattctatcctgaaatgattcactccagcacaaactgaaaacccatccccgatggaccttgactaaccgtaatgatctcaatgtctgcaatttcctgtcaaatatgagaacaacatcccaaagtgggagaacagatgaaacaagacggata

SEQ ID NO: 10456 - DNA, 418 bp, Homo sapiens
aattctggagaggaaggtggcagcattactaatcagatgtttgactgggaaatgtaaagagatagtcattacatggacatctggagaaaaaaacagcacatggaagtatcaagtgttctggggccgcccaggcagaggacatcttctcctatggatttctcctgggcaagaatggcatctcggtgcaggacccgcagcactttctctggctccgcagacccgtaatgagcctccagaacctcaggcttggttttctctgtcttcagcatgtggatcacatcttctctggcctgtaatagaaagtgcagcaagatcagacgactgacaatgtaaatcgcatactgggctcaaaaaatcaacagagagcttattgaatacatccccatcttgtcagggctattggcaaaaaaaaaaaaaa

SEQ ID NO: 10457 - DNA, 362 bp, Homo sapiens
mywwyygrawccttycaaaawtgtttttggcmctatggttttgaatgtcaacatatcattagacagttgaccacggaccatagctcacgtgctctaggaatggagcatttgcccttctgtatgaccacagctactctcacttggaggatcatcaatagacaagggtcaaccagctccagaggaagcctcttctacagctcagagaacctattcctttaagtttcctcacctctgttccaatgccagacaagacttttactgcaaacacttcagtatcatttctaataaagatagcttcctagctgaatatctctctgcaaaaaaaaaaaaaaaaaaaaaaaaaaaaaaaaaaaaaaaaaaaa

SEQ ID NO: 10458 - DNA, 477 bp, Homo sapiens
agaacaactcgagccgactaggtttacgcaagcaggtgttcaatttcagttcaattcattatgttgaattgtacgtatttgaattccggtaaaccaaattagtttaaattgccttcttccgagttagagattaccatggctgttttcactctaacagattttcaactgtttttgtaatcaataatgtaagtttaattcttcccccctccctccaaataacttcatgaactggaggcacatgtgcgcccatattttccgctctgttttcctttgttggtcctccacagatagtgccctctgttggatgggccggttcattttagcttccaccttcccttaaaacaattagaagctcttaatttagatggtactgatgttaatgatgatgattttccattttatgcaagttttggccctctgcttgtctaaaagccttgaggcaaagagttatatgcagtttctctgcgggtgtctgat

SEQ ID NO: 10459 - DNA, 465 bp, Homo sapiens
  misc_feature 346: n=a, g, c or t
ttcgagtctttgacaccagaactgaggcttggctggactgtcccccgactccagtgctgcctgaggggcgccggagccactcggcctttggctacaatggggagctgtacatctttggtggttataatgcaaggctgaaccggcacttccataacctctggaagtttaatcctgtgtcctttacctggaaaaagattgaaccgaagggaaggggccatgtccccgccggcgccagtgctgctgtattgttggtgacaagattgtcctctttgggggtacagtccatctcctgaggaaggcctgggagatgaatttgaccttatagatcattctgacttacacattntggactttagccctagtctgaagactctgtgcaaactggccgtgattcagtataacctagaccagtcctgtttgcctcatgatatcaggtgggagctgaatgccatgaccaccawcagc

SEQ ID NO: 10460 - DNA, 519 bp, Homo sapiens
aaatgactgtctgacaggtggtatctgtaacaraaattggaaactctgaaggaagaacaagattctgaggaaacgactaattttttaatgtgttgagcttgagggcctgctttggaactaacaggcagctgaagatttcatttcatgtcaaagaaacttaatttaaaatccatcaagtactaaactcagagctaaatgtgaaggactgaaataccaacttgcccaccatgttaggtttatgagagctcaatgcagaaatgcctctgaagtgggaaaatctataatttctccgaagaagcactgtctgtgctctggaggtcagaaaatttctagactcatgtcttcattagggtagatcgagaagccttttagaaattaaattttggacatgcccatgtgtcctctgagcctgtcctttctgtcagaagtcacgcagagacccaaatgtcaaaaagggacacactcttttgttgatgcacaagattgtggcattccaatctctttctgaaaatacattat

SEQ ID NO: 10461 - DNA, 69 bp, Homo sapiens
aaccgatatcgcgatactgcactccagcctgggcgacagagcgagactccctctcaaaaaaaaaaaaaw

SEQ ID NO: 10462 - DNA, 573 bp, Homo sapiens
  misc_feature 188: n=a, g, c or t
ctgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatntactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatg

SEQ ID NO: 10463 - DNA, 537 bp, Homo sapiens
  misc_feature 366,368: n=a, g, c or t
actttttctctctcctgccgccctgtgaatgtgaaggggtgcctcccgccatgattgtacgtttcctgaggcctctccagccatgcgcgactgtgagtcaattaaacttcttttgtttattaattacccagtctcagaaatttcttcatagcagcatgagaatggactartacggccctcaaaaacaccatttattatctatagctgtgctgttcaaaatggaggcagtgccaatgtgtgactatttaaactaattacaattaaaatacaatttaaaaattagtttctcagtctcattagtcatacttcaggttgcacaataactacccgtggccagtggttaccatagtaggcaacatatacaananatttctatcatttcagaaatttctattgcactgtgctacgttgtgctgtgcaatagcacagttttaacccttgataatttggcaaatgaaaaacatcttgtcttaattttcattcctttgattttattcagctgagcatctttttaaacataattgttaactatgttaa

SEQ ID NO: 10464 - DNA, 378 bp, Homo sapiens
acaaagacacaggatgagtcaagaatgaatgataggggtttaacaggccgatggggaaagtggacatgactcctccagctatcaaattagacssatgctgccatgttaattctccaaacgagaaacaaaagtgtaatagagaacttgtatcgtcaataacgtcatcgtgaaccagactagcatgtggatcatttctgcaattaaggctatggcgcggtggctggcttgcacatgtcaaattaacagrcagcaatgctttttaacagacgccgcctagaaccttctcagcaatcagcttgtgaaaattggacatcggatcgggagttgttatgatggatattacatgctcgggccattagcaccccaaaaaaaaaaaaa

SEQ ID NO: 10465 - DNA, 105 bp, Homo sapiens
agattctcctgcctcagcctcccaagtagctggaattaccggcacctgccaccatgctcaatgttttcttgtattggttgaacatttgtattagttctcctggaa

SEQ ID NO: 10466 - DNA, 63 bp, Homo sapiens
atttgscaaagccatggtgaaacatctctgtgctaatttcttttgttttgtttcctaattttt

SEQ ID NO: 10467 - DNA, 145 bp, Homo sapiens
tatgggtaccaacatctatggmtgctcaagtccctgatataaaatggtggactatttgcatataacctgtgtacatcccgtattatttaratcatccctagatcacttataatacgtamtacaatgtaaatgccatgtaaataac

SEQ ID NO: 10468 - DNA, 282 bp, Homo sapiens
  misc_feature 257: n=a, g, c or t
aattatttgactccagtaggacaattcatgcactttatattaagagagattgcaataaatccttccatgttttaactgaaaccatcaaggaagaactttctaatgattgarattcatcatggaatcactgcaatggccgcaaacagaggcgtctaagagactgggaaagtggccggcctgagataattgacgaccttgccaacctagtggagaacacagatgaaaaacttcgcaatgaaaccaggcgggtaaacatnggtggacagaaagtcagcctcttgt

SEQ ID NO: 10469 - DNA, 349 bp, Homo sapiens
  misc_feature 258,275,285: n=a, g, c or t
attgctccgcctagagccgcgccacctccaaagggtagcaccggccacccgctccgcaaagtccactctcagccgcgcaaaactagaagatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccganggatgggttgatcacangaccgattangctgtaaacaggttttcgrrtattttggatatgscaaaaggtcttttgaatctaaaatcttgga

SEQ ID NO: 10470 - DNA, 89 bp, Homo sapiens
actatgtgtgtgttctcgagcaagtttctcagtgcctgagttttcttatctgtaaaatggggcaataaatttacctacctcaaaaaaar

SEQ ID NO: 10471 - DNA, 64 bp, Homo sapiens
attcttctacttagccttgtccctacctctttactcctctgtaggcagtaattcttttttcttw

SEQ ID NO: 10472 - DNA, 558 bp, Homo sapiens
cattcacttgttctgtcacctgagagcacctagacacaataaaacctcaatagccataaataaaactagtgtccagaacttggtttctaaataccagtctttactggaaggcactggacctgcctggagaaatagcagattccagaattgggtcgagcaagggacaagcagacttgtcccttgtcccaaaaggggctgccactggtggaatatgggacaatttgagcaccaaaataaataatgatattcagatagtttggctatttttcccctcccaatctcatgttgagatctgatccccagtgttggaggcagggcctagtgggaggtgcttgggtcatggggacagatccctcatgaacagcttgatgcccccctcaaggtaatgagtgagttcctactctgttacttcgcttgagagctgattattaaagagagcctggcacttcctcgtctctgtcttccttcctgtctcatcatgtgacatacctgcttttcttccccttccgccacgagtggaagtttcctgagggcctcaccagaaacagatgccagtgc

SEQ ID NO: 10473 - DNA, 474 bp, Homo sapiens
actttgggaagctgaggtgggcagatcatttgagcwgaggagttcaagaccarcctggacaacatgctgaaaccccatctctactaaaactacaaagaattagccaggcatggtagcacatgcctgtwgtcccagccactcaggagcctaaggcaggrdaattgcttgracttccccagcttcaagaggaagagtctgcagtgagccgagatggcgccactgsactccagcctgggtgacaagagtaaaactccctctcaraacaarcaaacaaaccrrrhaaacaaatagcaacagcaaccacaatcatcatcaccatcaaggctggaacaaggrtgaggcaggcaggctctgatagcaacaggaggaagcagaccwwggagggagagaaaggaaggcagasaaggggaaawwaaaacwcaaatgrtrataatagatgctgacatttrcggagcacttactrtgtgctgggac

SEQ ID NO: 10474 - DNA, 547 bp, Homo sapiens
gttttacttagactgggccacttttggacctattcagcaattctgaatcatcagctcatgtcatttctaaagccaagtccccatcctttgactcatcaattatcatatatttttactcatagatattctccctatcactttttaaagatgcaatttatgtctactttccagtaatcgtcatatttttatcaaagcttttagctaccatttgtttttgccacctatgcacttttggtggttttacagcaagaaacttccaaataatttctggtgtcatggactgcgtggtttcccattgttgctctaatctgcccttctcacttcaaacctctacttcctaaaatgagtcaaggatggactctgatgttgttgaaggtatttacaaaatctggaaccatcttctcctgtttctggtaaacatttgcctgtaattttgtctcaggttattttctttttctgcaagtctagctgtagctttcattggcccctagggtctaccattcaaatggatcacagactataataaagtgtttccaattatgaagct

SEQ ID NO: 10475 - DNA, 529 bp, Homo sapiens
  misc_feature 320: n=a, g, c or t
ctcaaaagaagttcataaggccagctatcccttattaagctctagccatgtgatgggcaccttagatatacatataggaagatatggacatcttcccatcttctcagcaaacccaccaggaaggtgtaatcccagttcaaacatgagaaaacagagtcaaagctattaagtgtcctgccccaaatgctacagccagcatgtgggaactgtcttaaacccagcctctcctggacaccccactgagcacatctgcagccaccatgtgatccaaaaaccaatgtatcaggtccttttgggaggcttggtaataaccaaactgnmvgcccctgtgagtgaaagctaggccactgattcctgctcaccctgtgtctgactcgtgacctggcatagaacaaagaaaagaacgtgaggttgctgatgtttatacattttgcatgtaattactaccatagaattatacacttaaaaatttttaaatgatgtatgtatatcatattgaaattttaaaaagcaaacaaataggaggtgc

SEQ ID NO: 10476 - DNA, 515 bp, Homo sapiens
aattcctacagaagctgccatttaccagccctctgtgattttgaatccacgagcactgcagccctccacagcgtactacccagcaggcactcagctcttcatgaactacacagcgtactatcccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagccagtgaagccaaatcgtaacttacagcaagcagcatgcagcatacctggctctttgctgattgcaaataggcatttaaaatgtgaatttggaatcagatgtctccattacttccagttaaagtggcatcataggcgtttcctaagttttaagtcttggataaaaactccaccagtgtctaccatctccaccatgaactctgttaaggaagcttcattttcgtatattc

SEQ ID NO: 10477 - DNA, 454 bp, Homo sapiens
aagggacgtaggaggatgtgatctgtgtcctatctggaatatcaaggggatgaaggcaatggaagtagctaccacttggtgacttagasaaactcttaatgtaaaaccaccatcagagccaccctggagttatggcaaggccaccacagtctcctccaaaggccactgatatggaactgggaacctccctccatagaatgctaaatggctgatgtgaacttggttaaggatctataattcttctaacgaaggttaaaatggagttaaaattcacagtgaacagataagaagacctcttcactgatttgtcagagttacaactcccaagcagctggagagcactaacgataaaaggaccaacccgcaactctggctttctgcctacacatccctgaagatctggcagcttctgtttgcatccttgtcataagacttcctcttccgttcagcaaac

SEQ ID NO: 10478 - DNA, 145 bp, Homo sapiens
aaacgaggggcggggctgtagatgacccggtcgggagagggccacggtttgttgggggagcggctcgagattgcgttctagagaggaaccagagagagggtctttaacctaaatataaatgaatgactggaaaaaaaaaaaaaaa

SEQ ID NO: 10479 - DNA, 419 bp, Homo sapiens
agaaagtatgatgtggatgcatcacagggcctctgaaaaactcaaacatctagcccgtgaaaaggccagcatttggattcctgcctcagaggtagtcagagaagcagtcataatgaacagcagactcttgagagggcagctgtgtaaagaaacatatgcctattcccactctttttcccctggcccaacgaattggaggaaccaggtcttgcaaagaggagggagaaccacaatctttgaaccagattttgctctctaattccttcaacatctcaaatagtgaggatcctcattgaagtctgcattgggaaaaaagcagaggagattttaaactatatttgagattaaaattttaaacaacactgaattttaataaacaagtgaccccaaagctgcacaataacacaaagatatatgta

SEQ ID NO: 10480 - DNA, 503 bp, Homo sapiens
  misc_feature 195: n=a, g, c or t
tttactcttcccagtcaggtaagcagttcaaatataacaagactttgtgccagtcctcttctgtgttctgcaactctggctctcataagtagtaaaaatatttttgatgttgcatgctctcagaattatgttttctaaaatatcatattggcttycatttwagtttaataaacttctttggcaacttaattagbnatagggtatatataaactcaattttatctgcattttttaaaaaattgaaataatctgattgcatgtatgaaggactcctgcctcattacccaattacataaatacaattatctataggaaggtgaaattgttgatctattatttcaaagacttgtagactagcaaagattcadtctgattagaaataaggtctatagctaaagatatttttattttaaaaaattacagcccttgtaacaaaaatcatttgtaacattggatatgaagacattattagtatttaaaattattgtagtcatttgatcata

SEQ ID NO: 10481 - DNA, 450 bp, Homo sapiens
  misc_feature 267: n=a, g, c or t
acaggaagtttggctgaccccccacgcacacacccactcgctcgcctcagtgtcgtgtggctgccgcactgctcgggacccagacgtcaagggtgctggcggggcctccccaggcccgcgacgcagggctccgcccggacaggargagccgcrvccgccccgctcccactcactcactcactctcggccttcggaactcctatgtccgcgaasccgaaaaaacaggtcagctaattcgttgacgtcactgccaccccgcagtagcgnagggagtagtttttcccatcagcggaggcgttgcaatggaggcaaacgagaaagaaaagatcactgcttaaacatttatcaaaggtctccatggagaggaccttcgaagtttcaccgcccgagaaaggaacttgcagaatcaagttttgcattatatacgggacggggtatgcagtgagtctg

SEQ ID NO: 10482 - DNA, 398 bp, Homo sapiens
  misc_feature 121: n=a, g, c or t
agttgcggtgtatatctttagactaagccccatccctttcatgggcaaagctatcttcctgtgggctcctgggtgggatattgggatgcctcatggagctggacwrtccactagcaccctnctaggctgtacctgccamctkctgtttaactgaacgkttacgactgtcctgattctktaaaaaaactgcttgaggctgggcatggtgactcacacctgtaatcccagcactttgagaggccgaggcaggaggatcacctgaggtcaggagttcgagaccakcctaaccaacatggtgaaactgcatctctactaaaaatgcaaaattagctaagtgtggtagcgcatgcgtgtaatcccagctacttgggaggctgaggcaggagaatcgcttaaas

SEQ ID NO: 10483 - DNA, 369 bp, Homo sapiens
aacattccctttggttaactgaagatctctagtttcatttctccccaccaccatcccctttgttcattcacttgtgcattcagtcagcagaggagccagggggatatgacgaactttcactggttatatactatgtgctggttacagtttaaggaatacgaagctgtaaggtttgctctctttctgcaggaagctcacagtccagctaaggagacacgtgcaaaaataaacaatggtgatccttaggggtagatacaatactggaggtggtacttggtacaatggtggctcataggagggagagacagaattgcttaattggatccttcacaaaaactgatattcatcatgattcaacttccactgtat

SEQ ID NO: 10484 - DNA, 343 bp, Homo sapiens
actttttgggttcggatttccgttaaaagctgtaacactgggagagtctgcggcttcactcctaaatcaggaagaccacgaactcctcgagagaagcgaactctggacgtgacacttttaggagctgtaacacggcaaaggtctgtggcttcattcctaacgtcagagagacaacaaactcaccgggaaaaatgaacaactccggacccgccacccttaggagctgtaacacggccagggtctgcggcttcacttccgaagtaagcaagaccacgaacccaccagaaggaagaaattccggacacatgtgaaatggaacaaacgactgacacaccatttttaa

SEQ ID NO: 10485 - DNA, 474 bp, Homo sapiens
  misc_feature 455: n=a, g, c or t
tttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacngccattttcctacccacag

SEQ ID NO: 10486 - DNA, 369 bp, Homo sapiens
taattgtaagtttcctgaagmctctcagccatgcttcctgtacagcctgtggaactcgtcttgccctgtcgtccaggctggagtgcagtggcacaatctctactcaccgtaacctctgccttctgggctcaagcgatcgtcccacttcagcctcctgagtagctgggactacagtttcagatttgcaaagggagacgtgacatcaagtttgaagaaagctgaattactgggactaacagagtgaaaagaatatggactttcaaggaatrgggaataggaaggccagaaaaatttccttactccttcttcaaagatgatgaaatacaaaatgaccccaaatgaagcggatagaacaatcagtgttacaag

SEQ ID NO: 10487 - DNA, 439 bp, Homo sapiens
aagaatactgcttggcacatgtgcaccaagtcccctccaaggagagaccctgggtaatgatgatctttggtgtcaactaagattcttaagaactggatcctcgtgattcctatgtgacctgaaggacggatgaaattcaccaaagtctctaccacagacattctcagatggtcctaataaaaagaagaaacccaaaccagaactggtggtccacattgtgagagttsctgaatatcatcacaaagcaataattatccaacagcatgcttggtggctcaacattctgaaaggcaaatgtcaagggcacatagtctcaaccatgttgctgatgggagctcatgtttttttgtgttagggtggtcttgtgttctagcctggtggtctttcttctgcctgctatgacagcactaatgatttcatgtacacagtattcacttgt

SEQ ID NO: 10488 - DNA, 435 bp, Homo sapiens
aaaactgtctcactggttctaggtacacaaaacccaaatctgagaaatccactagattggcagaagcaaagggactcagtaccacaggaagttcgcttttctgtgtcactatatcaaaagctaccacaaatgcagacaataacggctctttaatattaaagggamaagctaacctgtccagctacagcagcaaagtaaccatacagcggatcctgagtttgtccgggaaacgcaggccctccgggagcccctccatactgtgaaacaggaaacacatacacgtcattctgccgaatcaagttttcttctttcaccactgagggcttttgtgcaaggcdggacaactgcccgcctgcccgmccttcacaaggtcacctccccaccaccgggsacactctgccaacactccacccctctcttccattcacaccccgt

SEQ ID NO: 10489 - DNA, 494 bp, Homo sapiens
  misc_feature 180: n=a, g, c or t
atttaggacacttgttcttgscggttaagtccyctgttcamcaatcttccttctggatactttggacgaagaccgcccaccttgtgtattcctcggtgcgccaccaccttctggggtcactgtgagttggctggagataagcctaagtgaagtatggatctgccactgccacacctatsncctgcatgagaagagagagggtccttattgaatgraagtccacaactgaatctctgcacactattttgcttcttccaagtgctgaagtatattggaaaagtctctaaaataataagacttaacaggaaatgtttctgtcagtaacaattatatagcttcgcatcagtagtatctttctcacaatttatttatcataatttccaaaatgctaatcaactaaatgatttactttcttcctggaaatatagvaatagracacttatttttattttgratacttattactttttaataaaacttaattacatgktaaa

SEQ ID NO: 10490 - DNA, 343 bp, Homo sapiens
aagamattactgaaaaacctccacgaacasaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggratgttgaaagtattgctgaacagatggaaaatccsggatttgaagaatgtyggttctagtactggggagaaaaatgaaagaacttcagtcggctggaacagtgatg

SEQ ID NO: 10491 - DNA, 625 bp, Homo sapiens
aaggcggtttgggaaccggtgagtctcaggcgcaggcggtttgggaactggtgagtctcaggcgcaggcagtttgggaactcttggttccacgtgaatccactcatccgctctgtgcctctcacctgtcaaacaagttcctcatcagacacaagcagcccagacgccttttccatcctgggaagaagcgggtgagcctccaggatcctgcccaagataggaccctagtgcggaggccagttgaagaggagccctgagggagggcctctgactttgatccaggtgcccggaacagaccgaaattaccggacagtagcaaccgcagagatgctcagatgcagagatgtcggccagtgaggctcgcccaggtggccactcatgattttcccacttcacaatcattgcatctaagagcacttcatggaaacactgaagccagggtgattactgtcagtgtggttccttgacttgccctccgctgtccactgcccccaggcccatgtgacaaccgcaactgcgggcgcccgggcacacagccgacttagcgccgtccggaagcagagcacgtgcttcgtaaaaaatgaaatgactctctgcactctgaaatctttgaacatgtgcatctc

SEQ ID NO: 10492 - DNA, 555 bp, Homo sapiens
ttaaggtaggcaaagcacctttagaccagagcattcctattactttgaccctgctagtgaacctggaggtcttgtctgatagggaaaagtgtctctgagtagtgtcttgtcttcggaataattcattagcaaagagttttcactcacaggtgaatcccagattgaagtttccggcttagactctgtgaagtctacttgctccttcactggcatttataccttcctgaaacctgtgggaataactttgatgtctagtaatagaagcactgagacagtatcatgaactttcagctccctcttttgagattttagggccattaggctttctttctttggctctttaaggcctggttgcttctgaatctgaaagatgttatcacaaaaatagttcagtggagccttttgctggttaacttcttactgtttcttttacagtgattaaagcttgtttttcattcttcagaataattttttaaggatttctagctcctcatctttaaactcattcgatgatagaaaatttagtgtgacattcacaatttttatgacagtgtt

SEQ ID NO: 10493 - DNA, 600 bp, Homo sapiens
aaccattccttaaaccagaaaaatgaaacagcatcatcagtgtctcaaattgtcaaatgactgggaggaaaacccttggcccaggagagatcacggaaggctggtcacaaaccaagccagatgttgactttcttaagaccagcgaatagagacaggagtttcttttatacttagagaaaccagagagtttcacggtagcgtaacaacacgagtgcctctggccactctggatccactctgcctcctgcctctcagccacacagtatgcccattcttctgtggcatcatttatctccctccggttttctccactgtgaatcctcacacatatcacttaacttagtaagcaagtctccatctgtcttgaaaaaaagaagaaaatgatgatggaatggaagaaagagaactaaaggagagccatcaaatcagacaaaagctatctgtctctttggagagacaacctctgggctcatccactgcattacattcttagagcttgtagaagagcggtcattaaatattttcaaggctacagactcsttcaagaattgataaaagctatagaacttctttcacaaaaatgcatgtattgcacactga

SEQ ID NO: 10494 - DNA, 312 bp, Homo sapiens
  misc_feature 129..131: n=a, g, c or t
accttccttcctcagtccatgataccatgtagagtgcatgtatttaagaagtgttatcagggctggacacagtggctctcgcctgkvatcccagcactttgggaggcccagacggatggatcacttgvnnncagaagttcaagaccagcctggaaaacatggtgaaactccgtctctactaagaatacraaaattatctgggtgtggtggtgtgcacctgtaatcccagctactcgggaggccaaggcaggtgaatcacttgaacctgggaggtggaagaagtaagattccatctcaaaaaaaaaaaaaaar

SEQ ID NO: 10495 - DNA, 469 bp, Homo sapiens
  misc_feature 195..197: n=a, g, c or t
aaattccaccasatgtacaaagaagagctagtaccaattctactgaaactattccaaaaattgaaatcaaggaggagggactcctctatgactcattctatgaagccagcatcaccctgatatgaaaacctggcaaagaaacaacaaaaaagaaaactacaggccaacatccctgataaacatagacacaaaatnnntcaacaaaatacaagcaaaccaaactcaacagcacatcaaaaagttaatttaggctgggtgcaatggctcatgcctgtaatcctagcactttggaagaccgaggcaggaggactccttgaacccaggaatttgagaccagcttgggcaacataggaagaccccatctctacaaaataattagccaagtatagtgatgtgtgcctgtagcccagctactcagaaggctgaggtgggaggatgacttgagcccaggaggctgaggctgcagcaa

SEQ ID NO: 10496 - DNA, 373 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctgvctaattttttgtactttcagtggagatggggttttgccatgttggccaggctgttctcgaactcctgagctcgggtgatccaactgtctcggsctc

SEQ ID NO: 10497 - DNA, 406 bp, Homo sapiens
agttctagtgcctctggttttgtattcgctcagggtgcaggagacttccaattagtttctgagttttcacaaagggagtttgtccttacgctgttgctgaattggtgtgtttgttgtgaggaagggtacttcggggtttcctactctgtcatattgctgacatcactctggttaatctttttaatgtggatcacttatgaaaaatttcctcaattacataatatcttcaaacaaacccattrrcaaccacttgctgcgaaaattaatacatattaagaaacaaagttaggtgtttggcattagtaacagtaaatatgtactatcagtggctgccttaaaatatttttgggagttttcaagtcatagggtatgaaaagcatcatctttcatcacagaacacctttgc

SEQ ID NO: 10498 - DNA, 390 bp, Homo sapiens
ttccatcctttgatctcattttctgggagcaacacaaaaaaaatgtggcttccttgaaagttcttcatgtatttaaagatcactctcaagcctgcagtcaacctggagtaggcagatgaagcagctggggaaaagacctcttgacctaccaacaaacaagacagagcctgtctatgtcattcagactggcctcaaactccagggctcaacaaagcctcctgcctcaacttccccagtagctgggactacagcaaatatcttccactgagatcgtgtggttttaatcatacaaggagagtggcagaagaacagaaagattgaaaccaaggacagagaacacctgaaattggaatggcttcaaatgttcagtggaagtgaacaagttcttgt

SEQ ID NO: 10499 - DNA, 441 bp, Homo sapiens
aatatttagcaactgttgcggctctctactgtgtctgccattaaccctgtggatgctggactgtcagattcaagttgttttggcttttactacaaaaagcatctttacatatatctgcaatttaatggataatttattttccctttccatacatctgaaagaagaaacataattggtatgaacagcacttaattccagactgacttcttttgaactgtagagactggatttcaccatgttgcccaggctggtctcaaacttctggtttcaaactgtctgcctgcctcagcctcccaaagtgctgggattacaggcgtgasmaccgtgccctgcctctcttcaaggactctctttgctacatcggcatcacctgggaacgtggtagggctacagaatcttgggccccaccttggacctacctaatcgtcatcttattcattg

SEQ ID NO: 10500 - DNA, 142 bp, Homo sapiens
acaatgattggactgtcatctcttcccacttgtttgttccagttttagctcgtcaggtcatgtagatttactctaccatatrrcaaaccttkrratacctgaactgatactcatgccctactttctccacctgacctctgar

SEQ ID NO: 10501 - DNA, 467 bp, Homo sapiens
  misc_feature 16: n=a, g, c or t
atttttattsctcadnccccttccccctccccacggagtccccaaagtccattgtatcattctaagatatgttgtctggagctgaagcagccatcttgtgaccatgagggagatgccgagagagatctcagagcttccggccgsctcgscacggctggtcgcagcctccctccagaatgctgagatgggggcgttgttgtgtgagggagaaagaccctgttgctctaagattttttttttaatgtaacttgcaacaaaaaactttcctaaataatatggacgttaaaaggccttcagagaaacacaaccagcccaccagcccctcatgttttctgatttatttataatttttacctcacctgattcctgaarhagaactgacgaagctgagagacgctggtcactgaccctgagcctaaggtttagctggagttttcttgttgacctcacggtgatgcttctggtac

SEQ ID NO: 10502 - DNA, 487 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggcccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagat

SEQ ID NO: 10503 - DNA, 454 bp, Homo sapiens
  misc_feature 107: n=a, g, c or t
aagaaatagggtgaaataatccaagagtggaagctgagataccagcttggaaattattgcagttattcagggaacctaaatttgaggtcaaggatcaaaacgagccntctctctgtcaagagatttctacttagacttatgtcttctgcaatgtcttctgcaaatgatttactgaaggcttatgacaacattatttgaaacctgaagatgggtgtctgcactgacagagagagctccagttttcaaattactttcatacacggtataatttgaccttcatataaccaccctgaaagggccaggaaaatcgaaactatatcttaaattgtgattaaaacaaattcacattttgaagaccttatatattttctcttcaatcttctaaaattcctttgagatgaggaagaaacagtatctccatatatagcattaggagactaatctataagtcagt

SEQ ID NO: 10504 - DNA, 399 bp, Homo sapiens
ttgtcctccagagactgcaccacctgtagcatagaaaaccaccaccacggacctgccagcsatcggcgcasaaaccagccagctgtttgctgccaaattccttcctctcccaggtccagaccaaatacaagatcagcaccacaccgtgtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgttt

SEQ ID NO: 10505 - DNA, 433 bp, Homo sapiens
catgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagccctdcccggscctccccagggccccccgccccctcctctgcctgctgcgtggaggcagccatgggaaggagccbaggggagctggcctgggggagcgamsccatgttcgmttcctgacttagagctggggggggtggggggtggggcttgttcccctgcagtatctgttctgtgaagtttgttaaatgta

SEQ ID NO: 10506 - DNA, 402 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaa

SEQ ID NO: 10507 - DNA, 395 bp, Homo sapiens
acatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactaggggaagtcttaaatgtgtacatgtagttgaatttcagtccttacg

SEQ ID NO: 10508 - DNA, 155 bp, Homo sapiens
attcaaaagactgggccgcaggaccttctagcccacctgtgggcggggtgcaggcagcagagcctgcgggcrtctgccctggccgccccaggctcctggcttcatcacgcctcccaccagctcctggatgacacagcttgtctccctcgggctct

SEQ ID NO: 10509 - DNA, 338 bp, Homo sapiens
tcaagctgtagtaaaattgtgaccttaactttggaggcagctaagggtaatttacctgcgtaattctcccccatctgatgttagaagtaaaataactccttaaaaatggtaaactattctggtcaatgtgaagctaaagcagtttwaaaaactctgactttcatgtattcttgacaaatccgtttacctcaatatggcataaatatgcctttcaattagtctcacatttattccctttgaaacactaggatttcttggcaaagtacctgtttctcagtgaataaagctattatttctttttcttgccattagatatttaargcaaaaatacatagtga

SEQ ID NO: 10510 - DNA, 346 bp, Homo sapiens
ttattggggatacctgtctctgaaaaaaaagcttgagccagaggcaagaactctgggaaattggtttctctgctgctagttgtttttggtatgagtagggttaaagcacgaattgggagctctcagcgacatcaccagtcagcagccmaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgca

SEQ ID NO: 10511 - DNA, 577 bp, Homo sapiens
aaaaatattaggggttaaataccaggtatcattagctttccttatgttaaatctgtgatgagacagaatcccgtattgttgcctaggctggtctcaaactcctggtgtcaagcgattctcctgcctcagtctctcaaagtgctgggtttacaggcatgacccatcacacctagccttgatgagtcacaaaaatcacttcaaaatgtgagtaatcccttcagatggaccatgaatagagaccacaatgctggaccaagttgtatgttgggctttcactggtgaccacataaatcacaaagcttctgaccccttccagtaacgaggacctctcctgcactaacatatacctgcagcttctcacatctaaccaatttcattttggcctcgtgcttctgctaatactctaccaaaactaatcctaattttttcctcttatgactaaggrrataaaggctggacagatgccactgcacatgcccattctcccctccctggcaccttaagcccttttactggctaacattatgggcctctattaaatggagagaaaataaagatgtcaaatgtaaactacgam

SEQ ID NO: 10512 - DNA, 386 bp, Homo sapiens
aaggctggaagaagcatgggggcgggactaggaggtgcgtctgggcgctgaggagcggcgggaacccgggtaggggaaggtagacccctggaaattgaacgggtgtctccacgccgarattcctgtccagtgactgtggggaatgcggatttctttctttttttcttcagarraagtattttaaactaacttttatgttgawaaagtaaaaattttgcgctccactttgggataggggaatcagtaaatcagacaaattgataggatcttgcagtttttaaaatggttattaataagtwaaagaagaatgaaattatgcggtatcccagctaaacctaggtagcgctttaaaaactattarraaacttactcatttttttaaaaar

SEQ ID NO: 10513 - DNA, 151 bp, Homo sapiens
tacttttattccctacatgtctccagagtttagaacaggccttggcacagagtggatgctcaataatgttttccgttaaattaaatatatactttaaaaattacatatttttgtaagttttctgaaagttgttttaaaaaacatgtttgtc

SEQ ID NO: 10514 - DNA, 142 bp, Homo sapiens
catttccaaagccatggtgaaacatctctgtgctaatttcttttgttttgtttcctaattttttttttttggcaggtggtgggaaatawyctttgtcttctttggagtaaaccttcaacacsggattttttcttttaattak

SEQ ID NO: 10515 - DNA, 164 bp, Homo sapiens
agtatttgaggagggtggaaggghgagasagtctaaagagttgcatttataaactctagatgtgtatatttagatacaaaaaaaagctgtggaagaaaatacaataagcagttagctgtgattgcttctgggtggtaaaattctaagtaattttttgtcttttt

SEQ ID NO: 10516 - DNA, 524 bp, Homo sapiens
atgaacatacgcctttgttctgtcattttaaagagtggtgtttactatgtgtgtgcttgagcattttctttcagttacatgggtgtaatttaaaaaacagctcctttttaagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatag

SEQ ID NO: 10517 - DNA, 400 bp, Homo sapiens
  misc_feature 400: n=a, g, c or t
ttctttctcataccttcaaacagacttcacattcttcatctgcagtacctagttcagaactttattatattttgccagacttgtaatagtagcagtaaaaataataatagccawwctdggtgtavmrgctcatgcctgtattcccagcagtttgggaggcaaaggcaggaggatacctcgaactcctgagctcaatctgcccgcctcagcctcccaaagtgctgggattacaggcatgagccatggcacctggcaagggttcttcatctttatatttsstgcatctagaaaacacctgataacataaactcagtatgtttatgtggaggagcaaataatatacagttcttacttcttatctccaaccagcttcacactctattgctgtttaaacaaacan

SEQ ID NO: 10518 - DNA, 387 bp, Homo sapiens
  misc_feature 16,225..230: n=a, g, c or t
actctggcctctgggntctcggctcgtcggttgggtacccgaacccagctactgctgcttgaagagaagatggatggggactcctcgccgtcgctgcgccgccggccttccctgggcggacgtacacctttgcgamstcagtgaggacccagggcccctccttggaatagctcttatttctcaagcgctgcagstgaagctcgctctgcggtccgagaggbctknnnnnnhggaagactgaaaactgggaagagacgctctaccctgtgctcctcgccggcttctataggagccgcagtgcctgggattttctcaaactttgtcccaaacttcagctgtgggagtggaggaacaaacaggcctctcccagaattgtgaaagagatcg

SEQ ID NO: 10519 - DNA, 408 bp, Homo sapiens
ttttttctagaaaaaagawaagcagaagtattaagttatttcactggatcaaaatcctttccccaactctttactccaatgaagtgggttcatacagaggcaaagcaagtgcttcatccagctctagaactaaaggtacccatgtgcaaagaaaggaaagaaatctggcctgcaaacttgaagctgttaacataaatgcagagcatgaatatttggctatataatgctcagacttcacagcccactatcaatcagtcagctgtgtaaaatgaaattggtgggagttcttgagctgatggaactcttctrgtgtcctgactgggatagtggttacatgavdctacacatttggtaaaactgaacacatacaaagagaataaattttactgtgtgtaaaatttaaaaatg

SEQ ID NO: 10520 - DNA, 433 bp, Homo sapiens
  misc_feature 70: n=a, g, c or t
atccgtgatgcttccgcgtgtcggaggaccaggtgccacctcaagagagaggccgtggsggcgagcsgynggmgwatwactcttagcagaagctcacctgtaagttttgagaacttagaaaccgatgccttccctctcatcagtcgtgaggcgcagtctcctggccgcggggttcgttcctccttgacatctctggagacgcatcgaggagctattgttctctggcgtcggaggttgcgctgtgtccgcggcgttgagggccccttgctaactggaacacggggaaggcggccctgtraggtttagtgaactcaatcaaagaggtcctgcaagtggagtagactccctgaagcaagactgccatctggaccgccgagtaatggcggtgttacctggagaacgtgaaacagtctctaaacacttactagaagas

SEQ ID NO: 10521 - DNA, 369 bp, Homo sapiens
  misc_feature 227,263,326: n=a, g, c or t
akgarttgtcagcgggctcacccwgaaggaatggttttatcctgctgccactgtgatggatacaattaaaaaacagaaaataagtgtcactacggatgtgaagaaactggaactctcatgcgttgctggtgggaatgtgaaatggtgcagccactgtggaaaacagattggtgatttctcararagataarcatagaactgtcatctgacccagttattccrstcynrgaacacttgtaagctcgtaactaatsgcgacaatngattggagaatygaacagcgatgacttgataaagaagatccctaaggatgactaaaggatatngagacccagagcccccatadgtagatgacagcagattttctca

SEQ ID NO: 10522 - DNA, 441 bp, Homo sapiens
ctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctysratcctttcaacagatttttatatagcaactgctctctgcaavgagttaaactagaaactgggcacatggtagag

SEQ ID NO: 10523 - DNA, 534 bp, Homo sapiens
aaaacgcgtgcgggggaggtggcttcttccggscgggccgagaggtggttacattcgttgaaggacaccagctgcggaatttgcggctttggcagattgaaatcatggcaggtccagaaagtgatgcgcaataccagttcactgtattaaaaaatatttcaactcttatactctcacaggtagaatgaactgtgtactggccacatatggaagcattgcattgattgtcttatatttcaagttaaggtccaaaaaaactccagctgtgaaagcaacataaatggtaagaagttgacatttaaacctttataatttagccattttgatgttaggatttttccctaacatttagtataaaaataaaccattgtcattttgcaaaatttatagcatacaagaaaaaaaaatacagaggcctagtatagtggctcatacctgtaatcccagcactttggcaggccaaggcgggcagatgacttgagcccaggagttcawgaccagcctgggcaacatgatgaaaccccatctctacca

SEQ ID NO: 10524 - DNA, 477 bp, Homo sapiens
tatcaagtttagtaagatgatgacagttgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattgagggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcg

SEQ ID NO: 10525 - DNA, 473 bp, Homo sapiens
aatgtaatcatccacaaatacagtgacaatgtaaattttgtcttactaacggtagaattagagaccacagagcctttaaagaagcaaaattcaggggattggttttattattgttacgttttatcattaacattagataatttattttaaatttttattatagtcgagaaataataaaagtgagataaaatgatgtagtaaacaaaggagaaaatttttatttcttttttgttgttgttgtttacttttttcattcaaacagattctgacagatatttcttaggtagtatatagccaaagtagacctggacataattaagtaattctatcagttattcttttactttcaaaaggaagagaaaggtacctttgagttggttttcagggccacgtttcaagccagagacattgctatgaaggttaaaggaaaagatattttttcctgcttttttcccctttatagtgatagctat

SEQ ID NO: 10526 - DNA, 140 bp, Homo sapiens
aaaaagggcttctgtcgtgagtggcacacgtagggcaactcgattgctctgcgtgcggaatcgacatcaagagatttcggaagcataattttttggtatttgggcagctggtaaaaaaaaaaaaaaaaaaaaaaaaaaag

SEQ ID NO: 10527 - DNA, 514 bp, Homo sapiens
tcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgagaa

SEQ ID NO: 10528 - DNA, 497 bp, Homo sapiens
tcaccactttcattagatctgtagttcctgaatcacagaaaggtttgtaatcttttttatgagcctcttccattaatgtatttctctgtgctcaggaggtcagatcatcaaacccagtctaatctcttggttggaacaagaagagtcaaggacagttcagggaggagttctccaaggtgagtgttcatgaagaacaactctggttgatgagaagttcagtatgtttgaaagcataattaggaaactttttaacatgtactttctccctgcactctaaaccccaaggtttagagaaagttaggaaatatttaacttcccacacgcttttatttacagagcagtccccccttgtctgtgatttcacttttcacggtttcagttatctgcattcaaccatggtccaaaaatattaaatgggaaactcggccaggcatggtggcccacacctgtaatccccacacattgggaggcctaggtgggtgaatcattgagcccag

SEQ ID NO: 10529 - DNA, 55 bp, Homo sapiens
accacagcctccacctcccggcttcaagtgaatctcctgcctcagcctcccaagt

SEQ ID NO: 10530 - DNA, 401 bp, Homo sapiens
acattcagttcccaggggcaggtaggagacagtggccttcctctatctcaactgcaagaggctttcctctttttactaatccacctcggcacagaccctttatgggtgtcaggctgggggacggtcaggtccttctcatcccacgaggccatatttcagactatcctatggggagaaaccttggacaatacccagctttcaagggcagaggtccctgcggctttccgaagtgcattgtgcccctggtttattgagactagagaatgctgcttgggaggctgaggcacaagaatcacttgaacccgggagacagaggttgcagtgagccgagattgcaccatggcactccagcctgagtgacacagcaagactccgtctcaaaaaaaaaaaaaaaaaaaaar

SEQ ID NO: 10531 - DNA, 300 bp, Homo sapiens
aaaacgcgtgcgggggaggtggcttcttccggscgggccgagaggtggttacattcgttgaaggacaccagctgcggaatttgcggctttggcagattgaaatcatggcaggtccagaaagtgatgcgcaataccagttcactgtattaaaaaatatttcaactcttatactctcacaggtagaatgaactgtgtactggccacatatggaagcattgcattgattgtcttatatttcaagttaaggtccaaaaaaactccagctgtgaaagcattttttaatcttaaaaaaaaaaaaaa

SEQ ID NO: 10532 - DNA, 416 bp, Homo sapiens
  misc_feature 181: n=a, g, c or t
atttcctcccaagaaggcagcagcttcactcagctggtatgatggagtattccaaacagaaaaccagctgtgatctctggcacttccaattccaattaagagctttgttcatttaacttaaggatttacatcactttaacatatcttgtcaagtaagtaacacttgaaatgaccccataantgtcccttaagaagaacaaattgcaaatcatctcaaaaggaaacaacagatcatcagacagcaggaaataagaaaggcctgagaacagctgggtaacagcatttcagctcatccaaggaagcctaggatttcttgtcagtgcatctagcacaggccatgacatggaggaaatgatgggtaaacgtccattgagcaaatcaaacttctgaaataaggctcttcaagaaggtttcaa

SEQ ID NO: 10533 - DNA, 481 bp, Homo sapiens
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagcactttgggaggccgaggcgggcggatcacgaggtcaggagatcgagaccatcccggctaaaacggtgaaacccgtctctactaaaaatacaaaaaattagccgggcgtagtggcgggcgcctgtagtccagctacttgggag

SEQ ID NO: 10534 - DNA, 474 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgttgc

SEQ ID NO: 10535 - DNA, 188 bp, Homo sapiens
aaytcaagactgctctgcctacagagaagccattcttttagtttcttctttttaaaaaaattagagacagggtctctctatgttggccagtgtagtcttgaactcctggcctcaaccaatcctcccgccttggcctcccaaagtgctgggaggtatgagccaccatacctgacattctttggaatcct

SEQ ID NO: 10536 - DNA, 474 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcvtkgctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgttgc

SEQ ID NO: 10537 - DNA, 428 bp, Homo sapiens
  misc_feature 366..367: n=a, g, c or t
catmtctasattacttataatctataatgtaaatgctacgtaaatasttgttatattgttttttaatttgtatgatgttatattgtwttttattgctttaaaaatatttttgatctgtggttggttgmatccacaaatgtacaacctatggacatgaagagccaactgtactcacatgctaktgaacatacttaagatcgrtgacccgcctttgtcacaaacaaatcccactgtttctatgggtaaattaagatctacctcatggtgaagttttcaggactatcctgcctatgttagcaacagaatcttagacctggccaaaatgggtgagccccagatggcagggtkatgagttawagktggwynnccwgdmttactgaaatgtckccattdcctgkctctacagrggaaacctgcccctatcctgg

SEQ ID NO: 10538 - DNA, 581 bp, Homo sapiens
tttaggccgaatcgcgggggccggctaaacgcgtgcgggggaggtggcttcttccggccgggccgagaggtttacattcgttgaaggacaccagctgcggaatttgcggctttggcagctgtttgttcccaccgagctgtgctttaggaagctggccagccgggcctscwkttaggtgcgctgcagcctttttcaaagcgagtgaatgtggcccggcccctacagttcgccaggcccgctgtaaaagggttagattatcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtacttgccacatattgaagcattgcattgattgtcttatatttcaagttaaggtcaaaaaaactccagctgtga

SEQ ID NO: 10539 - DNA, 442 bp, Homo sapiens
  misc_feature 102..104,367: n=a, g, c or t
camtgtwmacagtctcttcccacttcctgtggctgccagcattcattggcttgtggctgcctcactccagtctctgtctccatggtcatactggtttctcmnnntgctgtgtgtcctctcctctgtgtgtctgtcttacaaggacactgtggtcacattcagggcacatctagamaatccaggatcatctcctcctctcaaaatctttaacatactttaggccgggtgcggtggctcatgcctgkaatcccagcactttgggaggctaaggagggtggatcacttgaggtcaggagttggagaccagcctggccaacacagtaaaacaccatctctactaaaaatacraaaattaactgggcatgvnrgcgsatgctggtatcctagctactcaggagggctgaggcaggrgaatcgcttcaacctgggaggtggagattgc

SEQ ID NO: 10540 - DNA, 294 bp, Homo sapiens
  misc_feature 61..63: n=a, g, c or t
atamccaggatgccatggagacagactagtgagagtgaatgctggtcatagatgattgatnnnmcsatctcagtgtggaraaactgaggcttaagattagttaagaaatttcctaaggtcacacagctgstaagaagtggcagmgctgcgatttgagttgcacaggcagactggagygctcaattgtgggctttaattgcctacttgaaggatgcgatgtasmrtgcatgtagaagagacatctgtttgaasscatccattcatctttctggggcatactgtcactattgagat

SEQ ID NO: 10541 - DNA, 251 bp, Homo sapiens
cccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttt

SEQ ID NO: 10542 - DNA, 493 bp, Homo sapiens
  misc_feature 267: n=a, g, c or t
tcatttctgaaaattaatattgagcatacttattggatgaaacctatttttacctactttacaatctaagtagaatctggaactagtgggtgtgaaaagctgggagcagatggctcatccttatctctgcagagggcggcaaaccaacacccctggctatccatttacctaagaaaacaggagcgatgtgactgcatcttgagtccaaagattagattgtttggagacaggtaggttgcaaaatgtgatttgaggcctcatagcwmnggtgtcccaaagatgtaaaaaaacttggttagctttcatttgactcctagttttgcagttatttaattaaagccaattttaggccatatttactagcatagttataaataagaaaccagtgtaaagggcacctcaaacactcacgatacttgaatgtctcatctaaatttaggagatacctatttacctttagttcctgaatccatgctcccggcatactcattaa

SEQ ID NO: 10543 - DNA, 193 bp, Homo sapiens
  misc_feature 36..37: n=a, g, c or t
agaccatgtcctcctggggaaaaagtttccctagtnnccccagcaccgcgccccaccctacgccccgctggaaaaaaaacagcaacataaaatcctaggcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10544 - DNA, 396 bp, Homo sapiens
  misc_feature 115: n=a, g, c or t
aaatccttgttatccggcagataaccgcggccgsccasacccggcctgcctcctccgtctggctgcgggcggggagtgcgcctggctcccgagcccctgacacggatttggggyntgcaatgacgatctaccccacaccatccacattcctgggaccctcggggcaaggtcctacagtccttggtgaccaccacgcctgcaaaaagcggtgggaaagttgttacgcttagaaaactaccaacacgcgcatgcctgtaatcccagttactcgggaggctgagacaggagaatcgcttgaacccgagaggcggaggttgcagtgagccgagatcgcgccactgcactctagcctgggaaacaagagcgaaactccgtctcaaaacaaaaacaaaaaca

SEQ ID NO: 10545 - DNA, 506 bp, Homo sapiens
aaatagamcatcctaatcaaaatatacaaacaaaagtctgaagatgtaaaatacataagtgaggaatcattagctgctgccatttccctttgatgaccttttggtgatgtgttttcataaactactgcaattggatgtaccacctagagaatcctcagatttctttcaaggcacatcatggataccatatttaatgagactgcaggagaaatagattactgctcttctactctctggaaggtcgttgtgaatttttttttcactgaaaatgttttgggactgataaaaacatgcccattctccatctatgatggtaatgagtaatcaggtgtgcatttgattaaatctggtatgcttagtgttcagagggtagaactgaaagcaaaagaagaatgcaaattatataaatggaagaagtggaatatacaataatatacaatacaagaaaggaaatcagaaaactaggaccttttagccaaagaaaaagaaaattttgactgggtgtg

SEQ ID NO: 10546 - DNA, 504 bp, Homo sapiens
  misc_feature 401..403: n=a, g, c or t
aaaatatcaattaggtcaaagtggttgataatggtgctgggaacatttcacgacctgtcttccagctattttgaaatatacaatacactgttgtaaactacggtcaccctgctctgctactgaacactggaacttattccttctatttaactgataaaaagattgtggattttctattgagttctagccagcccatgtggcaccaactgtagcctgccctcatgctgaaascatacaaccaggaaacttacccaacgctgttcctttcttccaagtgactattcccatcaggatctgcttttcattggtccttagtacttttcagggctttcttgtcaccttctgaagagctcaccagcagcctctctgattcaacagtatcatatcaattatttaagmmnnnaaatgggatggatatttggatcagagtatgagttgtggatgaagagggaaaatttctcctactggcactgtgatgactagtgcaaacctacgctatctaca

SEQ ID NO: 10547 - DNA, 154 bp, Homo sapiens
aaaccttggggtctcagcctgtgagtctggtcggggggcacacacattccaactgtatcacctgcagtaaccatcagcagaaatcgagaaaaaatactcaagtagatttcttaaaaaaaaaaaaaaaaaaaaaaaaaaaaaaaaaaaaaaaaaa

SEQ ID NO: 10548 - DNA, 501 bp, Homo sapiens
tcagcttgcgtctccttccacgttgtaggagctttgtttatttgctctttgcaataaatcttgctgcttctcgctcattgggtctgtactgcctttatgagatgtaacactcaccacaaaggtctgcagcttcactcttgaggtcagcgagaccacgaactcactgggaggagtgaacaactctggactggaggaatgaacaactccagaggcactgccttaaaagctgtaacactcaccgcaaaggtctgcaccttcactcctgaagccagcgagaccacgaacccaccagaaggaagaaactctgaacatgtttgaacatgagaaggaacaaacgccggacacgtcacctttatagaactgtaacactcaccgccaggtccgcggcttcattcttgaagtcggtgagacaaagaacccaccaattctggacacagaaatactgaggcaagatagttacaactatatgtatctcatcaatttaattaaaattggaattaa

SEQ ID NO: 10549 - DNA, 127 bp, Homo sapiens
agacttggtaacgcgagasckgcggggagggtgtgtcacgcctcccgagactggggctgtgcggcctcacggagaaactgaggcaggcgcgaagtcgaagtgcgcgcgtggccctgcaggcaggcgg

SEQ ID NO: 10550 - DNA, 439 bp, Homo sapiens
agatcaaagaagaaaccctgcctcacactgtctcatctccacagaatccctcttccaaccttcctatcttttctatttcccattgatagagggaaacttgtagactcttctcatcaacaaaagataaaaaatttatttgttggccgggcgctgtggctcacgcctgtaatcccagcactttgggagcccgaggtgggcaggtcacgaggtcaggagatcgagaccatcctggctaacacggtgaaatcccatctctactaaaaatacaaaaaaaattagccgggcgtggtggcgggtgcctgtagtcccagctactctggaggctgaggcaggagaatggcgtgaacccgggaggcggasttgcagtgagctgagattgtgccactgcgctccagcctgggcaacagagagagactccatcccaaaaaaaaaaaaaaat

SEQ ID NO: 10551 - DNA, 409 bp, Homo sapiens
  misc_feature 330: n=a, g, c or t
atacttaatttctgttagtctctgtttccttgtctataaaattaggaagggtggactaggtgaccagtaatgtcccatataaaatctaaaatttttatagtaatgatatatggccgggtgtggtggctcacacctgtaatcccagcactttgggaggtggaggcaggtagatcacctgaggtcaggagtttgagaccagcctgcgaacatggttaaaaccccgcctctactcaaaatataaaaattagccaggcatggtggcacatgcctgtaatcccagctacccaggaggctgaagcaggagaatcacaccaacctgggaggcagagnttgcagtgagctgagattgtgccactgcactccagactgagaaacagagcgagactccatctcaaaaaaaaaaaaaaar

SEQ ID NO: 10552 - DNA, 72 bp, Homo sapiens
aatttccaaagccatggtgaaacatctctgtgctaatttcttttgttttgtttcctaatttttttttttttt

SEQ ID NO: 10553 - DNA, 494 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgttgcccagggtggtgtcaagctcc

SEQ ID NO: 10554 - DNA, 409 bp, Homo sapiens
  misc_feature 52,54,165,235,360: n=a, g, c or t
aaaacgcgtgcgggggaggtggcttcttccggccgggccgagaggtggttanbntcgttgaaggacaccagctgcggaatttgcggctttggcagattgaaatcatggcaggtccagaaagtgatgkcgcaataccagttcactggtattaaaaaatattdmaantkcttatagctctcrcaggtagaatgaactgtgtastggvmcakcatatggaagsattggcattgattgnttatatttsaagttaaggtccaaaaaaactccagctgtgaaagcaacataaatggattttaaactgtctacggttcttaacctcatgctgttaagttcccatgcctggagaagctaatgkccaantcatcatgtgataattgcaatttgtagcaataaattatgaacccaaaaa

SEQ ID NO: 10555 - DNA, 306 bp, Homo sapiens
aaaggagatcctgaacaatagccagtgaaggttcgaccccctgtgggsccacagagagtcacctgcagctcagtcttaccccaggtgctgggcccaagtctgctcttagaggaaatggagtgaacattgttccagcttgggtcaggtggctgtttgttgacattgaartccctggaagaagaaccatgtcttattcatctttgtatgcctggcctctcatagacacatacaataagtactcattgtrtcaaagaatgaatcaatgttcccgtaagtgaaaaaaaaaaaaaraaaaaaaaaaaaaar

SEQ ID NO: 10556 - DNA, 491 bp, Homo sapiens
  misc_feature 341,344: n=a, g, c or t
agttgggctcctcaaaagcagaccctgagacaaggttttgggcttatgtaatttatttaggaggtgaccccaaggtcaagtagagcacgtttttaggaaaaataaaagtaagaaaaggaagctaaaagagccagtaaatggcatattaatatgaagtttctactgtaggcaactgggactcctttggaatcctctgataaaactcacttcagaaatgagtgagtttctgaactcactcccaggtgtgggaaggctgaaccctccaactccaccaaatctccttctttattgattggggataagggggaagtggcttaaacttctcctccacttcggcathnbdncttcaggaagagaagaagaggtgcaggtgcttgaggtggaaaactgtcagagtgctagaaactattgcagcagcagatcatttcaggatggcaaagaagatgtgttggtgcatcagcagactcttctacacatctaaatagggataa

SEQ ID NO: 10557 - DNA, 437 bp, Homo sapiens
tatttttgaatactttttaatagcctttatttaatactcatttactcatttaataacctccgtttaatacttttttaacagccattatttaataccctgagcttcacttgtcctcgagaaacatggaagacataatgtaaatgagttgccttagttaatttgatggataaaattcaagccaagtcccttctctctgcagagcattcattgcccttaccttgactatgaaggagtgaagatggagtagtgtaatggttaaacacacaagctcgaaagtcagattgcctgaggtcaaacctataccatttatcttgtatgacctcagccaattaacccccctttctcagttctccattggtaagatggggataacagtatctactttatagagttgtaaagattaaatgagataatggtaaaaaaaaaaaaaaaaaaad

SEQ ID NO: 10558 - DNA, 337 bp, Homo sapiens
aaaacagcagcctccacccgccaccccaggaacctcgtgcttctaggttaccctgatggcaggacccactcccatcactaagagaacatcaaaagggcaggtgtgggggtggataggaagatcaggatctctgaaaggatgtttttcagaaatttgcattgtggtaacctacagactccacctggacccatgattcatgactcaaccagtccacccagaagctgactcagagcataaggagcattttccacacccctaggatttcatctccaaccaatcagcattccccattctctagcccctgtccaccaaactattctttaaaaaccttagctct

SEQ ID NO: 10559 - DNA, 403 bp, Homo sapiens
attgagccatgatgttgattgttggatgtcaagagtagataatgttgatgactaatggaagagtagtttatacagcgtggatacstgggcaaagagatggttcacattccacttggagtaggatggtgcaagatttcatcacacttctcagarcaacacacagtttaaaacttaatgacttttttatttctggaatttctcatttaaaatttttggaccacagttgactgcaggttgtaaagctctctgaaatagtgaccttagcgamsaagcacatgtggatgtgaaatttcagttgccaatatgatctgaaaacccagtggatggctgaaggtgttaaatgtgctataatcattaagaatactgtgttctgtgttattgttctktttctttttagtgtgtg

SEQ ID NO: 10560 - DNA, 319 bp, Homo sapiens
agtgtaattcgagttccctgtccatcgactgcaagtcctctctcctgcgccgcatgctgcctcgcgctccctttccttccccctctrcccccttccgcgatttactgtttcctcgcgcccaacagaaatgggcgaccgcaagtcttactctcgccggcgttacaaagaaaggaaggaggagacctgaacagtacatccggagaatccagcaaagcatactacggcatgaacgtgcaagtggacagaattaaaacacatgccagaaacactaatggattctaaacaagatgcagtttcatttcccaaaaaaaaaaaaaaw

SEQ ID NO: 10561 - DNA, 142 bp, Homo sapiens
atttggcagctgagtgaaggtgaagctcagaggtggatccaaacccaggctgggtttcctcgtgggtcggagatgtctgctttacttttattaaaacatcgtcccgatctggcacacctaaaaaaaaaaaaaaaaaaaaaaw

SEQ ID NO: 10562 - DNA, 385 bp, Homo sapiens
attacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcaca

SEQ ID NO: 10563 - DNA, 249 bp, Homo sapiens
aaagatgctccctggttctgtttttttgcttttgatgatgaattttgctgctgctcagtgtttaggtccgcactacctttttgagctgtaacactcacgacaaaggtctgtggtttcattcctgaagccaacaagaccatgaacccactgcgaggtaggaacaactccggacgtgccatttttaagagctgtaacactccagtggcaaaactctgcagcttcacttctgaaaccagcaagatcaggaac

SEQ ID NO: 10564 - DNA, 349 bp, Homo sapiens
gmctgtttcctaggagttctgctggagctacatgcctgaacaccaaccaataaccttttcatgtggctgagacctttcatatggccacagtcctcagagacagcatcccaagagtgatccttttaagaggctcaggtgcaaggctagtctagcctgctggacaatgagaggcctacggaacagggcggagtcaccatatcccactgaaactggcctaggttagccaacagcccacctctcccaggcacgtgaaagctcagcggactctgaacagatggacaataaacatttattgtgtttgccacaaaaaaaaaaaaaaaaaardaaaaaaaaaaaaaaaaaaaaaaar

SEQ ID NO: 10565 - DNA, 443 bp, Homo sapiens
  misc_feature 356: n=a, g, c or t
aaccgcagctcggkttccttccacgtggaagctgtgttctttccttcttcacaataaatcttgctgctgctcgctctctgggttcgcactacgtgtatgagctgtaacactcactgcaaaggtctgcggcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcganggtctgcggcttcattcctgaagtcagcgagaccaagaacccaccagaaggaaccaattccggagaaacttgttttaagcgtgagaa

SEQ ID NO: 10566 - DNA, 419 bp, Homo sapiens
  misc_feature 175,341,364,387: n=a, g, c or t
atacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagaccnrgcggcctacatcgaggagtttctacagcagtataatcactacaaatccaatgtggagattttcaaattgcaaccaaataaacccagcaaagaactagcagagctggtgatgtttatggcacagaacatcctaaatgtatgcatctgaattataggagagaaayrngagcaacttcagaagagcctttnsctttgttacagattagtcactngstacccagagtacctaagtaattttcctcaa

SEQ ID NO: 10567 - DNA, 328 bp, Homo sapiens
atcctgaagcacacagccatgagaaaagggctaagaactggaacaaaatggatttctttggagtagaaaagagggggtgtaccaatgatctgtcaagtgatgcgacactagaatcaggctggaatttggcgtcttacggctacaaaagtgtttcatcagtcttcaggtctctgtgctgatgttaatgctggtcagctgtgcctgaattccaacgggaggaaggaaagatgatgtgcagagacacagggagaagacggccatccacaagccaaggcgagaggcctggacagatctttccctcacagtcctcggaaagaaccaatccttt

SEQ ID NO: 10568 - DNA, 106 bp, Homo sapiens
tatggwtaccaacatctatggatgctcaagtccctgatataaaatggtggactatttgcatataacctgtgtacatcccgtattatytaaatcatccctagatcas

SEQ ID NO: 10569 - DNA, 575 bp, Homo sapiens
  misc_feature 259..260: n=a, g, c or t
atgattgtcccactgcattccatcctgggcaacagagcaagagtctgtcaaaataaaaaagaagaaaaaaagaagaaagattttaattatttttatcaacaattatacattttcagtctactgttatgaattgccacaacttggaggcttagaacaacacaaattagtactctcacagtcctgaaggctacagctctgcaatcaagatatcagcaaggccatcattccactaaggctctaaggaagaatccattttwtnntcttcctgcttctggtatgcatccactttattagacggcaaactagaaaatgcttcctacagtcgccacataaaaagttgcaaagactttgattcatttaaagtacatttgaatgaatgttcatttatagtgcttaactgacggcaaataatctgctgggctgcactggtgcacgggctgcatgcactctgtgatttggaacccttagtagttaggttgattttctcttccttcaattttctctgcttccctcttcttcgtgagcaaatgtaaaaccacttgtaagtttaatcagaaaaaaaaaattcattgtat

SEQ ID NO: 10570 - DNA, 523 bp, Homo sapiens
aagtgcagtggcgcgatctcagctcactgcaagctccacctcccgggttcaagcgattctcctgcctcagcctcccgagtagctgggactacaggcgcccgccaccacgtccggctakhttttgtatttttagtagagacggggtttcaccgtgttagccaggatggtcttgcactcctgacctcgtccaccctccttctcctcccaaagtgctgggattacatgcgtgascaccgcgcctggccctggtgcccttttaaaaacaggaagagggagagagtgatcttgctctagcaacacatgagaagaggcaacgtgagtacacagtgaaatggtggcttcctacgaggcaggggaagaagatgcggaaagcactgtcccttgccggsaccttctcaactggactccagatctgtgagaagtgaatttctgttgtgtacctgtccagtctatagtagctgttactgcagcccaargtgactggtacatgtggtttcccctaagacagttaagagctacgtgt

SEQ ID NO: 10571 - DNA, 559 bp, Homo sapiens
  misc_feature 488..491: n=a, g, c or t
gaggascatggttccggtggcttcaggcacagacttctgccaggcctgcagacagagctcaggataaagagccaagggtgtggcctgtctcgaggcccatagatgtgcgctctgcaggtggaatggccgtccggtgcttactttgactgtcctcgggtcccgagtcttctggtggttaactgaggaaactgctgccttatgatctagcagaggatgataattgctgttgcccaggacaaccacaccagttcacaagaaatccgtgaagagagagcatctctcaaggtgaaaacataaccatgaggcccctttccttggggtttacggagcmtgatgtttgtggagaggcatgacaggtcaggggttacgtgcaagaactctggaactcgactacctgaattgaatgcaagctcaggcattggttaggctggatgcycttggsaagtyatttagtatccacatgactcagtttccccatttgtaaaadnnnnktgataataacctctagagthattgtgaaattttaaaaagtgaatgtatgtaatagctggcagtagtg

SEQ ID NO: 10572 - DNA, 354 bp, Homo sapiens
attctgccccttgaaaatggactgtgacataccacaggcccaagtacttagatgatatgattctcctcttctgcctgggtcatggcaacaggaggatgaattattttagcaagcccagattacagtttcagatatgacagtcaacacatcctgaatgttgggtccaactacatgaggcacgtctcatcagtgaaccagatctatgcgtcatagcctcaattcctattgcatgttgtgttgacttaatggagtccagttttcttggtgtgctgaatcctggtctgagagtcacccaacccacctgtggaccacatttatgtataagagcytttttaaaaaaaatcttctgactgc

SEQ ID NO: 10573 - DNA, 296 bp, Homo sapiens
gtttgagacccagcgtctctagatctcgtatttgaatttgtggcgcttggtgtccgcgagttgccgaatgaagctgagcgtctcagtggaaccagggatctcagggaggggaaggtataaaattttcaaatggaggagtatacctgaacctaatcatggatgtgattttatgtaagtaatatgtgagatacagataagctgattctaaaacttacaagaatggcaaagaaacaagaagagcttaaactgcaatcatcaacagagaagctttctgcaaccaaagtgaagactgaagc

SEQ ID NO: 10574 - DNA, 271 bp, Homo sapiens
tttttttttttyccccyccacaagggycawagrawyctgttgaaaaatttactgtggcttgtaacacctcctcggtacccgttttcgtgttggctatgttggctaagcaaaaaggagttcgtraaaagaaaactggaccacaggaktggaggaagaggtgaaratgtggaaagcccagagagttggagatttgagagaaggaagaaagcagttaaggtcagaaatctgacagaggtcccactgggctaaaatcaacgtgtcttcagggatk

SEQ ID NO: 10575 - DNA, 90 bp, Homo sapiens
aaaaacaagcctgccatggccacctgtcggcagtgatgcaactgctccccggtacagctatttccaagattcsagatttcgcattttttk

SEQ ID NO: 10576 - DNA, 353 bp, Homo sapiens
  misc_feature 353: n=a, g, c or t
tacggccaagatccaggggatggcaagttcttggaaaagcaagaaagccctgtaagctcattttacactgagaacatttgcccattcagaagaaataaagctgaagaaaatagcttgtgtttgacacctctgggaacaagcaagtggaaactcaagaccaccttaaggagggcagcttgataaacacgactttacttgcatgtgcctgcagcgcttaagccaacttggaatcaggcaaaagaacaggggatgaagtttgtgattcaccgattaataaggctgaattaagtggaagaaaagagtggagagatggtaataaatgagatgactgtccaagttcttcaaaaactctn

SEQ ID NO: 10577 - DNA, 314 bp, Homo sapiens
atgttgttgccccattctgaccstgagagcacctggcaggtatgtggaaaaaagaaatgtgcattaaaacagagacactgataatcaagttatgggaagctctggggtggtagaagattgttacgcaaatgcatgagacaaagtggaagaaagagagagaaagacaagatcattccatcccggaaatagacagggtatgatataatgaaaagagcatggagtttggagcaagacctaagatcaagattctgtttctctggagaaccttgacttatgaaataatgtcacaccttcttcagaatgttgttatcctt

SEQ ID NO: 10578 - DNA, 119 bp, Homo sapiens
agtagcgtatgaagtgcgacgagsaaggaatatagataaaaatgaggggtagaaggtggtcaataggcagcaggcaccaaggagatgctatacacgtataagcaagataaaagtcctch

SEQ ID NO: 10579 - DNA, 351 bp, Homo sapiens
actttctagtcaaaactctaccaattgccagtggtgaagctggtataagccacgtatctctgagccaattttcttatcatcaaagtgaagacaatagcaccagccataccttccttagggcgttttgcaggctaaatgagatagtgggcaattgaaacttgttgtcatcaaacaaggtgaagagactgggcctttgagaataattgcatctctatagagaaatcatgcttttacagaaaaatttctgtaggatctcacctatcaggtccctcgttggctgctcgtcagattdctctcttcaattccaagcgcatcttatgtaacaatagtgtctatgatagtggatgtgat

SEQ ID NO: 10580 - DNA, 80 bp, Homo sapiens
  misc_feature 26: n=a, g, c or t
tttggcaacccgctcgagtccccttncacgctgtggaagctttgttcttttgctctttgcaataaatcttgctactgctc

SEQ ID NO: 10581 - DNA, 361 bp, Homo sapiens
aaaccaaagtacaagatttagactatgctatccttcatataagaaatgggcaataagaacatatacatatatctgcttatttgtacaaaagaaatacaggaaggataaaccagaaactaaagagatcagctacctacaggggataggtgggaaagggataaaacgaaatgggaatggatggtagggataaggaaggagtgatatttctctgagtatatctttgtgtatagatgactcaaaaccagagtaatgtagcgcataccaaaaaaattaaagaacccagaatacaaacagtaacaagtgaatctaactgcgttacaaaggrrtaacatraccacactgaagggcatgaggaagaaac

SEQ ID NO: 10582 - DNA, 306 bp, Homo sapiens
gacactaaccacattctaragttcattacatagagctgtgtctatggttttgatgtggacaatggcacatctgcgggacggagctttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaa

SEQ ID NO: 10583 - DNA, 535 bp, Homo sapiens; identical to SEQ ID NO: 10397

SEQ ID NO: 10584 - DNA, 57 bp, Homo sapiens
tacttgtcgaggtttgttctcccttgtgggtgttttttaaatttttttttttttttt

SEQ ID NO: 10585 - DNA, 511 bp, Homo sapiens
aaaaaatgtcgttcctgtgggaaatctcaggagttctgtctcaactctagagagaataaaaaaccttaggagcaaattgaccatcatacagaaactgttaagacatgtggcaggcaatttaatctagtggaatatgcaaataggatttctgaatttggcatgcaaatgaatttgagagcttctgggagcatctcttccaagattctggtaagcctttcttcctgggcgaaacttagcagaggaagttatagagaagacctaagaaagaccaaggagaatttgtgtcactaaaatttgaagctttgattccgaaattttactcagcctgagttggtcatttgacttttactgctatcaacttgggagttaagtcttaaagaagaggaacagtgctgtttattaaaaggatcagacaaggagtaaatgtggaatgatcactcttcccagacctaattgactgcaggaggaacagtctgaaattggggaaaacatcacactacacctatacctt

SEQ ID NO: 10586 - DNA, 116 bp, Homo sapiens
attgatcctttggtgtaaaatcaattgagagtatgcttgataaatttaaaaaatgcaaatatggctaataaagtgaaaaaataataaaaaaaaaaaaaaaaaaaaaaaaaaaaaaa

SEQ ID NO: 10587 - DNA, 312 bp, Homo sapiens
agaaacaggggtcttgctatgttgcctaggctggtctccagctcctggcctcaaatggtcctcccacctgggcctcccaaaatgctgggattacaggtatgaaccactgagttatcctgtcccacagcttctgaggaggggtttcctgcaacaacatttatcttaattctggagtttccagggaatggtccctggagctattttcagagcagcccctgtgtgaatgcctttacacagagaaggcctgcttttccttaagcctatcaaattgcttcattaaaattttatgtvrccgacaaaaaaaaaaaaaaw

SEQ ID NO: 10588 - DNA, 591 bp, Homo sapiens
attgggagctcatttcttgccaggccctgtactaggaattttccttatcctgtttcatttactcttcctaactaacctattgcataagaactatcattatcgcaattttatggatgagagagctgaacacaataggtgaagcagaaatttggtgactgcaaagtctatgattgtaaccaaaatatatatatttwtwtawtgcaagtgtgagtcartggttcaaggattgtgcaataggctagaaggaaagatattgaatgtaggtaatatttaacagggaattactgtttccaacaatagaccttagcagcattagcaagaggaagagcagtggacccaggagagcttggagaggggctcagtggtgggagactgaggttagggttagggttgaagtgcaatctgacagaagggtgggtggagacagtgttgagtctgagcttctcctcccccacaatttctctttcttcatcccccctctacccttcatctgtccacttacacaaattccaactaagaagagataaccgaaacttagaaaaacactgtatttcatatatttgaagcatacgtgatttctctctacatctc

SEQ ID NO: 10589 - DNA, 503 bp, Homo sapiens
cagctgcagaatatgcattcttcacctcagcacgtgaaacactcttcagaaaagaccatatgttaggccacaaaacaagtctcaaaaaaatttttaaatagtaattatatccagtattttctcacaccacaatggaataaaactagaaatcaataacaaggaactttggaaactgtacaaatacatggaaattaaacaacactctcctgaaagactgttgggtcaatgaagaaattaaggcagaaataaaaaaaattattgaaacaaaaacagcaacataacatactagaacctgtgagatacagcaatagcattgctaagagagctatttatagcaataaatgcttacatcagaaaagtagaaagagctcaaataaacagtttaatgatgcatctcaaggaactagaaaagccagaacaaaccaagccccaaatttagtcgaagaaaaagcaataaagatcagagcagaactaaatcaagtagagactgtaaaaataataca

SEQ ID NO: 10590 - DNA, 572 bp, Homo sapiens
aaagagaataaaacgaggctgcccccgccagcagtggcaacctgctcgggtccccttccacactgtggaagctttgttctttcgctctttgcaataaatcttgctgctgctcactctttgggtccatactgcctttatgagskgtaacactcaccgcgaaggtctgcaacttcattcctgaagccagcgagaccacgaacccattgggaggaacgaacaactccagacgtgccgccttaagagctgtaacactcaccacgaaggtctgcagcttcactcctgggcttgcgagaccatgaacccaccggaaggaagaaactccgaacacatccgaacatcagaaggaacaaactccggacacgctgcctttaagaactgtgacactcaccacgagggtccgcggctttattcttgaagtcagtgagaccaagaacccaccaattctggacataatatgattgaaacaaactcgcaagttgaaggacagtagggagaactgtggtcacctggctagacagcactctagctgctactcaaggtgaagcacattgctgtcatatgagatcaggagc

SEQ ID NO: 10591 - DNA, 491 bp, Homo sapiens
gtatttctgctggccagagacgtcgcgtccctggctgggcattcagtcacccccaggaaaggaggtgtgcctagattgatcggtataaggctcactctcccgccccccaaagtggttgatcgttggaacgagaaaagggccatgttcggakgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgga

SEQ ID NO: 10592 - DNA, 127 bp, Homo sapiens
gttgtccctccaggagggggtccggggcgtggggactgatttccgacctcccgggcccaacgagccgtgctgaaacgtggcgcctcggaggaggctgagattcctgcaggtagacaccaaggatctc

SEQ ID NO: 10593 - DNA, 370 bp, Homo sapiens
atcctctaattctgatgctaaagttctgattccatttataagccatcatctcatctcatcttctatgcagtgcacgagactctctgaaatggatggagtctctccctgtcgcccaggctggagcacgatggtgcgatctcggctcactgcaacctccgcctcctgggttcaagtgattctcctgtctctacaaaaaataaaattagccaggcatggtggtgcatgcctgtggtcccagctacttgggggctgaggtgggaggatcagttgaggctgcagggaggcgtgattgtgccactacactccagcctgggtgacagagagagaccctgtcacaaaaacataaaataaaaaaaaaaaaaaatgsgaa

SEQ ID NO: 10594 - DNA, 607 bp, Homo sapiens
atctgtttatagaccaatggtagggttgtagttgctcttgtctgatgaaattggagakawacatgaggtggaatactttccttagaaagttctggatggtaggwagtccaagatgaagatagcagaagatgtaacatcctgtgagcgctcactctctgtttcaaagatggtgacttttctgtgtgtcttcacatagtgaaaaagactaccccaaactggattatttataaagaaaataaaatttctcacagatccagaggccaagaagtccaatatcaaggtgccagcagctgtcaaggggcctcttgttgagtcatccatagtggaaaggcagaagggcaaaggcacatccatgagagagagaatggaaacagttcaaacttattcttctatcaggacccactcttgagataactcacgcctatgataatggtgttaaaccactcatcagggcagaggtttcatgatgtaatcaccctttaaagatctcacctctcaacactactgcatcgaggattaagtttctaacacatagactttgaggaacatattcaaaccatcacatataagatagagtatgtgtgtgtgtatatatatgatgaatata

SEQ ID NO: 10595 - DNA, 447 bp, Homo sapiens
caaacgtrdcwraaaagtatttcttccctgtatcccagagccttctcttcattctctacatcataacttcttatacgccatgcagatttatcaacaggaatttatgatctgcaatattaaaaatgttccgtttgtggctgttgaacatggaaagatgtggatactcaagatttctattggggaaaactgtggtccttagtaaagatggagaaaatataatgttgaggctccattcatgtgttccattagctgtatgctgaacaggattaaggaattgcttatttaggtcgggcgtggtggctcatgcctgtaatcccagcactttgggaggtcaaggcaggcagatcgcctgaagtcaggaattcgagaccaacctggccggcatggtggaacccgtccctactaaaaatataacaattagcctggcgtgatggcaggcacctgtaa

SEQ ID NO: 10596 - DNA, 532 bp, Homo sapiens
  misc_feature 246,351..352,457,475..476: n=a, g, c or t
tgaaatatgagctgagattgtgccactgcactccagcctgggtgacagagatcctgtcatatgaaataatgaaatgaaatgaaataaatgaaatgatgaaatgaaataaaatgtgagctgagattgtgccactgcactccagcctgagtgacagagtgagatcctgagtgagatcctgtcatatgaaatgaaatgaaataatgaaatgaaataaatgaaatgaagaaatgaaatgtgaactgaghntgtgccactacactccaggctgggtgacagagtgagatcctgtcgaaagaaatgaaatgaatgaaatgaagaaatgaaatgtgaactgagattgtcccactgcdnnccaggctgggtgacagagtgagatcctgtcgaaagaaatgaaatgaaatgaaaaatgaaatgaaatgatgaaataagtgaaatgaaatgaaatgaatgaaatgankvaaatgtgagctgaganngtgccactgcactccagcctggatgacagagagagatcctgtcatatgaaatgaag

SEQ ID NO: 10597 - DNA, 445 bp, Homo sapiens
ttttttctaaataatatgttcagagattcggactgaatgcaattgcaaccttctccaccagtcagcaaacactgagaaagtttcctcatagtctacttggcagttgcagctgtccctagaatgagtcctgaaacctagatctgagttgcggtagaaagcctattacttccttgcttgtttgaagacagcctactgtaagccctatggcttggaggtgaccaggctctccaggagaacacttcgagccctctttgccctccttccctgccccctcttctaggggagtcagatcgagttgtaaggagaacatgcccactgtctcgatggctgcagcgtgcaatccatacagacggtgaggatgcaaagagaaagtggctgcctgcaaaccaggaggagagccctcaccaggaaccaatctagctgacactttgaacttggacttcaa

SEQ ID NO: 10598 - DNA, 50 bp, Homo sapiens
aatctggwcggtccgaccgcctcgtgmttgrtgggtttacaaactctgac

SEQ ID NO: 10599 - DNA, 453 bp, Homo sapiens
aggacaccagtaaatggcgtttcttccaggggtacagtctttctcttccatttactctctgcccctccacccagtatctgtcggaccaggagaccgattccttcagcgtccaarctttcctgactgctagtcctctaaccaaggctgggacgtaaccagcggaatsgtgagaacggggcttcccgtttagtcgggtctccaggatcaaaggttccgcgcgctgagttcgcgacctcgagttgtaatctggcggggcgcacttaagccggcgcaggccttcgcaagatggcggctggaggcaagggcataggcctttcagagcgttttcttttttccctttcctcccttcctgcaaacaatacagccctttcaaggagcagtaagatccttccagcgctccgtaaccttccgcctgcccccgggaagtacgaaagtccggtctcttggagccgc

SEQ ID NO: 10600 - DNA, 425 bp, Homo sapiens
  misc_feature 307: n=a, g, c or t
atcccctgaagatgcatcccaaaccgatctgccgccgctcctcatttctccatgtttaatgttcacggttcacatggaagtcagaggatgattccttcaagcccttccccacagccattcctatgaagtgattcattcttttgtcttccagccctcaccatgacttagtattttcgatgtctcacctcaaatcccccacgctagktggctacatttatttattggcggagatgtgaattatcccatttccctcctacagttccttcacatgcacctcgaagaccatttacttttgggctactgccangcaaatttcaacccacgttcttttacccaatgtccatgtagttcttttaagtttcctatctccaatctgaaataatggccttcagtctgtcaaaactttagtgaataaacattcttta

SEQ ID NO: 10601 - DNA, 443 bp, Homo sapiens
  misc_feature 239: n=a, g, c or t
ttgccatcagctattgaaatcactcctgactcgttcctgtcacaccagtgtatttaaagtttcatgaagttagttcacgtcattagcatgtttgatatggtggagcgtgtggagcctggtggattttaatatttcacagcatgttctgtgaccttgaagtagacgccttaagatttagcagttagttcactgtggaaagatgctcccatgagtccccccaaagacactgatttgccctnggttatgcttctkagccactaattcttkggattagtttgacctaaagcattgctgtctgtcagagtatacctttgtgcatttccttccctcaccaaagtgccggcttkacadawggcttcttaattggtgtggacaaaaagtaatatccctgccatagtagtctacacatttcacaattcacgttcgatttcagcatatggatt

SEQ ID NO: 10602 - DNA, 482 bp, Homo sapiens
cagaaacaaagcaaaaagcaggccacagccttaccaacaccaaagaaacatccaagcaataaagtggaagacgaaccaagatttggacattggaatgtttgctgttattctttaagaaacaactacaaaaagaaaatgtcaacaaatttttccagcaaactgagaacctgggaattcctgcacagaagacaagagagcagcctccccagtttcagcaagcgctaggtttatatttttttcctggtttttactgtttgggtaatagatattgaaacaagtaatattaataccgcatggggagaaccccaaccaaagaaatctgaaatataaaataaatgcttttttttccgtttttgttcattttggatgctggcgctaagctccaagtgtcatgattaaaaaaaaaaattatgtccttatttatttctaggatgaggggaggataacatttttgctttcttatgtgactctcttggaaaatg

SEQ ID NO: 10603 - DNA, 494 bp, Homo sapiens
aaggtcsaggctraggtcggkctcagatggagatgaggaacttggttgggagctggrgcagagacaagacttgctcctccttgcsttccaccatgattgtgaggcctcsctagctacgtggaastgtaagtccattaaacttctttttcttcccagtttcaggtatgtctttatcaacagcatsaaaacaggctaacataccatctcgactctcattaccactctcttgtcggtatttactcacatcatgcttgactgattyaagttgcctatatgtattttattctcactcagatcttgctcctttacctgggtaggtcctactcactctacccatatgaagcaatgtctccagcaggagttcttcccagasttcctcsaggctgggttagaatcctctcttatagcctccaaaagcactatgtgattctctctctcatagtagttgtcttactatagcagatcaatatactttcattggtagaaccaggtta

SEQ ID NO: 10604 - DNA, 480 bp, Homo sapiens
  misc_feature 474: n=a, g, c or t
aacagatatagggtgaatgtacatgttttcatttcacatataaataagggagtataggagagaagctaaaaacaggctgtggatgcaaaatgcctgggttgaaatcctacctgtgactgtgggcaaatctcttaatgtctatgtgcctcagcttcctcacagggtagagtgaaatactgctcaaaatatttgccastgcatcctgggagagaattatcgtctcctgccccattgtattcagacttagatgtgtgccttgctttggctaatgatgagtgtcagagtgacgtgctgcttcaaagctgtagcattaagagctgttctgtagtgccatgatctctcttgcctctgcttgaaaactcagaatgtcctggatggaggccatcccctctacctggtcccatggaacaagactgctgctcacccctggtggacacagtgtgakcaagarataaacttctgtgtgtattagcnctaaaa

SEQ ID NO: 10605 - DNA, 407 bp, Homo sapiens
  misc_feature 255,364: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaagganaaaatgttaagggcagccagggcgaaaggtcaggttacccacaaagggaagcccatcagactaacagcagatctctcggcaggaaccctwcaagctaggaaagagtaanggccmatactcaatgttcttaaagaaaagaattttcaacctag

SEQ ID NO: 10606 - DNA, 472 bp, Homo sapiens
  misc_feature 399: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtganactgtgcctagcctgagccaccacgccggcctaatttttaaattttttgtagagacagggtctcattatgttg

SEQ ID NO: 10607 - DNA, 303 bp, Homo sapiens
  misc_feature 91,143,150,192,270: n=a, g, c or t
cctccaggccgcagcggatctggaacgactttctcagctgttcctccacggccttcgcagcatcaaagtggctcccggctgcggcccgcmntccaggcccaaggcaggctgctcttcagcacgggcatctccagctcctgcgncaccgsnctcggctcggaccgcaccggggagggcggcgtcaggcggaangggacctgggagcagagggcagtgcagtggaccaaggaagtgctgtgggaacatcagatagaatgggwtagcacaghngcaaatttttacaaaaaaggattttaaaggaag

SEQ ID NO: 10608 - DNA, 250 bp, Homo sapiens
atatagaatcccagccttatttcagtgcagggtagggtgtcaaatatgaaatgtaattctacagggcaattctattttggtaaaagaagtggggagaaaagcatcaccagccagctttttraatttttaccacaacctattttgtgatccctacgtgtcatttcttcagtatattttttaaatgttttaaaatatacgaacatggtgagatttttaaaaaaaaaaaaaaaaaaaaggaaaaaaaaaaaaa

SEQ ID NO: 10609 - DNA, 87 bp, Homo sapiens
atsttkacccaggactgctactctcccaagcagtgagawaaatccatttctgttgtttaagccactcagcctgtggsattttgttat

SEQ ID NO: 10610 - DNA, 464 bp, Homo sapiens
aagaactgcttgaaagtagcacccacgattttcctgcaggcatttttgttctatttgatactaatgagttggctgtgtgggcagtgagttgataaaggaacatgaactgaatcattaagcctccattttattgtctccactgtacagatttcacaactgacttgggtgaggaaattccaccaaaaactttaatatggaaaaaaagagaaggaaaaaaaaggcaaggtatctctaaatagctctgcaaaggtcaatgggattaatgtatcctttgaacatggttattttagctgaaataagaaaacagcatgagggaacttcacagactacttgtgtaatagaaatgtaatgtatttgccccttttttcttcctttgtggcaaacatgtgattacatgaagcaagttggtagaataaataaaataaccaagaaattgtgctctggaaatgtgttcattatctgta

SEQ ID NO: 10611 - DNA, 391 bp, Homo sapiens
  misc_feature 315: n=a, g, c or t
actatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctstcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatncycctcasccccacgccccgcccctacaacctaagtcataaatcctcttcctccctcctttaaaaaaraaaaaaaa

SEQ ID NO: 10612 - DNA, 447 bp, Homo sapiens
  misc_feature 112: n=a, g, c or t
actcaggggtcagggcatcactggtctcgcgtgcgcgtgaccaggcccggtttccggtgccaggacctttccgaagcgtcgagtagcctaacggtcacagctgtcgcccaanggagaggcaggactactgcgagcagttttaccgkamcctccggaggccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgcaggaaccgaatattgtatctgacgcatcctgtaatactgaagagcaactgaagacagttgatgatgtccttattcattgccaggttatatatgatgctctgcaaaacct

SEQ ID NO: 10613 - DNA, 338 bp, Homo sapiens
ctaattccctgagcaataggagtgttaggaacaaagaacattttgtggccaggtgcagtggctcacgcctataatcccagctctttgggagaccaaggcaggcagatcacgaggtcaagatatcgagaccatcctggccaacatggtgaaacccgtctctactaaaaatacaaaaactagctgggcgtggtggtgtgtgcctgtagtcccagctattcaggaggctgaggcaggagaatcgcttgaacccgggaggcagaggttkcagtgagccaggattgcgccactgcactccagcctggtggcagagcgagactccatctcaaaaaaaaaaaaaa

SEQ ID NO: 10614 - DNA, 437 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaagaattttcaacctagaatttcatatccagccaaactaagcttcata

SEQ ID NO: 10615 - DNA, 480 bp, Homo sapiens
  misc_feature 462: n=a, g, c or t
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaaaaaaaaaaaagaaacwttctgtaatctgycaaggtaatggaawttawtscaktgacactgacaatawtttaaagcattttaagggctcttaacgttcatctmastcgytctagaktgaaggagagascagagattacagascaggtcstaggtcstcccccagatatanaaaaaccgcatttggaga

SEQ ID NO: 10616 - DNA, 503 bp, Homo sapiens
attctaacctggaaaacagccgcaacggtaacagcaaacaggactgcttccctcgcgccagtcactgttctgagggcttcgtgtaattaattcatttaatttggaagtctgactaacttatttttgccaagtctcatcaaatttcagttggaaatcaaggattccagatgaaatgtttggctttagtctgtttatttcacctctaataaattcaggcagaggaagagaactaccagacccgaagaggaggcgtgtgtttatctctccgtgttcttaaccttgtttttcctcttgacgttttcccccagaggagtgtgcttcagttgctgcactccacgagcgacgtgtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttagggccc

SEQ ID NO: 10617 - DNA, 556 bp, Homo sapiens
attgtatggggcaattttaagtcagctaaggcaataaccttatgcatgaacatttcccagactttcatgaagctgttgaggtcctataaaaatttaaaaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaatgagtgaaaatgtttaata

SEQ ID NO: 10618 - DNA, 563 bp, Homo sapiens
tagaatcctattattttttaagaaggaaaaattggacagcctcctgagccagagtaggctcggagactcctgttgtttctaactgaaatagtaaataatgtatttccaccatttacccagagtaggctcagagactcctgttgtttctaattgaaacagtaaataatgtatttccaccatttagtagcttttcaagagtccttaaaaatttttggacagcacagaaacatggattacttagccctttagttctcagattgagttatatacttcccagcaatttctgttatttaagattgccatctcatttctggtgtaatacttacatggaagtctttctctatttgggggtggtggggttctggcacataggaatttcttaatggcagaatattctgaaattctcggcattaaagtatacttgataattagttcacttaatattaaagcatgttcattcttttcttcccaggtcgctattaaagcatgaagactttctgaacctgccctagagctgggatattgtttgtgggcatattttttattgtctcttgttaaaaagc

SEQ ID NO: 10619 - DNA, 454 bp, Homo sapiens
ttatcatcaaaaccaatcacttatttgcaccaaagtaataagtaagatggtctccaggattaaagtcatcagtggccataaataaatatgtttaactttcacatccagatatacttcattttggccaatgtgatggaggataccaatcagagggagagaactactgtttgtaaactgttcagcttccgtgatggtggtgttcacctaggctgtggtgcaccttgacattggaaatatgcttgatgtgtcgtttgtgttgtcactcacacccactctccaaggcacttaaaaagatttatttagctcttaagttttaacgtctatattgagatgtaattaacatgctgtaaaattcattgatataatgtaatgatttctaatatattcacaagagttgtacaaccattaccactatctaattctagaacatttttgtcaccccaaaaaaaaaaaa

SEQ ID NO: 10620 - DNA, 536 bp, Homo sapiens
agacttttaaaaatctataaattgatcatctgtttataaattggcagatggttgtgtaccatcttttaaaataaagattgaatttcacccagtgtgatggttcccattgcttatatttctcctgctgaggccggacctgatatggccctggtctgtgttcccagccttgtttcctcattaccactaaaatctttcccctgtatgcccgcccaatttttctggctctgagtccttgttcatactgttctctccaattctaccttccaaaggcctttcttaacaccttcggattctttctttgagaactttccagattcccatgcctttttggaatcaatctctatcctattgtcatcacatttaagtttctacttccatcatcctcactcctatccctttggtcctgggatgacagggatgctgtgttttatttactcatctttgtaacttccacataacctaaccccggttcttgcttatgggagatgctgattgtagggtctgagttagatactgttaactaaatgcttgttgat

SEQ ID NO: 10621 - DNA, 470 bp, Homo sapiens
  misc_feature 230,364,371,455: n=a, g, c or t
gggaagaggcacatgtcacacgtgcaagaaggtccaaggatgagattaaaaattccacaaaggtccaaattctagggcccagacagaagagaagagtcacatcatctagatgatgaatgaaaagatatgtcattattctcctttgggcagtgcttctgcagaaaagttgcaccttctaggtgttggactcagcaatatatcacaatgtctgcagtattttggaaggagangagagtcaccattacttaggtgctaggcccagcaatacatctcaagcacttcttgggcaaagccarcagtaaaaaagagtcacattacctaggttctgggtatagcaatatgtcacaaatgcccctaagaaganggcccangaaaagaagagtcaccttggtgagaatgtcagagatattccatttttgggtattcacaaaaaagaataaagtcccataacctanaaaaraaaaaaaaaa

SEQ ID NO: 10622 - DNA, 438 bp, Homo sapiens
agctaggccccttcctcctccagtgcctgtctacctatgtttgatgcttggggctagaaagactgaccttgtagcccctcaccttctctccccaatgcactgggctggttcagcagctgaccaatgagggtcatgcttgcatactgghcttgggtgagtggctcaggaacagtttgcaagaccgtgttgaagctacttgtaactagaccattttcccagcttgaccatgagcttcttcaaggcatctcttctcagtctccactgtagctctgtggggatgctaaccctggcttccaaggatctgaagaggaagctgcggctgtggactgtcccttttcggtctgtcttcatcctgcctgactcacgggtctcctgtcctcctgcatagcttgcggtggtgaggtgatggcagccatggacacaggcccagagagstga

SEQ ID NO: 10623 - DNA, 451 bp, Homo sapiens
aacccactccggaacccttccacgccatggaggttttcttcgttcgcttgctgctgctcgctctttgggtccacgcgacgtttatgagctgtaacacttactgcaaagatgtgcagtttcactcctgaagtcagtgagaccacgaagccacccgccgcgagaaaggaacaattgtggatgtgcaacctttaagagctgtaacactcaccgtgaaggtctgtggcttcactgctgaagtcagtgagaccacgaacccagtgggaggaatgaacaactcccgacgggctacctttaagagctgtaacacttgccatctttaagagctgtaacacttgccatctttaagagctgtaacactcgctgcgaagaatgaagaacgtccgacgtgccacctttaagagctgtaacacggctgggcgcggtggctcacgcctgtaatcctggcactttg

SEQ ID NO: 10624 - DNA, 529 bp, Homo sapiens
tcacacaccccaacacacacgccctgtcccctttctccaccctgcaagctagttgcatttagctcacagacctgggctgcgacttgaaagagtttaggcagcaacagagtgaccctgggggtgctcttgaccgacagccgcacccccggcgtctaggacctccgagcagggatgcatctgtaggtctagggaagcacttccaccccctcctctcctcaatcctggcaggatggctactgctgcttcaagacagtgacgtttctctccggtcagctgtcaggagckctggtgagcttcctactgtgccacaagctgggtcttactggggatctggccagccttgggggcccttggagccctggcccagtggaagctcgtgcctgaggaacatggaggccacgctaatgagacagggtctccctatgttgcccaagctggtcttgaactcctgggctcaagtgatcctcctgcttcasctcccaaagtgctaggattatascaccgaacctcgtcttkaatarccttttaa

SEQ ID NO: 10625 - DNA, 512 bp, Homo sapiens
  misc_feature 14..15: n=a, g, c or t
gctctctccaagtnnsccctcagaatcgbcccacccacttccaacccctccccatgtcagggaaaaaaaactccaaaacaactagggcgaggcttgctgtggcagtgagaagctgagaaagagctggagggtctggtgagaagtagagaacattcaaggccttccttccactaagataggaactgtggctaagacagaagaaagaaggtcagatgtttgaatggactttctggatttgataaaatgtgacactagtggaaacatttactagggacaacttttgagtgtcagaccctgtggacacaaagaaaaagcttgggttcctgccttcaaggggctcacagttgagtggggaagacagacacgtaaatgaagaacaataacagactgtgctgagtactggaatggaagtgcagcaggaactcagaagaggtcatcactggaggggccacctctgggaaggcttcaccaaggaagtataattggagctctgtcttgatgttcaaataaga

SEQ ID NO: 10626 - DNA, 562 bp, Homo sapiens
tatgttttaggattttttgactttatgatgggtttatagggatgcagccccatttcaagctgaggagctccttagggcttaggaatcatacctctttcacaccatggtaaagttggaaaattgttaagtcaagctgtcattaattaggagactgctgtgttgctaacgttatatgcatttttaacttatgatgggtttattgggaattaaccacaatgtaaatcgaggaccatctgtatattgtatgatttttgctaatgcattgagagagatctgtgtaaattatctatgacttcagaatatgcatattacctccaactgtgttaactcaacgtttttcaagagagtaagggtactttcaccctatgtggatgtactgtagaatttttctaagctacgaaagtctataaataacaaatcaacttaaactttttgggaaataatttctactaaagattcataatcggcgtattccttcaatgactgtacaagttcatccagtagataatctccttgcataaaagttcaagatcaaaaaaaaaaaaattcgaaatttcgwtcs

SEQ ID NO: 10627 - DNA, 337 bp, Homo sapiens
  misc_feature 310: n=a, g, c or t
ttccggtgccaggacctttccgaagcgtcgagtggcctaacggtcacagctgtcgcccawcggagaggcaggactactgcgagcagttttaccgcgacctccggagccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgataaaaacaagaatacctacttacngatgaagatgacaacactattctttat

SEQ ID NO: 10628 - DNA, 501 bp, Homo sapiens
attattagtacttcagaataggttcaatactgtctagtttctaggagtggaggaattgaagggcttattaatctttttaatctggatgagggaagtaaggacttaaagagttagtaagggagaaatataaggttattgttttatgatatgcaatggaaggtatcagtgaagattaatctgaggggcagtgttattatctgagagaacagttcaaattaattatagttgtcacttcccataactcaactgaatgtggttcagtttcttgtgacaggtacatagcttacttgaaggggactgggccctggagttataaccatcctttggctaggacaggtgttgaggaaacagctgaagcyttaagtactatataggtatagacttccaccaccattccccccacaacatacctctcaaatctscaagagatttgatgcttctgggatgagtagttaacmagaaaaagttcaatgtgaggtaataataaattgtccaacagat

SEQ ID NO: 10629 - DNA, 489 bp, Homo sapiens
  misc_feature 152,154: n=a, g, c or t
attgaagaaataatgatggaagattttccaaatttgaaaactgaactgacaagtttgagaagttatccataccccaagtagaagaaacaccatgctaaaatgtatagtaatcaagttgttgaaaactggtgataaaaatattaagtgcamsngnaaggaaaaaggcacattaagtacagaagaacaaagataggaataactgtcggaaacgatgcaggccagaagacaatgtagctacatctttgaagtactgcagaagaaacaaatttgtcagtagaaattctatacccagcaaatatatctttcaaaaagtaaggctgtacttttccagacaaacaaatgcatcaccaacagacctgtaccagaagaaatattacgtgttcttcaggcggaagaagaatatcaaatggaaatgtcagtctacacaaaggaatgaagagtggaattgctctcatttttttcatacctctagaagacaggtgactaagg

SEQ ID NO: 10630 - DNA, 281 bp, Homo sapiens
atttttattattagctggctatgaaggaaagaaatgcacttaattgggtaaacagtttatttcttatcttcttttaagctttctgaacgaacagaatttggctagctggttttctacccttgaaagcataaagaagcttggactgtctgaaaatactcttttctgggagtatgtwcgtagacaactgaaataaactgcaactcactggtgccaaatatatcacacatcagcccacctcctgccacggtgagcttgtagcagagaaaagaatgttctcaggt

SEQ ID NO: 10631 - DNA, 400 bp, Homo sapiens
  misc_feature 109,212,393: n=a, g, c or t
taaaggtgtatgtttttaatgtakaatctgtgtgtgcccccattaatattcttatttaaaagttaaggccggacatggtggcttacaactgtagtcccaacagtttgtnaggccgaggcgggcggatcacttgaggtcaggagtttgagaccagcctggccggcatgatgaaaccttgtctctactaaaaataccaaaaaaaatttagccangcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaangcgttav

SEQ ID NO: 10632 - DNA, 511 bp, Homo sapiens
  misc_feature 438: n=a, g, c or t
agtttgtgcttggtcgccagaggaggcggtggctgaggagagttgagtccactgctgaccctgttttacgttctgtgacccatgcccccgtagagtaatgacagaacatagcacctctgcctgcatggatgctgccatgataaccctgtctccttcttaccactggatatgaagattggcttgatgaaattgggacaaattgttctccagaataccaggtccatcttctccattctcctgctttcccaggtgcctgccacagtgcagcctggtactctctgaaagcagtaacctgaagccttactaggtctcaatcattgtttcacatcactcaggcactacaagatgatccaggcaaatttgtgtttatttcatgcccaagccaagtatccaccatttcttcaaagagtcgctacagggtcatctgttgactggggnccttgttagctgacacagcaaagaaatatacctgtgtatactaacacacacatataaatgtatctataatatt

SEQ ID NO: 10633 - DNA, 374 bp, Homo sapiens
  misc_feature 107: n=a, g, c or t
ccatttctgtaaaaagtattgttgggattttggtggggattgcattgaatatgtagtcacattgggaagtattaccatcttaatgatattaagtcttccagtccatnaacttgggatttttccatctatttagatatttccttcagcaatgttttgtgatttttagtatatacktcctgcacctctttggttaaatttatcactaagtatttgatttttttattctactataaatggaattgtttccttaatttcctttttagattgtttactgctatttatagaaatacaacagatatttgtgtattgcttttgcataartgtaacttctgctgaatttattagctcaaataatacttttgtggatcttattc

SEQ ID NO: 10634 - DNA, 487 bp, Homo sapiens
agataagactctgtctaccctgggcagctttcctgatccatggcagtctggcttacaagcaatactaggcttctattgtctctttctgtatatttataagaaacatggccaggcaagatggcttatgtctttaatctcagctgtttgggaagccaagtggaaagattgcttgaggccaggagttcaagaccaacctggataatggtttcttcccactctccagtgaataagcaacgatgagtgttaggctgtttattcagataccctcacgccactgcagaagcgagtagaggaagaatacaaggaaaaaagtgtctcccagcctgtggaaagaggatggctatttcatccactaaaggtgtacactttaagtgaattggtatgtctacatcatcccaggaggagtgaatgtctgtgtgtgtgtacctgagataagatgatgtcttgtccaatgctggtttcaccttgtgccctgagctgttgggag

SEQ ID NO: 10635 - DNA, 514 bp, Homo sapiens
agagtttgccctaagctttgggaatacttgaatgctgccagtaaagcctcatccccatgtgttaaatacttttctatctctaggaattccattagtcctatagtcctgagttcaaatcttttctggaattttcatcttacctctaacttgctgattgcataatactgatttttctgaattttatcttgctccttggtaaaattgaataacatgattcagtcttgaaagtaaggccaggcgcagtggctcacacctgtaatcccagcactttgggaggccaaggtgggcagatcacctgaggtcaggagttcaagaccagcctggccaacatggcaaaaccctgtctctacaaaaatacaaaaattagccgagtgtggtggcgcactcctgtagtcccagctactcaggacactgaggcaggagaattgcttgaacccgggaagcagaggttgcagtgagctgagattgcgccactgcactccagcctgggcatctcaaaagaaaaaaaaataga

SEQ ID NO: 10636 - DNA, 551 bp, Homo sapiens
  misc_feature 44: n=a, g, c or t
gacattgagctctctatagcaggcattgttctaagtgctttsmntagatttatttaatctyammaatagctctmtaatatgggtagtcatacccccattttgaagaaattgaagcacagaagagttaattaacttggctaatctcacacagctaatgtgtgatacaacctaggcagtcagagaatggtgggaaatgcctcatctgcaaattctgctgtcagaagaaccccatgtggggcagggactacagaaggacagagtacaaggtcttgagtacataccagcgaggacacccaaatagaagacatatttcatggtgatccagctcttccccctgtgagatgtagaagaaaatcagcagagtgtggagcggttggcttagttgtcttctcaggaacacctggtagactcagtggctatggttagatacggaggcactcyatggggattggaaagcagctctgggcataaacaggggaggagatggcttcagagagacagatgaaagccctctgttccagggaaggtgaggctgtgctctgttgggattc

SEQ ID NO: 10637 - DNA, 466 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacagggtctcat

SEQ ID NO: 10638 - DNA, 451 bp, Homo sapiens
  misc_feature 74,205,209,287,312: n=a, g, c or t
attgttttgcaacaaacagccggcagccagggtcccaggcaggtttctsaagksckggcccccaggsttggctngggctcaatccttggccctcccaactgcctggccagscctgaacgattgagttatctccactcgcatcccctttgtttggggcggctacttgcccactcaaggtaaacaaattctgggcctgtgtgaaaanaaangaacggttatctctgatgccctcagcggcctggctggggagcaagactttcagaggcttctgtctccaaagawagganggatttcggagcatagckkccagangccagctgcctgggttcaagctccacctcggccactgactgctgatgacctttggcaagtcccttgaccttctgcttcaacttttttacctgtaaaattttggcacaataatatctatatcataaagtctcaaaaaaaa

SEQ ID NO: 10639 - DNA, 552 bp, Homo sapiens
taattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggtaagataattcatactggagaaaacacctacatgtgtgaacaatgtggcaaaacttaaccagtgctcaccttattgcacaggaaagcatttgtacttgagataaattatacaaatataaagactgaaaaagccattaatatatgttcatatctcaacaccagatagttcatacttaataaaagcattataagtacaattactgtcaaaagacctttcagaaaatacaagcttttgaccaggcgtggtggctcaggcctataatcccagcactttggtaggccaaggcaggtggatcatgaggtcaggagtttgagaccagcctatccaagatggtgaacccatctctactaaaaatacaacaattagccggttgcggtggtggtgctgt

SEQ ID NO: 10640 - DNA, 456 bp, Homo sapiens
  misc_feature 393: n=a, g, c or t
cataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctccctttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtgganttgtgcaagcattttacattgccacataattgacttgccattttatggttaaaaacggcacat

SEQ ID NO: 10641 - DNA, 169 bp, Homo sapiens
attttgcatttccaccagcaatatatgatagttcgtttatttcacatctttgacagcatttagtgttgtcagggttttttttgtttgttttagacattttagtagtctggctcttgctgattgaattccttttggtgcagtttagcatgtycctcttgkgtyytgcatc

SEQ ID NO: 10642 - DNA, 155 bp, Homo sapiens
actcccactctcactgtgtgacagccctgctgccccttcaccttctgccatgattgaaaacttcctgaggccctcaccagaagcagatgcsagtgccatgcttcctgtacagccttcagaaccatgagccaaaataaacstcttststttataaa

SEQ ID NO: 10643 - DNA, 440 bp, Homo sapiens
atcgtcttcaactgacaggataatcattaagagtaatctttagttcaccatttactgctggaagtgttgagaagtaatttaatcttttttttaaatgataaaagtgacttacagaagttatgctattgaccattaagacttaagtcatttatgcaactacaagttaccagaacgagacaaaagattatgcaatctagaaaaattcagtcttaacccaggaaaacaaaaaagttattaattaagataactattggcaaacactgaaaacagctctggtaacctagtaaagtggataattattttgccagtaaactgtaacaaggaaacacactgtggtaattatgttaagtcaaagctcttaatccactatcaatgamaaaaaatctcagccatcaatcaatttaataagtttacacrttatagctttactttttcctgtt

SEQ ID NO: 10644 - DNA, 129 bp, Homo sapiens
tgttctgttctgtctssctgtagtcagtcttctcsttcattctctgstgatcactaatgttttcttgctactgtaggcttgccttttctagrtattgcatggatagaaccatacaatrcatagtctttt

SEQ ID NO: 10645 - DNA, 541 bp, Homo sapiens
tagaagcatttgttgtatgttttcaatgtaggtaatgttagattattgatagaaaagtatataaacttatctccaaactacagttcataaatcctgattgaaaatggtacctactgtcctgcaaaacctcatccctataccatcatcccaggtctcactttctctgctaactgtagtctaactgctgagcttggcaacagaacaatcccatgagtctgtggccctcaaatgagctgtgttctctggtgatttttgcacagatgattccccctattgggataacatttctttggcttgtcagcttggtgaattcctattaagtcctcctaaattctgctccaggcgtttctcctccaacaaaattccctctttgcccagtgaatcccccgcttttttggagagctgctgtgcactttatattgttttgtgatatatgtataaaaaatcagtttcttgtttgaaagacaaaaagactaatttatttttgtatcccaacaaagtggcagacagtkcatgtgaaatgtttgttgactgaacatag

SEQ ID NO: 10646 - DNA, 557 bp, Homo sapiens
  misc_feature 386,399,475,481: n=a, g, c or t
attttttctattgtaacatctaggcaaaacggccaacccttgtgtcatttcaaaaagaccaactccatcagatgttccggagactgaggaatcaaagccttagaagaccagggttaggaaattatacwkyracaggactaacaggagaacaggacactctccaaactctccctccagtctaagatgatgccagctccaggaagttggggattgtcttcctcactcctgtattcccggctcctagaacagtgactgtcacccagcagctgttgagctaatggctattgagtggacaaccactcgagcaacaatgcagtcagcttcgtggactttgttttactgaggggcatctggagagttgggaccagaggtgaattgctcaaganaagagggaagcantgaggacacagctgtcctcctccatctatccccagagcctataaggaggaggagcagaggacacaccatgtgargnmcacancaataaggcagctgtttgtaagccaggaacagagcctcacagaaactgactttctagcacgtgatcacagacttca

SEQ ID NO: 10647 - DNA, 557 bp, Homo sapiens
  misc_feature 67: n=a, g, c or t
agagatcgctttccactgaaatgtaccgaggaaaggctatgtgaggacatagcccagaagaggbscncaccagagcccagctatgckcaaccctgacctcctgctccagcctccagactgtgaggaaatacgtttccatggttgaagccacccagtctatggtattttgttgtggctgcctgagctaagacaccatcacacaatgaccagggaggctctttggccgtggtcagcagaggcagctgtkccactgcctgtgggtgccacgcctgcctcacagcagcaacttcctcataagaaagtctctgctgttatttagatgtgtgtcttgtctcccagactcagatacaagcccatcaaggcagtgaggttgacatctttttttctgacttgtctgcaaacccgtcatgaggattgttgcacagtcatgtttgggtaatgccacgtacagtctttccttcttaggcaattatattagcagttaaaggctctgagaagttttgcaatgaagatgctgtcataagtttgtctaattcagcatttgacaacagaactga

SEQ ID NO: 10648 - DNA, 484 bp, Homo sapiens
  misc_feature 117: n=a, g, c or t
tcattagggaccgttgctggtgggcrrgggatgggcgtatagtgggctcctttgaaggttatttcacagttgaggattttgggcagatccataacagctggttccaawtttgacagngaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtag

SEQ ID NO: 10649 - DNA, 553 bp, Homo sapiens
  misc_feature 524: n=a, g, c or t
gggtttcttagaacactcctgtgatactggacccaccataccggagaagccacagatttgcatcctgtgtgagagcatcctcacaccccatctttccagacatttctgccaaagtgtccaacacatgagtgaagccagcgtggagctccataccagccctccatccagcccaccgattcacctaagttgttatttggagtacgtgggctgtatgttttctctctaacctttctgttgtaaatttctccaagaaaggaaaccaaatagaatcttggagaagatgttcccagttgggatgtcttactaaaggaagttgatccaaaatgcacaggggatggactgtgctgggtgctgtgtctcaccaaccagatttttacttctcttggaaatatgagtgttgagaagtcacgtgtgagccgttttctgggaatttccctgagataaaaagtaccacctcctttcaagtttcagacgcctgctcagtggtcacatatctaatgatggtggacgcaggagttgtkaangtcagctccattttctccgtctgcctttt

SEQ ID NO: 10650 - DNA, 538 bp, Homo sapiens
agttcgcagctactggaagagagaggagcatatcaattgtttaaaacaaaaagccagcgttaacaggctcagagaaatgaagttgaaaggaatagatgtagctcctgaatagaagcaaaagtccaacgtggttccattaaaatgacttctcagccgtctctccctgcagatgacttcgatatctaccacgtcctgactgtctccaatgtttttttcaacaagacgcactgacctggaacaacgaaattcactgctccttttgtgaaaccaagcaagaaactgctgtgagggccagtatttccaaagcaccaaaaataattattttccacctaaaaaggtttgacattcagggtacaacaaaaaggaagctgagaacggatattcattacccactcactaacttggacctcactccttatatttgctcaattttccggaaatatcctaaatacaacctctgtgcagtggtgacagtttcgctcttgtctcgaactcatgacctcaggtgatccacctccctcatcctcccaaagtgctg

SEQ ID NO: 10651 - DNA, 497 bp, Homo sapiens
  misc_feature 363,482: n=a, g, c or t
agaagccaggttgtcatctcaaatgccgtccctcacattcccaccactgctcaggggagcagctctctatttttaaacatgttttagtaattatgaatatgtgttcatatgaacattttaaatattactggcatttgaaagatacatttaatttttttttttttttagaaaaagcaggatgacatttttaaaagctatgtaggagggctgtgcycattcattttcaaacagaaagcgcagttgcctgccatacagctgaaccctggccaaaggtcatgagattatcyctwdkagatcacatttctcaagagaaaggcacttggactgggycctttgtgtactgggtcatgccttgtaagcwknscataattaccaaaaaatgctgctggaggtcccttcttaattactgagcactttcgttccgaatcaagcagaaatgagtggctaagctcagggcctgaaataaactkagggaggcattnaaaaaaaaaaaaaaa

SEQ ID NO: 10652 - DNA, 445 bp, Homo sapiens
tgactaaaaaattagcaggcatggtggcttctcaggaggctgagagatgggacaattgcttgaacccgggacatccaagacagcagtgtgccatgatagtgccactgcactccagcctgggtgaaggagtgagaccctgtcgcaaaaaaaaaataaaaaaaagtgttaaatcactgaggtagaaattggctttttaataaatggtaccgatatatctgaatgtcccagataataaatgataccactgaataaatagtactgagatatttagaaagrgataaaattagatacacatcttgtaccatgkwtaagrataaatwcmacatgtacacaggttttcatagcattattcataacagccaaaaaattcaaacttatatgtccattgactgataattggataagcagagtgtggtatgtccatacaatgaaacatatttcagca

SEQ ID NO: 10653 - DNA, 309 bp, Homo sapiens
atgttctctttcctaagataccctccaaaagacaagaggaaagtttgccttttctgctcccttcttggaaagatgcaaagtgctttagtaggctcctgggccaggcgcagtggctcacgcctgtaatcccagcactttgggaggccaaggtgggcagatcacgaggtcaggagttcgagaccatcstggccaacatgcacaacaatggcttctatgggcactacagaagccaattcaagagtgaaagtgctagagaataccaccttgcagccaagccccagcstccagcagtgttcctgcagcgatgtc

SEQ ID NO: 10654 - DNA, 426 bp, Homo sapiens
gcgaagtcaaactgttgctgtttgctgatgatgtaatcatatacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccagracaccaccatc

SEQ ID NO: 10655 - DNA, 527 bp, Homo sapiens
attgattagatataaaattcagtttaaaaagaacatgctattttttaaatgccatcacataaacaaagtgatttcacagggagaagaaagctgtataaagctgcagctttcaacaggttttaaacctggcattaaaatgtaatgcaaaaccaatattttctatattgtgaagggcaaaggttacagaaacggtcccaagaaaatctaacacccaaattttcctttgatagatagatgcctttaaaagggctggtaatgcagttacattctaacagagaagtccaaactacaggtaaaaactacggcttgtactgtgaaaaatgtgcagcttttcagttataaaactagttgaacactggtttacaagataatccgtagaacagagagactgtagaaaaatattccagcacttgagttgtgtgtggcagcagcatttgagtccatgaatgctatggtcattaaaataattgattatactttcctaaagaaaagccattttttaatgcaaagtctactacttccaaatg

SEQ ID NO: 10656 - DNA, 149 bp, Homo sapiens
taataataaaataaaaatttagattataattggaaatgcattgtatgtttgcaatagtcaaggataggtttccaataacgtattcactgatctgtttttcttatagtctatcaagctgtattcattaacccacgggscagtgactagtc

SEQ ID NO: 10657 - DNA, 525 bp, Homo sapiens
gtcctcttgtgggatgctgcagactcacagtgactatgatactgcctcctaagcaaggacacaccccagtgatgagaaataggcaaaccatggtcttgaaatgcctaggagtataggctggggtttggagggaaatagttggatgacctcaggaaatagaaaaaaacaggcagctgctttttggagagagtggagatgagatcagtgcctacctggaacaaaaccctctggcattctagactggctgaatatgtagtgtagggactttatcatctgtcagaaaatctcctttaagaagaagcgatcaagaagtttagtcctggccaggtgtggtggctcacgcctgataatcccaacactttgggaggccaaggcaggcggattacttgaggtcagaagttcaagaccagcctggccaatgtatggtgaaacccgtctctaccaaaaatgtaaaaaattagccaggtgtgatgggcacacacctgcaatcccagctactcaggaggctgaggcagaagaatcatt

SEQ ID NO: 10658 - DNA, 470 bp, Homo sapiens
atggatgctcaagtcccttatctaaaatratgcatcatttgcatataacctgcacacatcctcccacatactttaaatcaactctagattacttataatacaaaatacaatgtaaatgctatttctggaggctgggagttgaagataaagataccagctgggtacgatccatgcccagttttccatgcagactgctgactttcttatatatcctcgcactgtgaaaagaaggttaaatacctgggagtgagattgctgtgtcatatgacgactgtagttcattcaggagacaacaacgccgcagtgatactggaggctcctggaggacctcagcgactcaaggtccagtccaaggagggccgcagatcaggctgaagaaggatggatccacatgcttagaggagatcgagaaatgcagaagagagatgcagscagagaaatgccacagaaatggggggctggagagaatc

SEQ ID NO: 10659 - DNA, 520 bp, Homo sapiens
aatgagactaaggtatgtccagatgagcctagccccttcggagggggtccctttggaggctatgcaggactgtcacttttgttgaaaacctgtttggaacctcatttgggaatggccttcagagcctgtggtgtgttcttcggttgtcctcattggtagcatgtcctcctacttcaagagcctgaaatggctaggtgtggtgacatgtgtctgtaatcccagctactcagcagtttgagatcttgaagatactcacagggaagatagtggtggggcatgccatccacaacgacttcaaagcccttcagtactttcaccccaagtccctcacccgtgacacctcccatatccsccccctcaaccggaggctgactgcccgagaatgccaccatgtctctgaagcatctcaccaagaagctgctaaaccgggatatccaggttgggaaagcggacattctctgtggaagatgcccaggccaccatggagctatataagttggttgaagtcgactgggagagc

SEQ ID NO: 10660 - DNA, 403 bp, Homo sapiens
  misc_feature 297: n=a, g, c or t
cactcctccctgaagccgccactacacacagcgctcggtcatcttttcaggaactytttgctgttctggggatgctcctctggatatacttcaaaatccaacaacaaccctcttataatgtggactcccctccacagcagaacacaacaccatcaacacagcatgtctccccaggacaaacagaaagactctgaagcagtgaggtggaacctgcccttgagggcaatcaacgtcaaatgacttgccatctcctaagagcaaaaagtggtcagtggctgtaaaaacyttccwcgtctnacacagtgggaaatggaggaagcattactactttttaaattattattrtactattaagttctggggtacatttgcagaacgtgcaggtttgttacacaggtataca

SEQ ID NO: 10661 - DNA, 428 bp, Homo sapiens
acaagtctctttcatttcggcagtttaaagacacaactgtgggctttgaggcgatgcccgttgggcaaacttaggtttatgtgtttggtttttcagctgacgtggaagccctgggtgggcgtcccctggctggcctggcttttgggttcaagtctgtatgtatggagtgggttggggccccaaagctttgctgctatttgatttgtccccgacagcaggcaaagcctcacattgccctcaattttccccctttcatttgaaggaccagtttttcatggtactttgtcttgatctttttcatagtgttcaaatctgtatttttgtatgtagagggaaataattttctcaacactaatcgttaataactattgtattaaattgtcatgaaggaacttgtttaataaatggacgtgtaaggcaaaaaaaaa

SEQ ID NO: 10662 - DNA, 503 bp, Homo sapiens
acaaaggatcctgcgggcttgaacaaggggctcgaacaaaaagcagttactccacagaagaccagaggggtcctcccagcattgtggctctatgaggaaactgagacccagagatggaactgggattcaaaacaatgtctagtgtgactccagagcctttcctaactcctacttaaagcctctgaggaatgctgaaaagagcacaggacatagaatccagattaaaatgatgaaagtcatcaaccttaaaagaagcaaaaaagaagagaattagctcctctgtgtaatttttttaaatatagcatcaaaccatcttcccgtcagcaacaggcactgcagtattgaagatcatcacatgagggcagagggcgtaaaaaaggatggtgtgttgagaccagaagcagcagcagtcctcgacatcaactacaactttccttcgcacagtgcataccctctgatatactgaacccaacgcctatcctccagcccctaagaactagaga

SEQ ID NO: 10663 - DNA, 562 bp, Homo sapiens
tttattgttttaaatcgtcatcgtcctctgggaattaccctacatgtttgtcattgcttactgttcatttttgaatgtcagctcatccttcttgaatcattcttctgaaattcatgttagaagactttttagtcttctaactgtagatgataatttatttttttaataatttctcagtttgtgtttgtctgaaaataactgtattgcttctgtttgtaagaaatataccataagtatggattttgtcagaagattggaacggcagtkggatcacaggctagtgtaaagagattaagagcccatcctgcctatcacagcttcaataagaagtggaacttgcctgtttattttcaaataagaacagaagtctgtgacaggatgagctgaggtgccaggtgagccagctgtcatcagggaaaaaagaacgcacatctaggaagcgctggtacagacagccgtagaacccgaagatttagagaaatagcgggatccttagaagcagcacttacagatgtcctggaagatgcccagctgaagtccgtattgcctttgsttctcatag

SEQ ID NO: 10664 - DNA, 583 bp, Homo sapiens
aattccatgtcagtttctttataacgtacgctcttgtctacacccacttttccgtcatggcacccatctctgtcgttttatctgtattgtgtggatgtttgactgatgctcaccatgcatgagaaatgtatacaaaatacgaaggcagagagaaagttttagaacacacctatatgacccaagtaatgagtttccatgtgtgccctggaggttggaagaggagtcaagacagatgctggaggcagatgggccttaaggcacagactgcccttggggtatcatttcacagattttggctcctataaatgatacttctgggaaattaagatatagatgatacacatcacaactccttcaaccacaagtaaatcaagcacattggtaatcctttacaaaatttaagaaaatttaattacgttatttcttcaatttgaattttcaggtgtatggcaaatatctcaccaaagaaaattattagtgaamctcaaattgagcagttattactctttcacaaaattatatcttatagaatcttgagcgcatcaagtgactgcatgtctgagtataattaaagactaaaaaa

SEQ ID NO: 10665 - DNA, 265 bp, Homo sapiens
aaaaagttgaatgcagattaaaaactgtcaggaaatgggtgatttctactaacatcattcaaatgctctaaaaattatctatttcacatgctgatagtatgttacatggatactaaatacacaaggattataagcaaaaatgcaggaggggaaatggaagaaagagactaatgacgtttatgcacctttcaagtgccaggcactggtttgtgcttcatgtgcatccatcattatccttcatctccatgacaattctactggcagg

SEQ ID NO: 10666 - DNA, 480 bp, Homo sapiens
  misc_feature 439: n=a, g, c or t
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagcactttgggaggccgaggcgggcggatcacgaggtcaggagatcgagaccatcccggctaaaacggtgaaacccgtctctactaaaaatacaaaaaattanccgggcgtagtggcgggcgctgtagtcccagctacttggga

SEQ ID NO: 10667 - DNA, 433 bp, Homo sapiens
ctgtgagagtttagcggtaccactgctgagagattttagcagtctcaaactctgtgcacgctcatactccaaactgtttaacgtgtgaamtctcaaagcttacgttcctaattgcagtgactagagattttaacaggtaatggaatcagcgggtttgaaagttataaggcactcataaagcagatcttggcgactcttactggtttggccttttcctaagctttggtgggtggtgtgcttgccacactagactgactgccaaggctatggtgcaggtgctaagctctgcagttacatcatcattcatgggttctggaakgcacattttctcatatgtcaactctgaaatcagaatacctcatttttagttaaggtaatgaagtgacattgtcctcatctgggatacagtaggtkaagagttaaaaacatttct

SEQ ID NO: 10668 - DNA, 260 bp, Homo sapiens
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccag

SEQ ID NO: 10669 - DNA, 493 bp, Homo sapiens
aagcatatatatatggcactccaggaagatgaagtgtatgcagctgtagtctgggaggtctgatgttagggaaaaagaaggaggaaagcaagattaaaaatcattcctggaaatgcaagagaaaatgtgctggagtggtgctgttagtaccagggacactggacaagaaagataagcaagccactgctgtctgattcctacatagcaggttaaagtgttggattcataattctcacttcaggaagactgaaaaccagactttattctgttagatcccaagatatcaaggaagaggaaaagggaagagccccaggcactattaaaccacagctacaatcactgccatttgaaacttcccaccaaacaactttactattctgatttaatttcaactcccagggagagttagtattaagaggaagtacctatcatccatgataatccaccagctctgggggtttagaagggaaaagatggaggtctcagtgcttga

SEQ ID NO: 10670 - DNA, 345 bp, Homo sapiens
  misc_feature 11: n=a, g, c or t
gcccactgganbtctggagggtgggacatccccaaacctaaactgttaactgagacctggaactgtagctgagtcatatattcttcttctttttttgagacggatttggdtcttgttacccaggctggagtgcagtggcgcgatctcggctcactgcaacctccgcctccccggttcaagtgattctcttgcctcagcctaccgagtagctggggttacagacatgcgccaccacacctggctaatttttttgtatttttattagagacagggtttcaccatgtctactaraaaatacaaaaattagccaggcgagtttggtgtgcacctgtaatcccagctact

SEQ ID NO: 10671 - DNA, 196 bp, Homo sapiens
  misc_feature 110: n=a, g, c or t
acgacgcccagctaattttttgtgtttttagtagagacgggggtttcaccgtgttagccaggatggtctggatctcctgabbtcgtgatccgcccgcctcggcctcccanagtgctgggattacaggcgtgasaccgcgcscggcccctcataaggtatgttcttttacttcaaaatagaaaatagtattaaatga

SEQ ID NO: 10672 - DNA, 447 bp, Homo sapiens
aggtcgttggaagccccagtatgggagatgctcctcagggaggaagccatgtgagggggccggctctgtggcaggattgttgctgaggaattgttgcaacctatggactatttgttggaatcctgaccaaactggaaaagtggcagtaaccatggaaaagtcaaagacaaaatgacagccaaatcacaccagtaaataagtggagtgaagacacgtctgttttcacagctgaacactggaaattgcaaatttgattgccactggcattggatgctggaactgcttctgtttttactgacactagcataccgggatacttcgaagttgctgtagtctctgcaatattgagtgttggaaggtgctagaaaatgagtgtctgtcttttttgtcttttatactggaaggcaatcacctagacctatgctggagagtcatcctacaaggtca

SEQ ID NO: 10673 - DNA, 429 bp, Homo sapiens
  misc_feature 341: n=a, g, c or t
atttttatacaggaaggagagaaatattgttcatgtaatgtgttacctttttttgtctgtgtgatctacaagagcatggctgaaatgttaccatttttaactagtgttttgactgaagattattatgaaaagttttacttttgttagattcctaattaaaaatgcctatactcttttataggagtttcaacttttgcaatttggtaataacagatttaggtaagtaaaaaatgagaatctcatacagttctgaagatctaagtttggttgagaatttaatgtttcatcaccagtaaattcaattaaagacttttgattcaattaaagactcagttctgccnacacctgcaagaactgagttgatctgtacatcaacatttctgatgtttctttggtagttgctgctggagtcagaagttaggaacaaat

SEQ ID NO: 10674 - DNA, 531 bp, Homo sapiens
atgtaaaaaagatgaacaaacaaaaagaaaagataatattgcaaaacaccgtattgtgcttatacccaaagaagttaaaattaaatttataatcaattattttattgcataaagttaatcacaatttggaaggccattgtttctaagttttctgtaaattttactttactcacaatatgtagggtcctggtttaggcctggtagaagagctaaatgacattatgcatttcttctaaaagctcatgaacctagacatgtcctaaaattatagggcaatatatgattgatgctaaatgtgagttaacagtcaataagtagtatatggatgagtagttcagaatgaggaaaaatcttaagggctaaagtgatgagaaatttttgatgaaagatgaggaatattgggagagaggtacaagattataaaakagaaaaggtgggttattatttctttaggaagaaagatgtggaaagatgcagaggcatgtgcagaagcagcaagatcagtgtgtaggtatctgtgcagaggactgg

SEQ ID NO: 10675 - DNA, 233 bp, Homo sapiens
atgttaataacatgaatattctatacaaaccctcactgtgcctgccctaagtaaggcccattctgagggaaaccagatgtccaaacttaatctgtctgtggacccatcatgatcagcattttataggagagcaaattcctgggtgccagatctgaggttgcattaaacaaattgtgatatgcaaaaaaaaaaaaaaaaaaaaaaaaaaaaaaaaaaaaaaaaaaaaaaaaaaa

SEQ ID NO: 10676 - DNA, 410 bp, Homo sapiens
  misc_feature 98,150,407: n=a, g, c or t
aaccgatatcgcgatactgcactccagcctgggcgacagagcgagactccctctcaaaaaaaaaaaaaaaaykkttagawtgcstwttagstgswtgnggggaaacagtaaccagaaagtagaggactggacaacatctggaccaagggntcaaaattaacatcaataagtcctagaatcaggcgtttctttaagaggccctacttcctctaattggataattctagaaaccggtatttgaatctgaggtttamctaaagagaataccttctactgatgtaacagcaatggtaattggtataaaggcaaaagcatgtgcaaaggagaaatcacaccaagggccactcaaagtttaaatattaaattagttgtcaaatttttgcaatattaaaagattttacctccanaga

SEQ ID NO: 10677 - DNA, 497 bp, Homo sapiens
  misc_feature 43,76,377: n=a, g, c or t
agacaaaaaaacagcagatggtttctggatggtgtttcctggnctgtcaaggggtggtggtgaggcaggagaatanggtcgggaggsgttagggctttttcatgctgacttcctagaactaaattgaaaggaaaaccctaactttccacacctaagtaacaaaggaccagaggctgctccctttgcaaacccccccttttttttgaggcagatgggaaattgaaagtacctctgattgcaagtagagtcttggtttgcaaagaaacgcaactttgtaacttcactttagcctctgattggttgcagaagtgaagttacaaaggttgctttccacaaccaatcagactgatggcaggccaccacttcatttacaccangcgagcaccaagtggccaatgggaaacctcctgggggtatctggacctgagaagattctgtcactaggccttgagactctgctcagccggctcccacactgtgagtgcactttcattttc

SEQ ID NO: 10678 - DNA, 402 bp, Homo sapiens
acttttcatttcagcagttatagtttgtttcaatagcaacagttatttccagttttagttttgacagcattcctagaactagctccttagggttttttaaagacaccaacgccaaccagcaagcgccccctactgagcggtctaggtcccagctctgagaagccactcaagtttctaactgagccccagaaaacctttcagcaaacaaacatgatggtttcatataccagttggcatgaagataaagtgttggtgctgcattttaaaggggaagtttgagaaatatgaggaacgaagtcatgagtagaagccagggaggcatgaaagaaaaagtcttgtggcacccacaccgagaagatgctaagcagagatgtgaggaaacaaagctgagaattgagggac

SEQ ID NO: 10679 - DNA, 351 bp, Homo sapiens
agtgatgccatcaggtgtggtatgtaatcacaggcaactcaggaacagctctccagccccaggacttctgctggaaccgctgggagttggaagctttcttcccactgaggggcaaaccttctaggtatctgaagatgttgaagaccatttcctggaacagcagagagagactgtggaatggactgactctccagagctgcagattgaagatctcaatggcgggaacaccttcatggcccctttatagctggtatgttttcttcttatggacaatgagaaacatgtaataaactgtgtttccttctcgctaggaaaccctgagttaaagctttaaaaaaaaaaaaaaaaaaa

SEQ ID NO: 10680 - DNA, 298 bp, Homo sapiens
  misc_feature 243,274: n=a, g, c or t
cttctctgcagacaccagcctggtgtcctccttcatcccaggctgccaggctaggcaggggacagcggctgccctggtcctcacagccctggctacggggctggtgacasagatcctcatgcttctgcgacctgagcgctgccttcagacacctctctgctggcgtgttcctgggtccatgatggaagaaggaaaagtatttttaaaagacaatctgaagctcatactgtgactgcaacatanaatgtgttcacctgaggagactgcttggganatacagtctctgcttgggcgatca

SEQ ID NO: 10681 - DNA, 413 bp, Homo sapiens
  misc_feature 359,370,404: n=a, g, c or t
aaaaacatgctgaagsataatcttactctcctgtaacttacaatctaattgtagagttgatgtaagagttgtgtttaatgccatttctacattgtgtgtgtgcttgcctgtttataattgtcatttattaaaatctgctatcgttgcaagttttagacggattctgtaaagatgggataacatgggagaatctacaaaattagaataagattgaggaacacagggttctttcttgttcctttctgatccctgtggctgctggtgcattttaagccagcaagcagactttactttcctctcttccctgaaggacattaatgaccttcccataacagcccagctaatttctgtgagtaggntattttggaantgagtattgaatgtttttatctgttagtgtgacnttttttttt

SEQ ID NO: 10682 - DNA, 410 bp, Homo sapiens
agttttctgataatcttcagtaatttaaaatcttctggaggtaattataaggaacatcatttcaaaggatacggggaaaagagatgtcacatgaacacgtcttagaatttacactgtaaatcaaacaatgttgctgcaaaggcatgtaagttaatatagaaacaatggaagaatgtaaagaaaactcagagacagggaagaaagccaggataggctccaagatcagctggatgagatcacaacatgtgaccctcacagatgatagatcaagaaaatgggaagagcttcaaagccctgaaaccatataaaggagagtcacccaacaactaaaagcacccatcctaaactattgtgtgaacagaaacaaacctctattaatatatttgaattattaaatattttgagtctaa

SEQ ID NO: 10683 - DNA, 487 bp, Homo sapiens
  misc_feature 105,337: n=a, g, c or t
aaagatgccactgtagggacagggatgacctctagcaaggtgaccctcagtgggccagagggggcttctgaagagaatttctctagcttcttggtgtttcctgcntgctactttcaaacaagggtcccatttttaatgttttcccagtaataccttatgaatgttattgcaaagcgggctaaatcaacaccacaggccccgtgatcaatatatgtgatgaggacattacatcctggtgttgttgccccaagtcttgacgtgaatctgaccacaaggacaattcggacaacctgaaatggtgacgcattctacaaaataaacatcaatgtcatgaaanacaaagactcaagattttctgcttaatggagactaaagagatgcgacaacagaatgccaggcatgatcttggatattcttttggctcaaacagtcttaggacaattgaawaaacgtgaatgaggtctgtagctaatagaattgtgtcaat

SEQ ID NO: 10684 - DNA, 546 bp, Homo sapiens
  misc_feature 42..43,536: n=a, g, c or t
agattaaagggattcatgctggggtcaggcttttggagctanntcacaataacatttgggtttggatgactgcatttcaaagggtttcaagttagaatcttgatttcatacagagtaacagagaataaagagtatgtaatgcttattttttgtaaaaaaaaaaagagagagaagaaaaagaaaaaggcaaatatggccaaatgttaacatctgttaaatctggatgggccctggagccagactgtctggggtttgaaatcagctcctccacctaccagctattgacctcagcctaaagagacccttggagccagaaaaaaagagcaaagttatctgatgacagagggagcatacaagcagaagctcaggctatcactcaagagtttgagtgtactttgggcaacagctgggtgtattttaatatttatcaatttttattaaggatacagcttgggctttataaagacatggccatgttttaagttractcatctaagtttcctattctcagtgttttagaaatgtcagttgttcanataatactac

SEQ ID NO: 10685 - DNA, 501 bp, Homo sapiens
ataacatcccaaagtgtatctgctggtgccccagctaaagccacttctgctgttttctgabctctaaatgcaattttagagggtctttttataataatttattgtgcctccctttctagaaagtgaaagtgtggccctttaaatatatcttttattttaaaaatgtttttaaggaatcagaaaagtaaacataggttgacacctccctgtcttacaagggttgtcatgtcagggaaacatggaaaggaagggaggtgaaaagagacaataggaaaaccgtagctgtgacggaaaaaaatgaaacagatgagtgagaagaaaagtccaagagccaggatgacggcgcagtgatggctcactttgcgttgctgttccgtccactgttccactgactgtgaactctgtcagagtagggagatttttttgaaactcataaactttcaagaacatgagaggagaacagcagcacagtctgggagtctgagcaacagatggacgagt

SEQ ID NO: 10686 - DNA, 293 bp, Homo sapiens
atattgagtagatgtcttggactcacccagtaactcagggctgtggaatgaaggtaaatgtaaaaaacaagcgggagtcacagatacattgtctgggaaagtcaaacttagtagctttgtgagtcctgttgtaatgctttcagacacatttatagatcaaggggccaaagttacattttttaccgattagattcctgatcatttaggggttgccaagattctgctacccactgtagttaataaagagaaaacttgtctctaaaaaaaaaaaaaaaaaaaaaaaaaaaaaaaar

SEQ ID NO: 10687 - DNA, 477 bp, Homo sapiens
  misc_feature 315: n=a, g, c or t
agaccaaaaggaaaaaatgacagtcacctgacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctanaaaaaactcagaggttacttgaaaaattagatattcggtgcagttatattcatgtgaamagatttttaagttaggaaagcacaccaaatgtcattagaaggttttacaagatacatggattcacgtgaatgtctactgtttaaaaatgaatgtagaaagttt

SEQ ID NO: 10688 - DNA, 447 bp, Homo sapiens
  misc_feature 303: n=a, g, c or t
caccacaacaatttaattagttacagtttgttttcttttctgtactgtttgtttttcttttcctttctaatttaaaagagtgtgtttaaccctccatcttagacaatgtgatagtcatgaagtctttgtgtaagaaaagaagaagaaaagataatctgtaatgaagatcaataggggtcttctctggtgcccttcagttaactactgtcttttacaaaacaacgtaggtaaggaaaaaagttaatctataacagagaaataaaaatcacattggcctaggtgacagctgcctgcttatgttgnctcaggtaccataatcacattcccttaaggctcagatattttaaagttccaacagcttagattttaagtgacctatttttacagaggaaggattctgagcatattctaaggcaatgacatttaagtggactttcagcctagttc

SEQ ID NO: 10689 - DNA, 84 bp, Homo sapiens
gactatggaacgtcaggtgctgctgagcgagcccgaggaggcggsgmctctgtatcggggccttagccgccagcccgcgctgag

SEQ ID NO: 10690 - DNA, 67 bp, Homo sapiens
gaggaaccttaccggtaccggccgcgcgctggtagtcgccggtgtggctgcacctcaccaatcccgt

SEQ ID NO: 10691 - DNA, 429 bp, Homo sapiens
aaaaagttctgagggaaggagagacagagaaggggagaaaactctcaaccaggaagtctatatccagccgacttcaaaaataaaagagaaattgagacattcctaggtaaaaacaaaatgtttgttggtagcatgcttaacctgcaagaaacactaaaagaagtccatcaggctgatgtgaaaggacactaaacagtaactcaagttcatgtgaaaaatgaagagcatcagtacagtactgaattatttggtttgtaattcttttactcctatctgatttaaaagaaaaacatataaagcaataattctgtgttgatgggcacataatgtgtgaagatacaacttgtacaataataatagcacacaggaggggagagagaatgaaagtttttgtatactacttgtgatggttaattttatgtgtcactg

SEQ ID NO: 10692 - DNA, 356 bp, Homo sapiens
  misc_feature 283,307: n=a, g, c or t
actactttgttgttcttcacaattagttggagctttctttggtcaacagcagatgtgactaagaaaatcacgctgtttcacttagagcagtggtcaccaagtgtggtccttaggccacacaggtcagcatcacctaggaactaggaaatgcaagttcttaagcaatcccacccagacctactgaattggaagtgctgaggatggggtccagcaatctgtggttgaacaagctctgcaggcatccaggagcagagctgtggggcagcagaatctgtgatgacanakaatgatgatgtatttttgccancagatgcttttgctcctgttttgataccccaatattcggattcmgaaaa

SEQ ID NO: 10693 - DNA, 361 bp, Homo sapiens
  misc_feature 346: n=a, g, c or t
attcttcggtttgcctcctcccagtggcgtggatttgctcccgacccgcttttggggcgtgcctgcttcctcctctctgttagatctcgctctgtcacccaggctggagtgaaatggcacaatcttggctcactgtaacctccgcccccaggttcgactgattctcgtgcctcagcctcctcagtagctgggattacaggatggagagtaaaggaggtaaaggaggactctgatgcctcagccatgcgcctgtgtgccgattcccattaagcctgcaccaatttgatttccaagactccagtcaatcctcagagctccaagatgggagggcagcttttcctggtanctgctgatcaccagc

SEQ ID NO: 10694 - DNA, 271 bp, Homo sapiens
atattgagtagatgtcttggactcacccrgtaactcagggctgtggaatgaaggtaaatgtaaaawacaagcgtgagtcacagwtacattgtctgggaaagtcaaacttagtagctttgtgagtcctgttggtaatgctttcaggacwcatttatagatcaaaggggccaaagttacattttttaccgattagattcctgatcatttaggggttgccaagattctgctacccactgtagttaataaagagaaaacttgtctctaaaaaaaa

SEQ ID NO: 10695 - DNA, 270 bp, Homo sapiens
  misc_feature 192: n=a, g, c or t
gagaatttacaccatggaaactggcaaacgctgcaaacactgcctcccaccatcacagacagccagttattaagcatttatcagcacattatgttgccagggactgtgctcagagttattggggggagaggcagtagcagtgttatgtagtcaagcttataactgataaactgtagtcatttggaaaaacanaagcaacgcagaggagatgggagtgaaccaagaacatagtaaccaccctgaacctcctcaacaaaccccakaggacat

SEQ ID NO: 10696 - DNA, 521 bp, Homo sapiens
aaagagcagggaaataaaggagaagagaacagaattattaccatgaatttttggaagacagacagaaggtgagaaaaagtatatgagggccttgtaattgcatgtcctcaactttttatctcagttcatcagggactgatggcactccatttggaactaagggaaaataacacgttgaaataggcagaaagaaatacttgttcaggttggttaacgaaagtgagccacaaacagcttatttgttcagttttctttgactctgagaccatagtgggaatcagataatggaagtcaacaactctgtgtcatagaatttcctggaggactgacaattacattcaggaaaaaagcaaaaacctttagtataagcaccctcagcaacaaggcaacctgaacttctaagcatagagtggaaatcaaggaagatggagatcctgaaagtttacagtgaaaaaatagtaaatgtatattaatggttcagaatctcattgtaactatttttactatgtgtatttagggtg

SEQ ID NO: 10697 - DNA, 344 bp, Homo sapiens
tatatttgagtccctgcttttaatttttctgggtatatacctaaagttggaattgttggatcctatggtaattctatgtttaactttttgaggaactgccaaactgttttctgttgtagccacaccattttatattcctaccagcaatgtaccagggttccaatttctccacatcctagccagcatttgctgttttccatttttggtaatggccattctaatgggtgtgaagtggtatctcattgacttgcatttctcttaatggctagtgatattgagcatctgttcgtgtgtttgttggctatttgtacatcttcttcaaagaaatgtttactcaggtaaaa

SEQ ID NO: 10698 - DNA, 379 bp, Homo sapiens
  misc_feature 319: n=a, g, c or t
atcatacacctgggagggcacagcatggggactcagggatgcaagccaggtgccaggtgctgcagcctcagagcaacaatgtttgataaataggagcttaacagccatcttggagctcaaacataagaaggaaagaggcagagtcagcgtcctcatcccccgctactttgtgggagtggtttattatagagagagtgggagaaggaaaaccaggcacggcaactgcaaacatgctaaatgatttccaagtccaaatagagaagaaaacagatagggagctgatgcatttataccgactgacatgtaaaccacaggacanggaccactgttcctaaaacctggctgtctagagcctcrttttgctcattctsarataagg

SEQ ID NO: 10699 - DNA, 419 bp, Homo sapiens
  misc_feature 411: n=a, g, c or t
aatcatcacaggcaggctctcagggagagctctgtatcccagggcactgcactctgagcccactcaatgacttgtatgggcacattatgcccaaaggtgtctctaaaccctcaaaacctcatgcagaacaagctagggtaatacagatctcaactgcagtccattcagagggagaaaatatgaaaatggaaaactgggtctgtcctgagaatgtttactatgcaaaagaaagtgcaagccaggaagagacaggtggtgaagaataaagagcgctatggtggaaaatgagcttgagaatgtaaaacccgccattagaggaatgaaaatgagtggggcttctctggaacggcagtaagcatttggatgacagtaatgatggatctgtttcagttgagttcctacatggtcatntcaatgac

SEQ ID NO: 10700 - DNA, 470 bp, Homo sapiens
atatgcagtagagactaaataaatatttaattgaacttattaaaaataattcagtcattatgttttaaggagaaagtggacaagtatggaggctttgaagcataaattgtgatttttaaatttttatttatttttctaacgtttgaagtcttctatgtgacagtttgattctttggtttttttattatttccatttttcccccatccaggaaaatgcttgtgcacgatgtgtgctgaaatcttgcatttgttgcctttggtgtcttgaaaagtgcctaaattatttaaatcaggtaaaatattttaaaaataaatctaatatttactttcaaagataggttcattgtttcttctcccaagataaacttaattgaaagatgttatgtttttcttgtggtattgtacattgtgccttgataaagtatgtctatttcaatcatattcttattttttaaattaatgtatatgct

SEQ ID NO: 10701 - DNA, 288 bp, Homo sapiens
tttctaggccgacaagtccagtcaacagcagtctgccatwkgctggggaagaaaatggagaaatgttggtcaaaggttaaaaaccwwkttgtaaggtgaacacgttctggagatttaatgtacagcatgggtggtcatcaatgtgttaattttkactgtkgtaaccattacagaatgtatatatatacatcaaaacataactgtacatcatgaacatatacaatctttgtgaagtattttaaaataaaaaaggaatgtttaccaaaaaaaaaaaaaawtgcgaaaasc

SEQ ID NO: 10702 - DNA, 299 bp, Homo sapiens
aaattaagccaaaaggtcttaagtgagtrtttctcagcrrcatcgagccatagcaccttacgccagakgggcagcccggttctccaaacccattgcaaagttccctaccacacaggcaagctatgcggggtcctaaagagacagaaaccgcacaggaatagatgctgcccaggaggctgagggctgggccaggttcaaggggtggagcctgtggcagtggttggtggaagaaccagccgctctttgaccatgtcaaagtcttcatcacaaattaaattaatctgatcccttaaaaaaaa

SEQ ID NO: 10703 - DNA, 470 bp, Homo sapiens
accaagtttgtgtaagcataaagatatcagcacataagaagaacattcatgaagagaccttaaaagcagatgcttggtgtaaaaktactcatgccaagakattctctaataatgagcaatgcatcacctatctcaaaagaggctccccaaaccctcggatttattaggactaactggccggtctcttactctccagacaaagtacttacactttcttcgctgacagcattctctcttattaatttatacccatatggaccgaaaaagctttcacttatgacataatatagaatttgcatctatctctacagtaacatgacccattttccccccttcattatgccatagatttctactttttctctctcaagtagcaaaacaactatttctaatgatggattaaaaacctgaagctgctattccattatgaacctctatctagtagctactgcaaactgctcagctccttt

SEQ ID NO: 10704 - DNA, 85 bp, Homo sapiens
cagaaagggctgtgtatagtagggccctgttctccttaggatgttgcttcttgattttttttttttttaggggtgggtsagggtt

SEQ ID NO: 10705 - DNA, 540 bp, Homo sapiens
  misc_feature 517: n=a, g, c or t
agcccgccagcctggaattgctcttaggccagggcagattagccacctccacaccctttccaaaccaagtggcagcctgagccccagttctccttcaattacctgatcaaggaatctcaactcccagtgtgagtttttcccaccacagcgtgaatccaggttgttcctgcaatgttatgcaatgtgagtggagctttctaacaataagagcaccatctatggtctggctgtctgctgagcagcctcatctgtcaaaggagcagaaaattccaaagcatgatcctatgaatcaaacctgacacccacagacacaggagctccctcctccccaaccgccaaaccctcaagcttccacagagatctgagcctctctgggttgaggaagagagggactgttctcccgtattaatcagatcccattaatttttcaaagtagacaacagcccacttactcatctgctgtggagcctcatccataattgatcctgaactgcacttaccctaacagaccgcgcanatgccggctgcacatagagctct

SEQ ID NO: 10706 - DNA, 420 bp, Homo sapiens
  misc_feature 132,322: n=a, g, c or t
ataacaaattgctactgtttaaatgcagccctgccaagagtgctccagagtcttctgcaagccacagccagagtgattgccagagaatcagagagcatcctaggtggatttagacacataggctggccacancaagcctgccagcttgactccccagccccactctattgatcagcatggggagacttgatttttataggcttttatttgaccttgaaaagttaagttacagaaagactagcaggctcatgccaaccctgaaatgttttcctttttagtcaaaaggcaatgcccacaaaggcttttattcaggcagttgaanggcacaagtgaaggagaaaattgttkttgaaagaccgctgggactctttgaaacctagttactttggaagtattcgtggggccagtatagcattagga

SEQ ID NO: 10707 - DNA, 304 bp, Homo sapiens
gatgagatcattggagtgggccctaaagcaacaaaactggtgtccttataggaagagggaaatgccatgtggacacaaacacgaggagaagacgactatgcgtgatggaggcagagactggagtgatgcatccacagccaaagaaggccaaagactgccagcaaaacaccagaagctagaagagtaaaggaaagcttctcactacatgttttagagggagcatggcctatgacaccttgactttggacttctagcctccagaactatagacaataaactgttgttttaggccaaaaaaaaaaaa

SEQ ID NO: 10708 - DNA, 499 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcaccacca

SEQ ID NO: 10709 - DNA, 418 bp, Homo sapiens
tggatgccccggtgtgaccgccgggggsgcccggggcckycggcgcacctccacacccgccccaacgcgttctctggagctttgggcctcagggcgcctagaaggcagggacgcagacctgaaggcggccggtgagcggggcgggttctgctgggtcgggaagaaaaataattctgcaaggtattttgttttttattaattcgcgcttggccacctcatctgtaaagagattctaaaagcaagatctggaaaagtgcttcgtagactccttgacggagtttgcctcctttgtacgctgcgtgaacatgcctcacctttaagagagtcttaaaggtaaagacacgaaaacacttcctccagggaccttcccgaaaacgttctggctctcatctggtgcggcatgtgtccactttgcctt

SEQ ID NO: 10710 - DNA, 194 bp, Homo sapiens
attatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaa

SEQ ID NO: 10711 - DNA, 474 bp, Homo sapiens
attgagcgcctagcatgtatgaaacacctcgctaaggactcaggataaaagagtacttctccttgaggaggacacagtctgatggggaaacaggagtgtacacagatgtttcttcatgatcttgtggaaagtcttctttgagtatggcatttcaactgaagatgatgaccttccgtgaagcaactgtacaattgcaaagaagaaaatgaaaactcctgtgatgatattagaagacatggaaagagcattttcagtgtcctataagaagatcttccagtgatattgaaaatcaaatcatgagtgatattgtggccagcatatctaaattaaaaaatattttaatgaagtccataagaggataatataagatggaaatgtggaaatacagaaagaaataaagagaaacagaaatacgaaaaacctactacttattttggagaattctgtcaaagggaaacaaactaccaggttcca

SEQ ID NO: 10712 - DNA, 486 bp, Homo sapiens
  misc_feature 95,173: n=a, g, c or t
gagaaaagaaattatgaataagcctcgttatgttcaataattagcagctacatggaaaaaaacaaaaccatgaatttaggttgatgcatttatsncagtgtttgaatacaactctgagtgtgttattgctttaaaatgagattctaacaaactgccaaaaacttcttgactancagttgttactcagtgctataatttaaaaattcatcctgtccatctcttttttctcctatttatattcttccccagcagaagattggtaactaatgggtaatacacaacattccaagatagattctggtatcttgagccaacatatcaggagaatggtacagaaaaactgaacattaccagcccctctaccttagctaactgcaaaatgaacaacttccaaggacttgctgctactctcccacaaaatgaaaagtctatgtatcaagatgtagaatagtacagctaagcacaaggctcctccccagtcaaaga

SEQ ID NO: 10713 - DNA, 58 bp, Homo sapiens
accacagcctccacctcccggcttcaagtgaatctcctgcctcagcctcccaagtagc

SEQ ID NO: 10714 - DNA, 468 bp, Homo sapiens
  misc_feature 413: n=a, g, c or t
gcgaatcaaactgttgctgtttgctgatgatgtaatcatatacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccanaacaccaccatcattcttcacagaactagaaaaaacaatcctaaaattcatgtgg

SEQ ID NO: 10715 - DNA, 59 bp, Homo sapiens
aaagactgcagagtctttcgttctttctggtgcagcttaactgatttgaagaagccgaa

SEQ ID NO: 10716 - DNA, 433 bp, Homo sapiens
agtactggccatgtctgtactgtgaagcactgtgctggaggatgtagaaaaatataagggagaagatgaaatttccaatcaacttcacagtactgttttaaagagacagaatgaccaggcctcttctgatacaggctcccactatatgcctctgcagatgtaggacaggctgtaccaagagttggttttctctcaggaaaaatggattgggataatccagcacagctataattttgttactatttttattgtacctcaatgtgatttgaagtatgaagggcagcgaatttgaatcgtgggattaccagcttgatccagaagtcctaaccattgtcttacaggtgcctggaaaatgctgatatatagatggggcaaatacccaacaggctgatgtcaggtgatggatgcactgtgatgtggacttaaagtgggc

SEQ ID NO: 10717 - DNA, 396 bp, Homo sapiens
gactggtcaaggcagtgcaagaagtttaacctgtctggaaatatggggacaagaactggaaagggcagtctgtgcatgaagattccaggagaagcctgatgatggaaaaccttaaaatcacatcgagtacagatggggtttcaccatgttcgccaggatggtctcgatctcctgacctcgtgatctgtccacctctgcctcccaaagtgctgggattacaggtgtgagccaccactcccagcctttgtcatcatttcagatagggtgaaggaatggtttaagtcgcctccaaggtatcttgttgggggtgaggggtacagaggggtcttactgaatggtgatgaaaaaggttacacaagcgaaaaatcaacatttgagaaaagataactaaaccct

SEQ ID NO: 10718 - DNA, 443 bp, Homo sapiens
  misc_feature 405: n=a, g, c or t
aagttctcactcttttgtaatgtgtggtcctcacttggcctctgggacacctccaagtcttagttgtcttcctaactcactagttgctccttctcactctcctttgctggttcttccttttctccttgacctcttaatgttagagtcccagagtgtagtsatagtccttctctgtgatctatttttaccctgtctttgtgatctagtataatggccaccacctataaacttatagctcacgaatttatatcactagctctgagatctctcacgaactccagatgtgcacatctgactgcttactcaacatctcgaatgcctgttcttcaagagtttgagtcatgaagtgtgaagcctagagatggtgtgatacacagagatgaaactggttttcacaggtgatanatggaaggctgttttcaaaagatcaagctttgaccaca

SEQ ID NO: 10719 - DNA, 65 bp, Homo sapiens
cttsartaattaagtctccagctactcttttggctawtacatctttggtttctgcsattttcccc

SEQ ID NO: 10720 - DNA, 421 bp, Homo sapiens
  misc_feature 402: n=a, g, c or t
attttctcgcagcttcaccatggtatctatcttgtattccagctgcagacctccacattcctcagataagtctttccttttttgtactcctttatatgtcagtgtgttcctccttttgtctgggctgtcatttcccttacccacatagagaactccttcctttcaagaatcaactcctgtgtcacctactttgccagtacgatctgttcctctctctctctcgctccaaaagactaatctgcacactctgttacagcacttgtctaattgtgctgtagcgtttatttacatgtttgtttctcctctagccagtgagcacctctcaagcagaattatcttccttgtttctctggcaccctaaatatttgttgaattaatagtccttctcttcttttgtaattntgctttctgtaatagaagc

SEQ ID NO: 10721 - DNA, 500 bp, Homo sapiens
atcagctgtgggcctagagccaggggtccctctcactcctacatatacttccgtgcctacaaaatgaagggattgaaccagatgacctgacactctttgtttcctaaaacagttttggaaacctttcctaaatgctcgtgcacttaactttcttggttccttcagaggtgaataaatacagtggatgtttccctgtttccttgtggtcctcactacctgatggtgacttatgagacaagatgggtctgtttttaactgcccctaagtggggtgtgaaattttcacccacacccacctctccacaaaaacacacctctgagttctctacgtttacccctcactcgggaaatggaaattgctttgatttatcctgagcccaccttctgaaaaggctgctttttcctgttgtctaggattggtttgcaacctttccaagtcttttcatactgtatgagtggtgaatcttcgagttagaggtggtattacatacaggatttctc

SEQ ID NO: 10722 - DNA, 149 bp, Homo sapiens
tgcagtggcctctgtgagccccagcctgagccagtcccagctgtgcttggagtctttatttattttaactatttcttcaacattccacatttgatgatgatacctctttcttccctgagtgtatatgttctaatacaaatctttttgtt

SEQ ID NO: 10723 - DNA, 109 bp, Homo sapiens
agcaggttaccaaatgtagccaaagatcagactcccgtgcagaaakgkaaaagacattcatgacagatgctgcccgccgagagcaggagtccctaaagaagaagattca

SEQ ID NO: 10724 - DNA, 383 bp, Homo sapiens
  misc_feature 71,366: n=a, g, c or t
acgcggccccgstcggggaggtttccggcccggggccgactgcgggtggcatttctggctaagccgttasngaattatatggagatatatacacacacgtatctgaaaacattctgacgttttaaaaacggagcaccagaggagggggacttcatctgacttgttcagcactgtctcccaggccctggcacagagggagcactcgatacacaccgatgggctgaagaccctgagccgttgtcaaaacacagcttaatccccattccctgggcccgagaccctgcagcccccacgctgcccggcttccgtcttacctggggcaacctgaccaacaagaacgcggaakgccatgagccaaaaacaganactcctgatgggtaaca

SEQ ID NO: 10725 - DNA, 414 bp, Homo sapiens
atactaagttggcttaaaggtttagaaaagtagggtgtcttcgttcaagaatttggaatgtgaagctcccagtatcttcatgtgtcctcatttaagtcaccattagattcagcccaacaatgtggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcac

SEQ ID NO: 10726 - DNA, 485 bp, Homo sapiens
catctgcaaatagacaatttgacttcctctcttcctatttgaatcctctttatttctttctcttgcctgattgccctggccagaacttccaatactatgttgaataggagtggagagagagggcatccttgtcttgtgccagttttcaaagggaatgcttccagcttttgcccattcagtatgatattggctgtgggtttgtcataaatagctcttattattttgagatatgttccatcaatacctagtttattgagagtttttagcatgaagggctgttgaattttgttgaaggccttttctgcatctattgatataatcatgtggtattcaaccaaaaaaagctcaggatcagacagattcacagctgaattatattaaaggtacaaagaggagctggtaccattccttctgaaactattccaatcaatagaaaaagatgaacaccacctaactcattttatgaggccagcgtcatcctgata

SEQ ID NO: 10727 - DNA, 270 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccagctggtctggaac

SEQ ID NO: 10728 - DNA, 492 bp, Homo sapiens
tctcgcctgccgccatgtaaacgttctttgctcctgcttcgtcttctgccgtgattgtgaggcctccccagccatgtggaactgtgagtccagtaaacctctttttctttataaattacccagtttcagatacgtctttattagcggcgtgagaatggactaatacactaactttctcagtgagcatcttattccagttataaaactacctctggttctgaagatacaaagataggataatgctaactatttctttgcataaggcavgtgaaaaaatacagatgacctgatatcttctatctgcctactctctctaccttttgaaagctctctttctgttgctttaatagcattgaattgatacgccattatwgtgtctattcctttcacaatacccttaaataaagtcttacttttaactttttccagttgccgttttggtttggctgaaccttagaaaaattaatagtttacagtaaattaggtggagat

SEQ ID NO: 10729 - DNA, 496 bp, Homo sapiens
actttaggtaaacaattttgtgataacatttatcccctgcccctctcccctgttgattttttctggatgaggaawkcaaggctgtgcagccacgtaactcgtgtaaggacacacaacagtgcttatgtctccatcttcaggtcaaaccactttatgaagggcctactacatgccaggcaccaggctaggtgctagggaattgaaaggacccttttcataaaaccatcatgagggtctttgtgatttagagctcttctactaaaagaaactatgcatttactcctgtcaacttctttatgatttatgtattaagattagtcataaaagaaaatacagactacagactgttgctctggttggtcctcaaattcatttagtggtgacagagcccctagaagttttagcattcttcctgtgacacctcaaaatgttaaaaaataagcttcgaatagctaatgtataattttgtaataagtcagactccttatataataga

SEQ ID NO: 10730 - DNA, 483 bp, Homo sapiens
  misc_feature 75: n=a, g, c or t
agaattattaactagtatgtggtagataggagtcaaatgataaatatccaaccaggaaggttactgtaacacaknagtgaatcaacagactatcctctcccagaaaagctctttgtgtgtctggcttcccacacctaatctggaaktacaaacagtctgtgctacgtgtgccggatttctgtggactgaggcagaaaaaccctaagcaagaagagaaaattgttttgtattcatttcagcaacaagagactgcagtgtcacagagtggtcccartgcagggacatctcatcagacgtcaccccatcgctgtgccctgcctttctctggttctttcccactgttcaagcactttgacactttgtggattatgctttcaggttctttcatcaatttaacattaaaagtcctgtgaaatattaatgaaataatgtttttaaaaaagaaaaatgttcctacaatactgcaacattttaatgcctcat

SEQ ID NO: 10731 - DNA, 269 bp, Homo sapiens
gagattggaggggtgggcaaatgggcatgtttttaacacgtaaaaaagcttggttttatcccaagaatgatgagcagtctgtaaagggcttaattacggcaggaaacaccatattattagtgttttaagaaggtgacactggctatttggttaggtggcatttgtattgtagtaggtaacagtgaatgtggattgcttggtttacagaactgaaaggcttggccactcaaaggccatctcaaagaccctatctatgaggaagaagaaaa

SEQ ID NO: 10732 - DNA, 168 bp, Homo sapiens
agtcaacakaatggagaaaagagaaatttggtttgaaatgaaatttgagtcttgagakagggctgatatkwaggagaatcaaacaagssacatgggagcatctgaaggcctggagataagggsstgttgcatggctgtgaaaatttggcctttaaaataactaggcat

SEQ ID NO: 10733 - DNA, 266 bp, Homo sapiens
aacttgtttttgggcaatctagccaaggtgtcacataatggagaaaaatgcagatggtcctgtggctggtgtgaatgaagaatgacctgggcccaacatagaacttttccagtatggtctctgcatgtggggagccaaactctagagaagacatcagtgaactgctgatttggagtgactgacacttattcctgagagtaggtgattcttcagtatccaaagaaatgtatcaagtttgtattagatggaatatagcttacttttgt

SEQ ID NO: 10734 - DNA, 472 bp, Homo sapiens
ctatcaagcagagcagggggaaagccctcaaagcagaaagagcaaagctgcatggtgtgaagactgcatgtgattcaggaaccgtgagcaatggtagactcgtgccaaagcacagtgtgtaaggaagacawggctggaaacgtatgctgaggtctgactgtgagagtttgaagccccactgagaggtctgcacgaattaagaatttcagagaaacatgattagttctacaattggaaaaataattctggtgctaagaactagtaaggtataagataagcctaatcacggaggatttgaagttgaaaagagtttataagttattctttaagaaatctctgttattgaggtgtgaggcagagcagtacataatgtctacgttctgaaccaactgaacggggaaacaaaaggctaacattaatatcagacatttgtagagcatttaccttgtgccaggcaacattctggatgctt

SEQ ID NO: 10735 - DNA, 88 bp, Homo sapiens
  misc_feature 88: n=a, g, c or t
aggctcgtggaggcgtccgarctccagggcagctctggggcagaactgtccggatctaacaatccctggggagccggagaccggtgan

SEQ ID NO: 10736 - DNA, 264 bp, Homo sapiens
aggtcgggtggcttctggggccttctgakgaacatgcacaagctgctacagctactggagctatgggaaaagtgttttagaatggagacctttcctctgcggttcacggtagatgagtgctttccgcgggcatcagagtatggcgactgaaaggcagtgcgcatgcgcccacacttccttctccagccttctctccgaaaaacccagtacagcctgggatttgggatttaacatttctaataaaaacttgcatttgttaaaaaa

SEQ ID NO: 10737 - DNA, 206 bp, Homo sapiens
attgagggagcccggaagccacgcgctgtcagtgacatctcgtgagcagactgtggtgagggtggcggtgtcccaaaggccttgctgttcctgtggtgctctggggccatgaaggccggcctggcaccccggtcgacgaccaagcgggtggtggggactactctttctacctggctgatgagccagccaccatcatccgccgtcca

SEQ ID NO: 10738 - DNA, 454 bp, Homo sapiens
tattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtg

SEQ ID NO: 10739 - DNA, 485 bp, Homo sapiens
  misc_feature 275: n=a, g, c or t
gagctctactcgggggggaaaggaggggagagcagagatgcagggtctgcctatcctgccaggcaggattgagaacaggtggaggatgctcgggatggtgttagcagcgtctgaccagcctcttgagaccatccggcagccctgagcttggttactggttgtcagggaattcgtgcatttattcaggaaacacgattataaccagccctgtgctgggcctggcaagacacacacagttcctgctctcagggagcctactgttgaggggaagaaanagacaacaaacaaggcaatggcaaaaatataaaggcaatggtgacagccacacaggaaaataatccagtgctctgctagaacaaggtttgggggggtgccagaaagtgtattaggctgggagctggggcccaggacagcattggtccggcatcactgcccccagaacttaaaaaacctctgctgagaggaggctgtaaaaccagccctgg

SEQ ID NO: 10740 - DNA, 381 bp, Homo sapiens
atkttaatktatcagccaacacctctcctgtgcacctatkgcagacatcattaatccatcaaggcactctcctgtttagcccagtccctkcttcagagctcttctcagtattgtgacccagacagcggctacccatcaaccagactgccacacaggacagaaatctagattattacataatccatcttgagaatttagaagaataatatcgccctcgtgcctggcttatatagaamaagggacagcaagaagacagataaagtggagcacagaaagaaggatgaaatgaaaattatttgtctattttagacaagcaattttctctaatgttctgttctcttgtttggttgttctagtgagagctcaaggaccttttaaggt

SEQ ID NO: 10741 - DNA, 415 bp, Homo sapiens
acacaggtcacgcgcgggcccccacaaacaagctattccagccacacagatgcaaacctcatagcaacacgagacagaagacacacacacgctctcgtgagtaggctcggaccgcgcaccggcagacgcacgcgaatacccataagcagccccagacacagaccgtcctacagctcccggtcggcacaggctggcctctatgaagcatgcagccgccctacctggttatcccggatacaagcaccaccgcctcgcacgtgctcgttcaccctgggaacacgggggccgcagctccacggacaggcaggaccggcccgcagtggcctctgggcaatgacttgagacaggggaaaggcgggaaacgctcggcgcgaagggctctgggcctcgtagttcggagggcgaggctgtgctc

SEQ ID NO: 10742 - DNA, 514 bp, Homo sapiens
aagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagtttttattgtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaagacagacattccttctacatgtaatgacacttcttgtgttaac

SEQ ID NO: 10743 - DNA, 475 bp, Homo sapiens
gaattagtcccctaaaagaagaggccagagaaccagctcaccctactttttccacttaagtaacacagtactctgtagaccaggaagaggatgttcaccaagaactcaatcctgctggaaacctgatctcagacttccagactccaaaactgtagtgcaaaattccacatccacaaaacccacctggccagtgatggcttgggtaaggacggagaatgcagtgggatcagaaccctagagtgggcatgaagaggagaaaaaacaaattctgaaatcaccatggaaacactacagaggtatcagcccacggacactgccgtcctacaatgtgacacaaaaaggaagaaatcattaaggctatagattacacaggctttaagacaaaatgacaaaaatcttttagaatataccattttctgtacaaaacatatgaaaagtcagtcatatgtccagataattaaagagaaaaaaacac

SEQ ID NO: 10744 - DNA, 481 bp, Homo sapiens
tagttatgtttaatgtcagtattctgtaccttaaatacattatatattcatgccttattttaaacagatctttgtataatatacataataggttatatattatactaatctgaggaataaaggtaagaatatttttgttagatggtagaaatttataaagcaagtagcaatgctgatgtttctgtacgatcaatatgcagcacaatctttgaagtgtgaagagttgtctctcttcattcatccttggttttgctgcctgcagccattattgtaatcaaatggtaactttattctctgtgctttctacttgagtcagactgtattttcttatacccccccatgcattccttctattcactgttgccatggtatcatcttgaaaatgtggtaaactaattatggggtcccccccttttatggtttatctttttttatttaaatactcacaagtttatatatttagtacattaaaacctatgac

SEQ ID NO: 10745 - DNA, 468 bp, Homo sapiens
  misc_feature 429,432: n=a, g, c or t
ataagactgtgtacagagcagcatactaaggctgcttctgcccaggtacagtggcacataggtgaaagtgtgaaactgttgctgcattttgtaacttcttaacaatctctggcagctcatttgaaatttaccaagtgccctttcccagatgttggtaaaaacattcctgctgatagataacagaagctatggaaaaatcagcacccagctgataggtgcagaggtatacaaagccctggagggctgttggmataacactactcaaaaattttctgaaggaggttgaagcaggtttaagggtttgagttttttgaaacaagtgccaaggacaacattaatgtcaagcagacatttgagcgccttgtggatatcatctgcgacaaaatgtcagagagtttggagactgatcctgccatcactgctgcaaanaanaccacgagactcaaggaaactcctcctccaccgcag

SEQ ID NO: 10746 - DNA, 478 bp, Homo sapiens
  misc_feature 162,298: n=a, g, c or t
agttaggccactggaagcatggcaaaatattgaaaatgagggattaggtgacagtgtagtaactgctgaatactaaatacttgatccaggccccattccctggagattgacagggagacacattgtccaggtagtagtggagaaatgttttctgggtatctnabcagcctttgtggaargavctggcaccatcctgcagatgtaaccscctgaygggttcttcctgaccaatgtacacaaaaactcaattcatggagaccatggcactgcaggaaacggtttcattgacacakgccanccacgacatgtgggagacagagttattactcaaagcaatctcactgaaggcttggaggtaacaactaatgttggaattatgaaaagctcttctctacttttaacaaagcttagtcacaaacagttccccagttgatgagaaaaactaaaacaacagaacaattgaaagtccgaatctgca

SEQ ID NO: 10747 - DNA, 468 bp, Homo sapiens
gtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcakggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggat

SEQ ID NO: 10748 - DNA, 277 bp, Homo sapiens
tttaaatggtgaacgttgagctctacccaaagataaatactctgcttttcttttagtcatttttaaactattcttgttattatcatagactttgaagattttcctatgtatttttacccccattttttaaggatttcttgtttcagtgttctctaggtaatggtattcaccccaaattttcatcctttaaagcagttgttcttagtgggctgtcacgagaagattgagttccattatgcgaaawgggtatcgttacacctaacagacaagaaattct

SEQ ID NO: 10749 - DNA, 475 bp, Homo sapiens
aggacgattccctgagccttgacaaagcaggakccctccgtggcggtgcgtcggtgtcgaggctccagtctgactaatccagggggtcgacaaaacagattcgggacactatgctacacggagggcctaccaggatgcagaaacagcagacggagccagggaaagcagtgcgcatcccagcctcaggcctgcccgtacggtgttcggacggaatgaagttgataatagtgagaccttgttggtacaagactatgtaacataacctgcgcttctcaacaaagaattgcttttctgacttctgcactcaactactcaacatgaaggcaataagaatgaagacctctatgtataattgacttccacttaataaatagcacctcctacgaaccaggatctgtacttgctgtcccagttataaagtaaaacagcctgtccttcctgcactcaaggagacagctccataagcggggagctt

SEQ ID NO: 10750 - DNA, 150 bp, Homo sapiens
agaaagtcaaataacctaggccctgcaacattgcacccaggaatggattactgtctatcctacttccccaaaagagaattaacagcatagaaattatgcctaaaagccaggtatttatataccaggtttctcttactgataactctggat

SEQ ID NO: 10751 - DNA, 375 bp, Homo sapiens
acaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcatcatccttctaacaaacagtgtacactcccatagc

SEQ ID NO: 10752 - DNA, 305 bp, Homo sapiens
aaaatgattcctagttcagactgttcaggtttcagacacatactctactatattgagtataaagttgcttttagactggagctttagtcaactatggatttttttttccctcaatattctctcctctctagttcttcttcattcatgtgtttgaaaatatcttctgatttacttttaatgatctgtatcatttatcttcagtttttttttaaattgtctcacttaggtattaccattcacttaggtctgcgccacataaccattctgaagcttttaggcgttggagaggaagttgggggagtgtt

SEQ ID NO: 10753 - DNA, 360 bp, Homo sapiens
atcatcactaggtccttcagaatactttctttttttttcctgagatgcagtcttgctctgtcactaggctagagtgcagtggtgcaatctcggctcactgcaacctccgcctcctgggttcaagcgattctcctacctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggca

SEQ ID NO: 10754 - DNA, 455 bp, Homo sapiens
aaccaaaggtttgacctctaacagctagacatgggtgaaattggataccaagcttaatggggcatgcagcttgatgtttgcagaggagacagtctagcatttcccagtctgatatggaacatcaaagattgctaggatttctcagtactcagacattcctcattttgtctgaagtggtttacaggaaatctgtcattttttattaaaatggaaaactgtgaagaaagaaaaagatagcagttgaagtcaaaattctcggatgactattttgcttttgaggagtcagcatttaaaaacgatatgctgatttggaaggtcctgggagtaaactgcaaactttattttttccattcaatcaatggattttttaatcattccttggagtcgatgaagttcggaaacggtgtgtgatggggaacgtggcgggccaaatgtgttcctagaaattgcatctt

SEQ ID NO: 10755 - DNA, 318 bp, Homo sapiens
  misc_feature 193,253: n=a, g, c or t
aggattgtgaggccgcattctgtccccggtgagacctggctctgtccagttcctcccgggcctcccaacgcccccgatggctccttcctcctggccatctgtccggtccctccttcatgtcggtcgctggcccaccggtgactgcttggcttctgctggagtttaagggggctttccgctgccccgtactgangcatccccgcatcattcctgggcgtgtccccaagaacagccatggcctccacagtgcaanctgaagggatacccacccaccatcccagggtctacaacatccacagccggaccgtcacccgctat

SEQ ID NO: 10756 - DNA, 376 bp, Homo sapiens
  misc_feature 326,363: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccangctgttctcgaactcctgagctcgggtgatccaactntctcggcctccca

SEQ ID NO: 10757 - DNA, 271 bp, Homo sapiens
gtttctggttgatgaacctaggtagtaaggacactgaaaagcatgtgcaagacccagaggtttatttcaagaatttcctggctctgaaaatccctccgtgagtttcccctatggctgcttcattacgtcctaactcaagggaaggtctcgggcctttctttggcatgagccctgagctgaatttctgaagcaaaggccctgcgccttcaatcctaataaacgactagtccgcagaatcggacttggggatcctggaaaaaaaaaaaaaaaa

SEQ ID NO: 10758 - DNA, 449 bp, Homo sapiens
cccaccgcctccgtgctcctactgcggccgccagcgccgggcccgcagtgaggaggagaacctcattttcctcaacacagatctaaggggacaccgcctcactttgagacaacttgaggctgcgtcagtgaccttgtactgttgttatacaattcaatattgaagcgagagattctccagaacttgcccagaagccaagacgtctggaaaggatctcagcctctgtcagcctgcagcttgggaagagtgattcacagagcctgactgtccactgctgctaaaccatacactggccttggctcacacatctgactgaactgtctcctatgactaactgcctctctttcttcagccttgcaagtttcctgggagtcctgggagtggacttcacatataaaaggggactctgggagacctagttcctggcttctcttctggaagtcagggaa

SEQ ID NO: 10759 - DNA, 455 bp, Homo sapiens
taaaatcgatgctagtaataaaatgtgcccagtccaataagagtttggtatatgaatcaagagataatttgtattaagcaacaacacctatgattgagagactttcttatgcttgagagattgtagatgatttttatacacatttataacctgcattacatccctgtgaggtagctattactgtcctgattttagggataatggacctagatcttacagaaggtaagtaacttgcccagtaattaacagagcagattcaagcctagatctctctaatgaccccaaagatttccactgttcctaataccatttaaaactatatagtactgtgtgaatattagcaccataagactttttggagagaaatttggcaatgtgtgttaaatttaaatgtatatgtactttgtctcagaaattcaaattctgggaacttatcctaaggaaataatcaggca

SEQ ID NO: 10760 - DNA, 432 bp, Homo sapiens
aagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaa

SEQ ID NO: 10761 - DNA, 364 bp, Homo sapiens
catttagaattatattgctatcaggaatggtttcttgagaactggagcggaagaaaggctgtgtcccacgatatgtgatcctgctaataaagtggatgatcagacacaaagccaagttcatcttcccaccttggggccaccacagagccacgtggtaaccccctttttctgaaggaacggcattgaggcccaggccatgtgcatttccccctgggctgcctcctctgaccccaggattccagctcttcctcagaagttgtctccatctctgcgatgaaagaggagagcagggacctttctccctcccctcctctatgtctttctgaccaggtgcccccaggacgcctattgctgatgggcatag

SEQ ID NO: 10762 - DNA, 476 bp, Homo sapiens
  misc_feature 77..78: n=a, g, c or t
atactgcgcctgcsccgcggcagaggctcgtctctaccgggtccgctctcctccgacaccccagcaacgccgactcnncacccctttgagccgcttgaccagggcactcttctgcccgctcttggctaggcctcgctgctccagtgcggccttcaggtcggtcacccgcagcgcctgaagaggcttcccgtccagagtcacctcctccagctccgccatcttgcgtgaggtactcgggtccgtcccgacggcttcgggcatcttcggtaatttccgccaacgcccttcgaacgtaccgagatgaccccgcccactgccatactctacccctcgattaccactcagaactccccgggttcctccggatgtcctcggatgtttccgtctccacatcgttaccaatcaattctttccatccgccctgcagcgccccttttctcgccctgctttcaggctcggttttcttcgtcttgccg

SEQ ID NO: 10763 - DNA, 440 bp, Homo sapiens
  misc_feature 287: n=a, g, c or t
ataattgagaagatggcggaccagcaaggacctcatcagaataggtttccatcgtgtgggaagaacggataacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgassagcagcynaaatctcacaagcgaggaatgaaaggggacactgtgaatgtgcggcggagtgtccgggtgaaaaaccaagaatccacctcattgcctggagatcacgccaccatcttcagaaaagctggtctcagtgatacggttaagtgacctctctacaga

SEQ ID NO: 10764 - DNA, 71 bp, Homo sapiens
aaccgatatcgcgatactgcactccagcctgggcgacagagcgagactccctctcaaaaaaaaaaaaaaaa

SEQ ID NO: 10765 - DNA, 481 bp, Homo sapiens
acacagtccctggcttagctgacttccacctattaaatgaccccagatacttctaaactgggggaccaaaacaggatgttcagaaatattaaaagaaaaccaaaaagagcaaggctagcccgtcacaggtattgattgttccattgtggccagcctggaaacaggagcaaacctatttgcaagcatgaaatacctggagattttccactgcgcagttcacgtctatgtaaattttcttgaagaaaatttcttaaagatttggttcattaaggttaattgttccacatttagaacactcatgaacctaccaccaaattcatgaacttaagaacctcacaaaggaaaacggggcacagagaactacgcaatttatccgaggtcacacagctgtgtaaggagcagagctgggatttgatcaggttaaaagagactctgtggaccctctgctacatgctgtgagtgttattataaatgtcttctg

SEQ ID NO: 10766 - DNA, 162 bp, Homo sapiens
aacaatgttaaagtatcagactgaggccctgaatccggagacttccaagcggtatctctctgcataattgagtgatctaggaagagatttcaactgtttaaaagctattcactcattaaaaaaaaaaaaaaaaaaaaaaaaaaaaaaaaaaaaaaaaaaaaa

SEQ ID NO: 10767 - DNA, 506 bp, Homo sapiens
aattgtgacaaagagcatggcttttggagtgattctgagctatgtttgaatcctgactccagcatttactggctgtgtgactttgaaacctctggagtgttctaactggcaaaaacaatggtactttgcggttttgagcctgggaaacctaaaaaaaagtaagctgcatgcctggttgtgctgtgacatctcgtaacagacaggcagttgacactggctccatgaacaacagccaacctcctcctttgcacacagactgaaaatgggaaacatgaggtttgggaagagtcttagacccattttattaccaaatagttgaagcttttacttggacaaatatatttgcaatttcaaaatccacaaggatttggtttagaaattactgatgaaaaagaacatcaatcagccatcccacaccctgttgaactccttggagaactgaatgagaggcttaaaagaggtagttttaggccaaacagtacaagaatatattatattatgtcata

SEQ ID NO: 10768 - DNA, 421 bp, Homo sapiens
ggcaaatcatttgggtcccgtcagtattgtggaagctttgttcttttgctttttgcagtaaatgttggtgctggtcactctttgggtctgtgctgcctttatgagctgtaacactcaccacaaaggtctgcagcttcactcctgaagtcagcgagasatgaagccaccgggaggaaagaacaactctggacgcgccaactttatgaactgtaacactcaacgcaaaggtctgcagcttcactcctgacgtctgtaagaccatgaacccaccagaaggaagcaagtctggagatgtccgaacatcagaaggaacaaactccagataaaccgtctctaagaactgtaacactcactgccagggtccgcggcttcattcttgaagtgagcaagaccaggagctcaccaattctggacacagcac

SEQ ID NO: 10769 - DNA, 329 bp, Homo sapiens
atcagcctaagattgagctaggatccaaacccactctcactcctcaggagcgagggtagagagaaagatgtgattgcttccccttctgccatgatcggaagtctcctgagacatccccagccatgtggaactaatcttatcatatctggatacttgaaacatcccacagaacatcaagtggtctgctatattaaagacataatgcagagcaaaaaagactagcacactagaagtcttsgaagagaagcactctggaatcctagaagaactactttaaacttctgcagaaggaagtggatcttagcaacataagatcaactatggtagta

SEQ ID NO: 10770 - DNA, 354 bp, Homo sapiens
  misc_feature 305: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggangcccatcagactaacagcagatctctcggcagaaaccctacaagctmga

SEQ ID NO: 10771 - DNA, 127 bp, Homo sapiens
attttggaagattccagaaaaacatgaacaagtgtttgagtgctcttaaggggattgtctaatatcttggctcctgactcatccttagaagtcttccagccaccttgtacccatttcaagcccaagg

SEQ ID NO: 10772 - DNA, 263 bp, Homo sapiens
aaatcagatgttcaagaggaacagcagcagaaatggtagcagtgaamtagasaagaaacttsgagaaaatctaagagatgcaagaaacagtctttttacaggtgatacacttggagctggccaattcagcttccagaggsssttattagtssttgttgacagaaacatagatttggcaactsstttasatcatacttggasatatcaagcattggtgcacgatgtastggatttccatttaaacagggttaatttggaagaat

SEQ ID NO: 10773 - DNA, 320 bp, Homo sapiens
agttgtctctgaaagcgctcaccaagctcctgtttgaggtgatctgagggtggtgagccctgcccagtgctggagaatgaaagaggcctgcaaataaagcttctgctcttcggtaggaagtgctccttcatcatccaaagtggtccccaccacaagctgcagggaaaccctsaragctggagccaaatgttctacagaagtaccagatttgtggcacccactctggtccaacctccacttcccaatgttagattattgcatatattgtatatattccatatacatgtgtatatataataaagtgtgtatattctaaaaaa

SEQ ID NO: 10774 - DNA, 203 bp, Homo sapiens
acgacgcccagctaattttttgtgtttttagtagagacgggggtttcaccgtgttagccaggatggtctggatctcctgacctcgtgatccgcccgcctcggcctcccaaagtgctgggattacaggcgtgasaccgcgcccggcccctsataaggtatgttcttttacttcaaaataaaaaatagtattaaatgaaaaaaaa

SEQ ID NO: 10775 - DNA, 347 bp, Homo sapiens
  misc_feature 88,180,296: n=a, g, c or t
ttttcctcgtcttccaccgctaatgaatacacatccctctgctgaccagcggctgcatatcccagttgccagacgaaggcccaggtwnctcttctctactggataatccgttatctgtgtgaagagccagttscctcctctgggtggatttttgtgaagctaaactgatctttggggganaaatgcattctacagaaatcaatgcctttctccctctagtcatcttttttttctcttattcctttgctctcaaatatatcctgcataccgttatttaaaaacatattatctaagangactccaaatgtaaacggttgaaatttttcctttccaccatactttctgag

SEQ ID NO: 10776 - DNA, 375 bp, Homo sapiens
awcccgctggggkccccttcaacactgtggaagctttgctctttcactctttgcaataaatcttgctactgctcactctttgggtccacgctgcttttctgagctgtaacactcaccgtgaagatatgcagcttcactcctgagcccagcaagaccacgagcctagcgggaggaacgaacaactccagacgcgctaccttgagagctgtaacactcaccgcgaaactctgcagcttcactcctgagccagcgagaccacgaacccaccagaaggaagaaactccgaacacatctgaaaatcagaagggacagactccagacatgccaccttaatagctgtaacactcaccgccagagttcacggcttcattcttg

SEQ ID NO: 10777 - DNA, 372 bp, Homo sapiens
aaaaaaactaggagctcaatcatttgtttgacagaggatttgttcataagctttgtatgactttatcatttatgtgacctctcactttttatgtcattttgtctctctagccaacttctaaagatcaggtattggccatgctagagaaagccaaagttaacatgccagccaagcctgctccacccactaaagcaacttctaaaccaatgggagggtccgctccagccaaattccagcctgcatcagagatggcatcttgctctgtcacccaggagggagtgtagtggcgtgatcatagctcactgcaacctcgaactcctgggctcaagtgttccttctgcctcatcctcccaagttgctgggactacaggc

SEQ ID NO: 10778 - DNA, 379 bp, Homo sapiens
aaagtctagtgggtaggcctggaagcttattgagcaaatatgattttagtcacaagtagacaggatagtctggactaataatgaaaaatgttaacactaccttggatttagagtactcttcctttgaaggtgtaattaattaatacttcctttgcagatgtaattcattaatgcttcactttggttttgttttagtacttcacttatccaaggtaggttaagcaaagaagtattattcattacactgaagtattattcattacactgaagtgaacagttcaggcctcttctgtcacatcagtttaaataagtacaacaaagatttatgacttcagctgggcgaagtggctcatgcccgtaatcccagcactttgaggct

SEQ ID NO: 10779 - DNA, 268 bp, Homo sapiens
  misc_feature 259: n=a, g, c or t
ttcctttgtccacaaggcagtgaagtcaactctgaccagccttgcactattttcttgtctgttctggcaaaacaaggactatacatccacatttcaatgtgaaggtcctataaagaaggaaattgtcagaagagttctgcagggtttccagctccaggagccgatgtaagtagggagaagaacagtgccaaggaaaactgctgttgccaaagaggagggaggaagaagaggaaggaggaaagaggcaaacatacaaaanctcagacaa

SEQ ID NO: 10780 - DNA, 479 bp, Homo sapiens
agtggttaggagtggtgtttcatcagactgcactgttgcaaacaatagacctagaataggaaatttaagccaattgttaatcactgtgttaattgtcttgaggtatctatgaccaggaatctaactaggaaagaagataaaaccaaaatcttcatcacctctctactatatttaaaacacatcatcttgtaatcagctaatcactaacttaactcttaaatgtaaagcctgttttagcctttattggttcaaagttgctctaaacccagtaaaaaagtgtgtttttaaaatttaactgaatcattaaggagttaaacataaacattgttttctaaaaacatttccattcagtgtttctacctttctttatatatgccaattaagccatctacaatacagcaaaggtacaaaaacagaacctacaaggatagaacttactcctaaaaggacagaattgacagtgggagaaagcattgtcc

SEQ ID NO: 10781 - DNA, 462 bp, Homo sapiens
  misc_feature 278,345,354,412: n=a, g, c or t
aacatgattggttcagattaatggttgggcgtggactggaaactgagcgtcaagctccgtgtcctctgccctaaaagaccaggattctatgggccttgctgggctcttgccttcaaaaacccaggcctcctaattctccccagaaacagctgcattggagaccccaagtctcgggagcacacccctgcttcctgccctgtgactggtccctgaagctttcctctcaacctcagcgggtccccacctctccgtcaagttcagtcttgggaaaatgccangcatgatggctcgcacctgtggtttcagctattccggagccaaggcaggatgataacttgagcccangaggtcaangggtcaaggctgtagtgagccatgatcctgccactgcactccaacctgggggatagantgaaaccctgtctctgaaaaaataaataaataaatacataaaaaacaaaa

SEQ ID NO: 10782 - DNA, 431 bp, Homo sapiens
atctcaaaaaaaaacccaaaaaacctgtggcttctgscttgtcgtctgtssctgggattactccctctgggaaaagcaggtgtsatgtcaaggggacacccaaacagctctgtggagagttcagtgccatgagggactaagatctcctcccacagccgtgcagccgtgtcgggaacttgagggtgaatccccaagcacagtgaaatcttcggatgacagcagccccagcagcatcttgattgssgsctcgtgagtgatcctaaaacagaaactttcagctaatttgsstcctcatttctgacccacacaaactgagattcaaaaacgtgttgsttgtgttaagccctcaagttctggggtaatttgttacacaacaatagcaggaagaaaaggagaagtatcactctttttgctgcacaaatgtgaaaact

SEQ ID NO: 10783 - DNA, 232 bp, Homo sapiens
attagcttgtttctcagctagcttatgtagaaatttgccacagttgttactgctgggcacctgccctggatctgatcatcaattatatcatctcttccatctgatggactgcacctcaccccttgctttttcagagctggcgamstgggccaaggaaagcgatagtgccagctgagtggaatgtgcaggaagggaccgaggaggggcactatgtactggagaaaagagatgg

SEQ ID NO: 10784 - DNA, 63 bp, Homo sapiens
ctctttcttttcgccatcttttgtctttccgtggagctgtcgccatgaaggtcgagctgtgca

SEQ ID NO: 10785 - DNA, 154 bp, Homo sapiens
attttctgtatgcctattgcctggcactaagctggcagcacagcagtacgagtaactgttggatgaaatggtggcctttgcctgataccaggatgcctgggtgacttaaacacgaggatacaatttggagtgatttcccctgccccgaagaaag

SEQ ID NO: 10786 - DNA, 434 bp, Homo sapiens
aaaaaaacagattggttgttttagagcagttttaggtttataaaaataccgggcagatagtgcagagagttcccatgtacccctcccacgcccaggttctcasatwatttatattttgcattcgtgtggtgtgttggttgcacctgactcaactctacgttggtactgttactaacagccatagtttccattagggttcttggtgttgcacattctttgagtttggacaaaagtataatgaatgtgtctgccgttggagtgtcacagagtggtgtcactgccctaaaattcctccatgctccccctgttcatccctccatgacctttggcagccasagctcttctcactgcctccacagttctgtcttttccaggctgtctgtagttggagtcccagtgttgcaggcttttcagactggcttcttccacttcac

SEQ ID NO: 10787 - DNA, 152 bp, Homo sapiens
acttagccttgtccctacctctttactcctctgtaggcagtaattcttttttcttttctttctttttttttcttttggtgtamagtatcgcatgagccaagactgtcatgaaactatttggatactgtactctggttccttcatctcctcca

SEQ ID NO: 10788 - DNA, 343 bp, Homo sapiens
atttcttttcttctgctaactttgagtttagttattttttttcttgttatagttttcgttatatttttcaatgccttgaggtatggcattaggttgttaatttgtgatcttcctacttttttatgtagacatgtaatgctgtaaacattagtaatgccctcttagcactgcttttgctgcatcccacaggctttggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacagaaaaaaaaaa

SEQ ID NO: 10789 - DNA, 247 bp, Homo sapiens
abatgataaatctcttcacgaatgtagggtcccactcgaacctcagacactgctcagggagactgcagggtgacacagaccacatgcgtcatggcagagcctcatcttgaattgtgactgggttcaagtgctcactattcacttgtcaaccaatgcttgttgaactcttggccggcgtggggtagggcacacccctgccttctgcctctcggsaagccattcattcattttcaagtacttgtggasa

SEQ ID NO: 10790 - DNA, 441 bp, Homo sapiens
ttcgcattttactttaagatatatgattattgtcattgtgctatctttatcatactatataaatatgcacacacatatatatgcttacatatgtatactttttatgtattatgttattttatatataatacatttgttttgtatatataagtacatatacatatgtagatatatgtatatgcataatttgtgtacctataaaaacatacaataaggaactctttaaccttgccttaaatctcatctctatgtcttattaatttttctcaaattgctttcacgtatctgtaggtaccaagataaaaacattcaattccaaatatggtttcsccggttatgtattaccaacaacatcctgactatctattacaagaccttatatgtgcaatttaaaattcacttttctagaagtaagtgtccatttatttcactttgacttat

SEQ ID NO: 10791 - DNA, 223 bp, Homo sapiens
agacaacatctctatggcaacacctccacggaaaaatgatggcggccacagcaagacgagcgatgactattttttttaaatatacacaaatacagcactactaacccctgcaacaagccagatgaggaacataaggaagaattataattgtcattatttgtagacaataaaactgcctacctgtaaaaaaaaaaaaaaaaaaaaaaaaaaaaaaaaaaaaaaa

SEQ ID NO: 10792 - DNA, 441 bp, Homo sapiens
taatgaatacaaatgtgattttgaacatagccagtgtcaatgtgagaatccacttctcccaggacaatccacaaagccattcagtggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataa

SEQ ID NO: 10793 - DNA, 304 bp, Homo sapiens
aagttaatggctcactcaagactctcaacaagttggtgctaacaaagttgattttaaatttaggttcggctaaaccctgagtcccagacttcaaatacaagaatacagcaccagctgaaaaatatcttaactattcttctttaaaactaaaagcagatttcctctasstccccttgcactctcacaccagctcccatgaagacgatcctcatcaccatcttgmttgctaaacttcaatytgaaaaatagttactaattgaccaaaatactatgttgagtactgagaacacagagayaaaagggc

SEQ ID NO: 10794 - DNA, 172 bp, Homo sapiens
  misc_feature 57: n=a, g, c or t
agagcccgcgtgtcctgggccttccaagccttctgtccaccaggctgtgcatcccanttccttgaactgtgtctgagagcctcctctcgccaccctgaacgggatcccattggttaacatctyhwwtadgtcagaggggtgagcccagaaggccccatttcgggagcagcct

SEQ ID NO: 10795 - DNA, 254 bp, Homo sapiens
aaaatgcagttaggaacagcatccttaacaacaactttctttacaacgatattaacacaagagtcttgcaatacccttaacaacaagtttcctttgcaacagggccataacatcaacactcttggtaattgcattggtaccaaaacttatctgtgacaatatcttgaacattaatgcctttaagagaaatgcccttaaaaatatctttagcaagcatttccttagcaaacacgctcctagcaacagagagtaag

SEQ ID NO: 10796 - DNA, 374 bp, Homo sapiens
aaagatttaatacaagakgcaagaccaggtcagggatgctttggaattcattcattcattttcaagcattttacatgtgtatgaaaatgcgaattttaaagaattatctacacatgaagttgaaaagagacacctattgaaagaacccaaagaggaaaatcatgttagagggacagtttatgagaattttttagtagtagaatgattttggtgattagaatcggagtacacttgggaaactgttacagtgtttccaattcagtactcagcaccttatgtttcatatcgaaaagtcccatttcagtgttttctcaaacaaaagagacacatgtcttggataggattcatcacagattaaaagaaacctacgcaga

SEQ ID NO: 10797 - DNA, 80 bp, Homo sapiens
tgcaacgagaagatggccatctgtaaaccataaagtgagccctcaccagacaccggatctgtcagcaccttgatcttgga

SEQ ID NO: 10798 - DNA, 417 bp, Homo sapiens
aaacacttcccctcctgcaggtagcagggcgccaagcagtgacttctgaccaacagagtgtggggagaagggatgtgtattagccccggagacgtgatgtgagacccgcttgtgagtcctccacactcgttccccattggcaagatacatggagagcaccctgaggacctttaaaaggcaaagccgcaagsagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaaaaaaaaaaaaaaaaaggg

SEQ ID NO: 10799 - DNA, 268 bp, Homo sapiens
  misc_feature 248,253: n=a, g, c or t
gcgartcaaactgttgctgtttgctgatgatgtaatcatatacctagaaaaccctaaagactcctccaaarvgctgctagaactgataaatgaatttagcaaagtttcaggatacaaaattcatgtaaacaaatcagtagctctgctataaaccaacagcaaccaagctgagaatcaaatcaataactcaaccccttttataatagctgcagaaaatatatatactcagaaatatacctaatcaaggnggtgnaagccctctgcaagg

SEQ ID NO: 10800 - DNA, 447 bp, Homo sapiens
  misc_feature 280: n=a, g, c or t
atatcctttggcaccgggtggcattggccatagsagggtgaggatcaggagggagctcaggagggggaattgcactgaagatttgtcccatcgtgaagcaagagcactggaacttacactccaccatcaggccctgtcacaggagaacaaagaaggaaggcagaggagatcatgctccggccagcagggaatctccatttttttcagcctcataccttggaaagtacaaaggagtgagagctgggactaccagccagagggttcatggaggtagtgggangggaagatgggttctgcatggagccactccagggacttttcttctgtctcacagcctgacaatcacctctagctgttctcagtcccattctcatcgatgacctcgtctcctgattttgtacaatatctaggtgaccttctcttctttccatcttcaaacgcttgatc

SEQ ID NO: 10801 - DNA, 142 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaaaaaaaaaaaaaaaaaaaaaaa

SEQ ID NO: 10802 - DNA, 245 bp, Homo sapiens
  misc_feature 29: n=a, g, c or t
catttcgaaagcacccagtgggatcttknggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattc

SEQ ID NO: 10803 - DNA, 168 bp, Homo sapiens
  misc_feature 36,38: n=a, g, c or t
gtaggaaggcaacattgacaaggccaaacaacgaangnttgactcacttgattccttgcactctcgaaggaaacaaccaccttagaaaaaaccatgcactttcggcgggggcttaatcacattagcagcccaatggactaagatacttggattcagagttctctccca

SEQ ID NO: 10804 - DNA, 361 bp, Homo sapiens
  misc_feature 255: n=a, g, c or t
aatttgttaacgaccatccgcctgattcggtccgcggtgttagctcctcctagggggcgggacctcacttgtctactcaatgccgttaattaagtaactgcttggaaaactgatttcattactggagacctggtcttgtaggaggagtaaatatggtcggagggtcacaggaggaaggagtggaggtactgaagagcaaacaaggaaataattttttaaaatactgtgtgaaagaggtactctggaaggcagcanggatattgcaacctaattttactcatctctagaatgaatgagtatgaagaataatggggggaarttctcgtgcaagttggaaatttttaaagggtttccccaatta

SEQ ID NO: 10805 - DNA, 170 bp, Homo sapiens
acagtggcttctcagcctcccctggcccaactgaggctgttgctagatatgtttttcctgtatcaggtggttcatttctttttttctttttttttttgcctcttgatcttttttttcttttgtccctaaagaaaaaaaattaaaataaataaataaaagttttaaaaaaa

SEQ ID NO: 10806 - DNA, 376 bp, Homo sapiens
ataaccatttagagtttctgttttgggatttcaatttgagaagaatgtggagaatgctgaatcaagaaaagagcagtaaaaatgacaagaaaacaagctcaaattagatatttggtcaaaagaagcaatttctaattgcctagggtcattacagcttcagcctcatctctcatatcttctacttcactctcaagactatagagcagtcattggtgttcagtgtcctgaggtacttcaagatcatcaaagaatttttggaaattcctcctttcaacaagcagtatacagaatcccagcttcgagcaggagctggctatatccttgaagatttcaatgaagcccagtgtaacacagcttaccagtgtcttctaattgc

SEQ ID NO: 10807 - DNA, 343 bp, Homo sapiens
cactttgggaaggaatgttgaacaatcaatcgatttacagtctcttgcctccggcagacgacagggtggctcattaactcaagataaccagagtaactaagtatgccgccctgcacgccctaccccgacgtcagttcccgcgctttgcctcttaagaaagctttgcctcttaagaaagactcgggctctggagctccagcagagccggggcctcggctccaacccgtcgggccccgacttgaagcagcggggaactctcctcacacctcggtgaccgggtggccgccgggacacagaggctttgggtggcggcgtgtttgcgggtcgggaagaaccgcgcaga

SEQ ID NO: 10808 - DNA, 357 bp, Homo sapiens
acgaataatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgactt

SEQ ID NO: 10809 - DNA, 264 bp, Homo sapiens
ttagaaatgataacaggcagcagttcaattcaggtagagaccaagaaaggtttggaagaagatcttttggaaatagggtggaaaatcgaccgggaacggtcatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtag

SEQ ID NO: 10810 - DNA, 58 bp, Homo sapiens
cttcaaatgactacataaagcagaggtttccctgctgccccccacagctccctgctgc

SEQ ID NO: 10811 - DNA, 188 bp, Homo sapiens
aaaaaagaaaaggagctcttaaagggaaacgactttggactcacgtaggcataggagaacgaaacttctktacattttaatctgaataattcttcaggatttaaaattaattggctctggcttggttggaccgtactcggatctcgccacctctgcgtttcccgagtcactggcgaagaggtgatttt

SEQ ID NO: 10812 - DNA, 447 bp, Homo sapiens
actgttctcccattgtgtcttgctaatagattctgatttttaaatgttgttttacaagakccagtgcccccatttatgtacttttcttccttgttaaaaaacaaaaccccaaagatttgaaggttcttagttttgctgctaatataattctaaactttgttttctcctctcagagaatttctctgctcctcctgatgtcactacaactacctcttcctcctcatcatcttcctcaattcgcccagcaaacattgacctgcccccctcgggaatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaatttttttgtggatgactctgaagaaattgtgg

SEQ ID NO: 10813 - DNA, 52 bp, Homo sapiens
atatacattcctcagcatctggccctggactgcctgcsacctccacacatgc

SEQ ID NO: 10814 - DNA, 237 bp, Homo sapiens
atgatgcaatatgtgcaaagtgcttaacgtaktcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagac

SEQ ID NO: 10815 - DNA, 232 bp, Homo sapiens
gagaatgttatgacttccctattatcagtttgctaatatttttatttgatggcattttgtactgcagtcttaattgggtacaaatgtattttagtaaaaaggatgaggcatcgtttttattagtggaatcagcttactttgagaaatttgtatccagacatcatttttagatatctttcacaaaggactgtagaatattgtttctgaagacaaagctttttttttttttttg

SEQ ID NO: 10816 - DNA, 263 bp, Homo sapiens
attgaaaggatctagatggtttggtgatgtaggccattgatggaataatgtagttgctgcaaatgccattatttcattcctttttatggctgagtagtattccatgagggaaggaattaggagcgggaaggagattgactgttagtttcttaggattggactaacaaaagtggaggttgttacttacactgcaaaagaaacaaccagagctgtgtcactcagaaggctgaaaagaatcaggctgacaggatttttaaactcca

SEQ ID NO: 10817 - DNA, 401 bp, Homo sapiens
aaacacttcccctcctgcaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaagsaggaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaa

SEQ ID NO: 10818 - DNA, 463 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagatttcatatccagccaaactaagcttcataagcgaaggagaaataaaagcctctac

SEQ ID NO: 10819 - DNA, 436 bp, Homo sapiens
aacggtttgataagaggaaacccgtttcacttggttctcattctctctcttgcctactgtgttgtaagatgtgcctttcgccttctgccgtgattgtgaggcctctccagccacgtggaagtgtaagtccaattaaaatctttcctgtataatttatccagtcttgggtatgtctttatcagcagcgtaagaatggactaatacaccgagggacatacaaatgagaaaaaaagtcactggggactcctagagtggggaggaagagaggggttcttggactgaaaagctatctattgggtagtatgctcactacctgggtgatgggatcatttgtactccaaacgtcagcagtataatatgcccatgtaacaaacttgcacatatactctctgaatccaaaataagtgttgaaaaatataatgataaaaataaaaat

SEQ ID NO: 10820 - DNA, 222 bp, Homo sapiens
ccctccctccctccgacgctatcaaatgatgccgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatgg

SEQ ID NO: 10821 - DNA, 355 bp, Homo sapiens
  misc_feature 70,180,188,211,290,314,323: n=a, g, c or t
aaagagactctagaatcctgaagcactaagggatcctgaagcatctgtgtcctcccaccccaagagcatnaactcccagaggcagggatcccggccctgtgcaggactctgtkgctcctggtagaagasaaccacccttacagatggaagakgctggaatacgggttctygctgcaagtntgtttgancttggmgccaggcagtgtttgcntgtccccctgggacctggaccaccatgaggagagcttgcagtcctcacaagtgcagcctctaaggtcaagggtcagganggtcatgggacaccgcctgcaagnacacacatngctcctgtagccaagtdgccctgtgtggccta

SEQ ID NO: 10822 - DNA, 88 bp, Homo sapiens
agtctatgtgtgtgcctgtgtggtgtgggtatgcctatgccctttgtgtraacctgtgtgatgtagatgtgcctgtaccccagctgtt

SEQ ID NO: 10823 - DNA, 398 bp, Homo sapiens
tagcccaagattgcgatgccagcaaggttttggcagaaatgtgaatataagcaagcatactatgagatacatgatccagtcactgtaaccttctttggaactagtattgatccagcagcagctttcagtactgatcctaaaaacaaataatatgatcggatcagatcatcacaaagggagcaggaatttgaaggatgtatctgggttattcaaaccgaaaacacctaactccagttcatkaaaaatcatttcatatttgtataaaaataatttttaaaagagtctagatgtagttataattttaaaagtagtcatatttctagaaccttctttaaattcttgttatttgaatatgaaattattgtaaatccattgaataaataactatattcataaaa

SEQ ID NO: 10824 - DNA, 504 bp, Homo sapiens
aattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaagggtctttatcattttaaagaaacattcctcagtgta

SEQ ID NO: 10825 - DNA, 364 bp, Homo sapiens
caagagggaggtgttataagagcaatgcagaggttggagtkggcagcagttggggcaggaggaagccgactgctgcctggtctgcaaagaagtcctttcaagtctctaggactggactcttcctaagcaagtccggcgtgagattcaacattttggggtgaaaatcagcatagttgaacctggctacttcagaacgggaatgacaaacatgacacagtccttagagcgaatgaagcaaagttggaaagaagcccccaagcatattaagggagacctatggacagcagtattttgatgcccgtgataggagctttgtgggagtgggatttgtcaatttcctataagaatattattytgaagacct

SEQ ID NO: 10826 - DNA, 58 bp, Homo sapiens; identical to SEQ ID NO: 10713

SEQ ID NO: 10827 - DNA, 440 bp, Homo sapiens
gattgaggctcatttggtaacttcctttactgagccagtcttgatcagaagtccacattagtatgtgacagctagaggtactgttattaatgtatcagcaacagttacattaactatttcaaaggactactgcccttaaaatgaaaaracctttcagctatgtttgtacccgtgactgacatctggactggatttatgcttgatgcattgttgggaaaatatgcaatacaaactggtatcagaattccttatactgatgaggcactttatattttttattagaaagtagaactaattttagatttttcaaattggtgaattttatatttccctgaagaggtttcttcactattaatcttaaaattggataccattgtgcagcggtgtactgtacttcagagaaakcataaaagtacatctagctcagtccctatgaggta

SEQ ID NO: 10828 - DNA, 331 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtga

SEQ ID NO: 10829 - DNA, 80 bp, Homo sapiens
gtcgttccagggtgatcatctgctcggaggccgctctcatcctaagctcccacgtctggtgtggctgggggggcgtcaca

SEQ ID NO: 10830 - DNA, 267 bp, Homo sapiens
aaaatggtgcctctaggaaaggaggcttgtattttgcacattttataaaaacttgagagaatgagattagtgcttgtatatttctaaaaagaggaaggagcccaaaccatcctctccttaccactcccattcctgtgagccctaccttacccctctgcccctagcctaggagtgtgaatttatagatctaactttcagaggcaaaacaaaagcttcgagctgttgcatgtgcgagtctgttgtgtggatgtgtgtgtgtggtcccca

SEQ ID NO: 10831 - DNA, 429 bp, Homo sapiens
  misc_feature 224: n=a, g, c or t
agaatgagaaaaccgtggggtgtgtgtgtgtgtgtgtgtgtgtatgcatctgtgtgtgtatgtgaatgtgtatttgggcttcatctgcaatagcaacttaagctcagaataagtgaatgggttgtcaaggtggacattagcagtgagagaccaagagtctggacaacagggattcagtgattggkctagaagacccagtcatgaaggtcatagtgtgwwwwcynytcatttggaaatctgggagcagttcttaagtcaaaaaacagacctggaatcacagtatccatacataccagttggaggacaaaagacattgccccagagaccagaggcaccaaaatacactacacctagctacctgagaatgcctctagctggcaactccagcaaaggcccttttccccatccttgaacatcttgagtgaaagc

SEQ ID NO: 10832 - DNA, 69 bp, Homo sapiens
aattagagcaatttttctcagctgctccactacagaaaacgaaagtaattatacaaaaatagtgtaaaa

SEQ ID NO: 10833 - DNA, 189 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaa

SEQ ID NO: 10834 - DNA, 440 bp, Homo sapiens
  misc_feature 340..341: n=a, g, c or t
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtagacggattacaccttcccacttgctgaaaaggtcaaggccttcttggctgatccatctgcctttgtggctgctgcccctgtggctgctgccaccacagctgctcctgctgctgctgcasccccagctaaggttgaagccaaggatagtcggaggagtcggacgaggatatgggnnttggtctctttgactaatcaccaaaaagcaaccaacttagccagttttatttgcaaaacaaggaaataaaggcttacttctttaaaaaaaaaaaaaaaa

SEQ ID NO: 10835 - DNA, 418 bp, Homo sapiens
agtattcctgcttcatttcttaccatacacaaagtggctggaataatgcatgacaagggaacaagatgcagtggaagaacaccagcgatcccaggagacgctcaacagaataaacacacttgagacatcaaagaaatatcatattaagagaactgttcagaaaatggtgaagactggcagtccaaaatcaaggttggtgtatggtgaagcctcttctcctggctttcagatctccagcttctgtgcccttgcatggctttctttggtgtgaatgccacgaaaagagcaagtctggtatctctttctcttcttataaaaacaccagtcttatcagatttgggctccctaattactggaacttataaatgttaccttctaaggaaaaagagtctttgcagatataattaaattaaagatc

SEQ ID NO: 10836 - DNA, 348 bp, Homo sapiens
atggataaaagtggatcaaacagcattgcatgctacagagaaatctttttgaaagagtcaatcgaggtggcaaacttcactgttttcttttaaagaaattgccaggcctggcgcggtggctcgcgctgtgatcctagcactttggggggccgaggtgggcagatcacctgaggtcaggagttgaagaccagcctggccaacatggtgaagcctgtctctgctagtaatgcaaaaaagttggctgggcgtggtggtgcacacctgtggtcccagctactcgggagcctgaggcggagaattgcttgagcctgggaggcggaggttgcagtkagccaggattgtgccatt

SEQ ID NO: 10837 - DNA, 51 bp, Homo sapiens
actgtatctagctaatctggtggggacgttggagaacctttgtgtctagct

SEQ ID NO: 10838 - DNA, 130 bp, Homo sapiens
  misc_feature 54,93: n=a, g, c or t
assagaccgcggacgtctgtaatctcagaggcttgtttgctgagggtgcstgcncmkgcgacggctgctggttttgaaacatgaatctttcgntcgtcctggctgccttttgcttgggaatagcctccgc

SEQ ID NO: 10839 - DNA, 348 bp, Homo sapiens
ctcttcatagttcattctagatattttcttccgatttttcttccagttttctcttcagctatgtccattctgtccatctcatatacactgagtttttgagttatttcatttttaaatcccattactttggcttttgataccacagttatctcgatattgatatattgcatgaagctttgttaaagtgagttctgcctgtaactggatcctgtggcatgaaccttaagggcagtattaaaacaagtgccagcaacttgagaccaagacctggatttgtggctaactttgtaaccttggaagaatacctctggtgctgtaasctcggtatcctcatctgtgacattaaag

SEQ ID NO: 10840 - DNA, 233 bp, Homo sapiens
gtagatgtctattatgtccaattggtcaaatgtcgaatttaactccaggatttctttgttagttttctgccttgatgatctaactctgtcaatgggatgttgaagtcacccactcccatggtgtggctaagtatttttatctttctcctaccctttaccttgagtctatcagtgtcatcacgtgtaagatggggtctcttgaagacagcagatggcttctcatctgtctcacc

SEQ ID NO: 10841 - DNA, 446 bp, Homo sapiens
gtagatgtctattatgtccaattggtcaaatgtcgaatttaactccaggatttctttgttagttttctgccttgatgatctaactctgtcaatgggatgttgaagtcacccactcccatggtgtggctaagtatttttatctttctcctaccctttaccttgagtctatcagtgtcatcacgtgtaagatgggtctcttgaagacagcagatggcttctcatctgtctcaccaccgggagccacagaaagtggacatgctcacagtacaggaaatagagctttgcactgttcttttaatgatgtggattttttggtgaactcactctattttgtcttggtttcttcagctcataggtttgtgaggcagtttatagcaaaaggctataaaagtcttttttttctaaataaagataatagatcaaccaaaaaaaaaaaaaaatgcgaa

SEQ ID NO: 10842 - DNA, 101 bp, Homo sapiens
actgaacttgggagctgaagaatactggacggggcttcggagaggaaggatggtccaggcgcaccccaggggttgcgatgggctcttcttggtgtctgtat

SEQ ID NO: 10843 - DNA, 282 bp, Homo sapiens
  misc_feature 83: n=a, g, c or t
aatatttttgttgaatttcacattttctaccaagtaacgaattaacctttttgaaatcgcagaggagatcacagcakgwaatnaagccatatcctgtacacgctggctaccacatatgaaccatcagagagatggagggcaatgtctggaagaaggacgggaagagggaatataagaacattcagtattaatggattccaaactccgtgtgataaccagccggtcctggaccagtttatcatcgcagtgtggactgattctcttttgcaggaasttagtttt

SEQ ID NO: 10844 - DNA, 199 bp, Homo sapiens
aatagctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtgtaggagcaagtacagcgagcaaagggcgctata

SEQ ID NO: 10845 - DNA, 471 bp, Homo sapiens
agtcgggagggtaaaacacaatcatggtgccataaaagagtgaaggagccggcattacacacagacagcccgcagaagggcagcaacgttttggagctccttttagttctctttattgatatattttaattgaaaccagattttttttttcctgtctagcccttggagacaagctctgccagagctcgtatagcagagagaaggtcttgagattagtgatactcagcgtttctgacactggagacctgcataagaatttaacaaactgggaagcagttttcatgacaacccttttcattgcatagatgttaccaagagtttgggggtgtttttaagaaaagccattaggctggaagtcagacacacctggatttgagatccgctctgctacttcgtacttgcgtggttttgaggatcatttggcctcttttcaggttttagatccttcacctgtaaaatgaggatggttgt

SEQ ID NO: 10846 - DNA, 134 bp, Homo sapiens
  misc_feature 77,81: n=a, g, c or t
atttttttccaaagccatggtgaamatctctgtgctaatttcttttgttttgtttcctaatttttttttttttkggnaggnggtaggaaataatctttgtcttctttggagtaaacyttsaacacsggattttt

SEQ ID NO: 10847 - DNA, 166 bp, Homo sapiens
  misc_feature 15,41,154: n=a, g, c or t
attctcctgcytcancstcccgagtggctgggactacaggnkcccgssactacgcccggctagttttttgtgtttttggtagagacggggtttcaccgttttggccgggatggtctcgatctcctgacctcgtgatccgcccgcctcgggtcangagttcaagacc

SEQ ID NO: 10848 - DNA, 326 bp, Homo sapiens
aaaaatatcactggattggccattggaagacctgcatgataagttcagtacaaattttcccttatctattctcttaagcaaaaaggatgtaaaataaacaggcaaatgcttctgtttattagccttctgcagtaaatccatctattgctgtcaagtcttcagcaaaacctacgtaggtagtaaaagtttgtattagtagtaccaccttcgtggcaaatgattatagaaagacctcagcaacatggagaaaccatgggtcagtatgacaaactcagtttagcctagagcagctgtgcagtaatcccaggagcatgtaacatcgcaga

SEQ ID NO: 10849 - DNA, 246 bp, Homo sapiens
gagaaataccaaggtgtacctagatgtagttacagccatcaaggagcttaaaattcagtggaaargtggtgtcgccaaagttagttacctatgaacttatgagaaagggtaatcgtgagctggccgcggcaccggctgcctatcctggccgtgaatgtttgctttctctgccctggtctcaggacgtccgtttcgaatagatcaagcacttctctgtcggcagctttcacaagagatctcgtttta

SEQ ID NO: 10850 - DNA, 390 bp, Homo sapiens
ttttatgggatagattcccaagggagggatttctcagctgaagtgtatatgaactttttaaaaaaaattkatggccataaaaaatctttgaatagcaaaatgtactgtgaacagataaagacaatgacaggcaagggaaaatatttgcaactcatatcatagctacagggatatttctatactacttgtgtttctaaaaatcagtaagaatataaaagcttaatagaaaatggggaaaggacatatcaggtaagtcaacaaaaacataaatttaaacatcttttgaatatatggaaagattcttggcctttctattacctatgatatggaaamtatcaagaagtttcatagcagtcttttggctwggggagtgggaacactcattcttat

SEQ ID NO: 10851 - DNA, 243 bp, Homo sapiens
gggtttctacatgagaatgtctgctggagttgtaggaagaggtcctgggtaaaggagcaggtgtgttcttagaaggccctcctgtctgctgctggaacacatcacctgtttattcgtcctccatttcccgstttgcagagcactgaaagtctcttaagttacagcttcacaacagaagtcyaaagtctgcgcagaactagcacatctgcagscgtagagcagcagaatgaccaggcagcagag

SEQ ID NO: 10852 - DNA, 483 bp, Homo sapiens
  misc_feature 83,273,308,341,412,455,468,476: n=a, g, c or t
agtcgggagggtaaaacacaatcatggtgccataaaagagtgaaggagccggcattacacacagacagcccgcagaagggywncaacgttttggagctccttttagttctctttattgatatrttttrrttgaaaccagattttttttttcctgtctagcccttggagacaagctctgccagagctcgtatagcagagagaaggtcttgagattagtgatactcagcgtttctgacactggagacctgcataagaatttaacaaactgggaancagttttcrtgacaacccttttcrttgcatagatnttaccaagagtttgggggtgtttttaagaaaanccattaggctggtaattcatacacacctggatttgagatccgctctgctacttcgtacttgcgtggttttnaggaatcatttggcctcttttcaggttttagatccttcacctntaaaatgaggatngttctganaaaggga

SEQ ID NO: 10853 - DNA, 435 bp, Homo sapiens
accagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatc

SEQ ID NO: 10854 - DNA, 93 bp, Homo sapiens
  misc_feature 83: n=a, g, c or t
rrgtaggaatttgggtgagatttatgtgagaggttgtgaaggtgtgaaggggataaatttgatttttgtgtgaaagcaggaanctgaaccttc

SEQ ID NO: 10855 - DNA, 217 bp, Homo sapiens
  misc_feature 149,200,211: n=a, g, c or t
acctgcgtcctagagaagcctccctaccatttctctgtaagataccaatctgtttggttggctgagagagaatgactgaccggatcctctatattgtctctaacatgtcctctgtcccctgggagggcagcgcasagctgcagtgcctnccacttctcctcccacacctgggcactaccatgttctctaccgagggtgtngagaaactcangtaggc

SEQ ID NO: 10856 - DNA, 487 bp, Homo sapiens
  misc_feature 68: n=a, g, c or t
araaatgttctaaagataaaatctaatgatttcttataggaaggctaggcttggtgggcacaagtaanaaagccaagcagagagaagtctggactttgccttctccacctccttggaagacaggctgctcatcccattgtggtgtctcggctggtgtatgttttctgcctaggcttaatggacagcacgaggaggtagggactgacgttacccatgttttacagtggaagaacctgaggsttaaagaggcacttgccatctcgaacctgctggaggccaagactgttttaagtttcccagtgtcctagttcctttcttattgattctatacctatcatcattaatattaatttttataaaacattgctttcatcagcaaatataattcatgtgtttttgagatagtaaatagcatagtttgttaacttctatataatctgcatcttgttctgaatcctccaactatagagactaaacggaattaatg

SEQ ID NO: 10857 - DNA, 349 bp, Homo sapiens
  misc_feature 175,266: n=a, g, c or t
aattgtcactggtagctgacttaccttgttagtgtgaggcagtagacaggccaactgttactgaggtttcaaccagattcttttttagttactttgatttttgtcacaagtgccatttaccattcggatgaaggactccagcatttcctgcaggataaccaaatcattccagttngaggcttggacatattgaaagatcaatctctaaaagatttggaggatcactttgggatacagatgtaataattgaatgctgctgtgctcanggaaaggcttcagattctccatgggtgagttkggccatcagctcgctgctacagtcagcagtaaacatggtggcatatttgaa

SEQ ID NO: 10858 - DNA, 470 bp, Homo sapiens
  misc_feature 253,256: n=a, g, c or t
acactttagcatgaacacaaccttgcctcggaaagcatacgtgggaaaatatgccaggsgggtagctccccaattctsctgcccaaagatgtttgcsatagactacgctgactggsccattcaggagcccctcgggtttscgctggacctacccttctgatttgagatcatccacgtgttttcccacctccggagcttttattttataamttcctcccttcttagtacagtvccaatcactgctctcccccgnmrnscccctccccaaaggctctctgaggctgctccctttgtgattggcatctcattaatgaagaagggctggtgtctctcattacagttagagtgagtgagaggacctcagaactaatttacttgstctcactagggaagasacttgcctccatcaagaacttcactttcctgctgcctgtgsaataaaagaacccgttttgttttaacattaataa

SEQ ID NO: 10859 - DNA, 433 bp, Homo sapiens
  misc_feature 2: n=a, g, c or t
anaatttgatgttctatctcaatcttgccagctgtctttttaatcaaagagatgccattacaatgattattcttgaacatttgtgcccagccctcaagagaaagcaagagacctgctaactaactcaaaatgtttgcaaaatacaaaatattaaaggtgtgaaagggagcctgcggacacagaattgcttctgatcttctttgctaggctgaatcagaggatggccaggcacagtggctcacacccgtaatcccagcacttttggaggccaaggaagatggattgcttgagcccaggagttcaagaccagcttggacaacatggcaaaaccctatctacaaaaaattacctgggcgtggtggtgtgcacctatagtcccagctactggggaggctgaggtgggaggatcacctgagcctgggcagaggaggct

SEQ ID NO: 10860 - DNA, 450 bp, Homo sapiens
aagttctaagcactatgacctcctagcatagtgactttaataataactagagaaattatataaaaagtaatagaaaaactatttaatgttataaaattacctttaatatgacgagagacatatctcctttatgtcattagagggaaagaagtacaaccatacagtaaaaacagaagtgaaagcaaatcagaaaattttatgttcacaaaccaatctatgccagttataataaataaaaaataaataactcttgatagaaggaggttgaaaaaccagctccccggcttagatgagaaggcattacagcagagtagaagcttatgtcaagaatttgaaccagcatccccgcattcacatcctgactctgcactgtgtatcctgatacagtttactgaatgtcactgagtctcagtttttcatctgttaataggggcaatgatactgtttagg

SEQ ID NO: 10861 - DNA, 333 bp, Homo sapiens
aatttactattcaaaaccagcttattgcatgctacaggaccctggtagaaacagaacacctaaccaagggacatcaggggaccagagccgcccatcatgagctgagtcctgacagatcctacatcatcccatgaatatcctccagactgagctgtccaggtttctgctcattacatgtcctgggtctctcttgatgccccttatgtgtctatcaaggtccctcccacttaacatgtcactcagccaaggatgcactcttccagctctaggtggccagagaccagggtaacaggacaattccccccacccaactacatttcatggttcagacga

SEQ ID NO: 10862 - DNA, 350 bp, Homo sapiens
atttttttgttctgaagtctattttatgagatagccattctgctttctttcaaatttaatttttgcagagtgtattttttccatccttttacttttaacctgcctatgtttattttgaagtgagtttcttataaatttctcgttgtgttatttttttttcagttgattctgccaacatctaacttttgttatattttaaccatttacatttaagatggaaccccactgagctggtgggttggaagaaccaatgaaacacacacttactggggaggttctctgcctgatgctcaaaagtgtacttgtggattagaggggaactgcattgattctcagtattactgcaactg

SEQ ID NO: 10863 - DNA, 184 bp, Homo sapiens
  misc_feature 19: n=a, g, c or t
atcccgagcccgcgasrgnaaccgccagagstttcctccgagcggaagaagcgcsttcacctttcagtgcccggcgctgggcccacgcaggaagccgacccgccttggcctctggagttgtstcttgggatgtctttcagtctggaaatgaacctgtgtgctgggaaagggctcgggstccgst

SEQ ID NO: 10864 - DNA, 450 bp, Homo sapiens
aaaactatgctgcacaagaggatgtgaacagaaacatctggacggagaagatcttttttatattcagccatgccaattkacctactaccctctccatagccaaaggaatgcccaaatttccacagaaaggcatttttatatgaagaagctcatccctgttggacctttctcttgaatgcctactatgagtcactcagcaagagaggcacccagctccctcaaggtctgcagtgcctcggaggcccacttccctccatgaaacagtctctgaacatattattcctcacggatgatcaccttcttaactccatccagatgtgtgcctctgtctcactatttagcgtcgtcctagaaaatacagtaattgttttcatgcgtatacatcatgtttcctcaagtagaatctacctttatacaatcaaaagtgtcagattgatggatgagtagcag

SEQ ID NO: 10865 - DNA, 438 bp, Homo sapiens
attgcaaaagttctagtccaaagtaaggacaatttttcccaagtgattgagtggagcagcaaatgcctgtgaaaatagtagatataaaaatatcagcaagagccaaaattacaagactgtttctgaaaatattccgaaagaatgtttagaaaacatctttttccaggtagacagagagtttgtgaggctgcatcattggcatcattttatcatcaccatcccgctcaggagctcaagaagaggggaactgagtcagttagaattacagagggtgataataatttcagttggagcctcactggtaaccttgctcagccacacgactggaatgtaagaggctggggcattttggacagcacagatgttaaacgtgaacactaccttctcagtagcacaaatctgactacatctttaagtctccaagaggaacatgaggac

SEQ ID NO: 10866 - DNA, 256 bp, Homo sapiens
  misc_feature 49: n=a, g, c or t
ctggttgacagactgagatcctgtctcaaaaaaacaaaaaacaaaagangccctcatacagctagtaagtagtggatccagattcaaagcagacagtctactttcaaagtctgtgctcatcatcactacgttatgctgcctctcatagtatatacatctgatcacactttaagaacatcacaataggtagaagttcttaaatccatcagtatggttaaatagtctactgcttggtcaacattttccttccatggca

SEQ ID NO: 10867 - DNA, 336 bp, Homo sapiens
tatagatgaactgagcgccaatggacaatatcaatgtcttgctgaactgtccaccagccccatcacagtctgtcatggctccggtatctcctgtggaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaat

SEQ ID NO: 10868 - DNA, 372 bp, Homo sapiens
  misc_feature 152: n=a, g, c or t
atagtgacgattaggaccgtgcttctcaacacttgatgtgcataggaagcacctagkgaccttgtcagaatgcaaattgtgattgggtaggtctgggatgaagcctgggcactgcatttttaacagtgatgtcttgctgtgaacagaatagnttctaatctccccaaatttggcaccatcctggagagaggctctgcagaaatgaaagttacatgtaacatcatagtaaagcttaatccctgttattttagataaagcttaatctccattattcttcaatgatgaacagaatttcatttcattggataactcaggacattgtggacagtgatatccatggaaagcaagatactcaacaatgcctcaaatgcc

SEQ ID NO: 10869 - DNA, 358 bp, Homo sapiens
actaaggacagcataaaatggaagtcactttggtttctatgctatttttsattgcacattaatattttgaagcaatttatgaagatcttaaaggaaaaaaatgaatcctgaagaaatactttccttttgtgcaagtagtggcaaaatagtgactttaaggaccacgagttttcccccaaagtgaaattatctggtaaaagtgcagctggagaatttacgtgtacatatcattcatttaattccagaagcctttttttccccagtgaagatgatctctaattccctcacgtgtctacatctcagaggaggcagtgtgagcccaacggtttgatgctgcaaaggctgactgacaatgaag

SEQ ID NO: 10870 - DNA, 389 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaaga

SEQ ID NO: 10871 - DNA, 53 bp, Homo sapiens
cacctgcccacggacctgcctcgccctcaagcgcctcaaagcttcctaagcgc

SEQ ID NO: 10872 - DNA, 296 bp, Homo sapiens
gtttacatcgtacaacaactggtagtgatctaagcgatgacggctgcagagtgacagtgtgaggtrttgagaggaaaggscctctgaagaggtggccattttgagcagaagttaatgacgtgaagatccgggagaggaacagatgaggtgaagggtggcatgcasaaaggtactgagtcaggaacaagcttggggtattcacagagatgcgagaagacccgtgtggctggagaaacaaatacaaggagaagcaactctccacattgtgagcctctccatgaagaggcccgtgtgct

SEQ ID NO: 10873 - DNA, 378 bp, Homo sapiens
agtagttcagttctgtggggctccagggggcaaaaggcatgataaatgagtagaagtcatggagaggtggagcttgcctccagacagaatgctaagaaggatgctgctgcacagtggggactgagccaactcactgttcaacaaataagcattggagggtctctagttccatagaaagaaggcaaatgaagaggacagaagaaggagagagaccttcccaccccatcagccctatgctgcagagagatttaatcactcgaaagcccaaggtgtgaagagggaattgtgtgtgaacgctctaggcaagctttggtcagacacccgagcttgccctgcagttaagtgaagacatatgatgtgctctggccaatgaaataa

SEQ ID NO: 10874 - DNA, 294 bp, Homo sapiens
  misc_feature 140: n=a, g, c or t
cttctactgaaccactttcttccatgtgcacacgctgatttctcaacctggaatcatttccctacacctttcctcaaaggactgttaatgagttttcagaggtacttcactgaaatgtaactaccacaatgcatcctttncatgtgactaacttcgctcatggaccagaatcactgtggctctgcctggagtggtgcaaagagctcgcattctgtttggaaagcaaattatttaaatccagtagaggactctcaaatgtggttggaaaatctaagaagacttcccagaggcagc

SEQ ID NO: 10875 - DNA, 333 bp, Homo sapiens
aatattgtccttccatactccagaagtaaccattaccttgcacttaagtttgtcatttcctttctttttgaaaaacagttccaccatgttatatgtgcatttctaagtaatacattttttacttgtttttgaattttatgaaaaggatgtcactgaagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaac

SEQ ID NO: 10876 - DNA, 484 bp, Homo sapiens
aacatgtactttccgttggtgctgagactaaggcagtgaagggctgcttctcgagcaagtgatttctggagttagttttacaaagagtattctcatcgatagttgacatgcttaagagggtgacctcctggccatgttttccctatcagtaaggatcagataccccgttcagatgacagagccaaaaaccaaatgtcataacttgaaatgttttaacctggtgactgttcccaccatccacctataatgattcctttcaccagtcaagtcattttccaagataagtgttgttgaacatgaaattcaaggacataaagactcttcgcgggatggctactttctatagtcattttctttctatcgtttgaacctcttcagaaatacaatctctctaatagctgcctcttcagtttttccccttagccacaactaaatcaatcttgagggggaaaaaaaactgttcaaaataaaaacataccaaaca

SEQ ID NO: 10877 - DNA, 475 bp, Homo sapiens
tgaaacaggaagtaggtcctcaccagacacagaatctgccagtaccctgaccttggattttcgagcctccagaactgtcaatgtcactgttccgaagctagacttgcagttcactgggaagcatgacaccacagcacctccagctgtggacgcatcatggacaagccaggctgagaggagaacttctcattacttgcagcacagcaacattgggttcaatgtatgcccatgaaaaacctcatttaagagaatgccttggaaaggtgccaaggtccccaaactaattaactttcatctctcctggscctctgcaccctctctccatgaggaacattaaacatagaacatcagcttgagaacactctatttaaagcaaaagtccttctaaagatagccttgaacgtccatctaaatcatcctagtccattttctggcccagaatccacaaggccagcgcccccgatggccctactat

SEQ ID NO: 10878 - DNA, 438 bp, Homo sapiens
  misc_feature 414: n=a, g, c or t
gcgaagtcaaactgttgctgtttgctgatgatgtaatcatatacctagaaaaccctaaagactcctccaaaargctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccanrrcaccaccatcattcttcacaga

SEQ ID NO: 10879 - DNA, 288 bp, Homo sapiens
  misc_feature 54: n=a, g, c or t
attctggcggctgggcacagtggctcaagcctgtaatcccagcactttgggagnybgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctc

SEQ ID NO: 10880 - DNA, 58 bp, Homo sapiens; identical to SEQ ID NO: 10713

SEQ ID NO: 10881 - DNA, 300 bp, Homo sapiens
tatcaagtcaagaccattctatcattggtatttacttttgcatctattctcactgctgtgattcagggtcccttgctgtttccttcvtcattttcccaccttctaggatcctgtttcttaaaaccataatttctagcactaccagaattatttttctaaaatataagttcaatcatatcactcttggagcaaaagcctttagtggttcacccgtagaggtagtcattcattgcatcctgaaaagtatcatctcaaataaagcactaaagtacagcgtcagtgtcctggttggagacatca

SEQ ID NO: 10882 - DNA, 238 bp, Homo sapiens
aagatgaaaaakttctggagatggatggtggtgatggatgtacaacaatktgaatktctttaatgctgctgaactctacacctaaaaattgcccacattacttcactggtgaattatatcaaatattaaaagaagaaataacatcactcccatacaaacttttacagaagatagaggaggaagttaccacttcccaacttatcctatgagagtcaccacagccaccctccattgcaga

SEQ ID NO: 10883 - DNA, 340 bp, Homo sapiens
agtggtcattaccatgggctatraaggcctgggctctccccagctctgccatttattggctggtcaacattgaaaaakaaacatctgtgcttccatctcaccatctgcgaaatggggtaataacccccacccctaccacaccaggaaattctcattccagtcaatatctcaccttctccgcctgtgacaaccactgatcgccttgctgtcacagtcaatccgtgaaaggacctgctcctgaacatgcaatcgagccgtgcaggaggtcatcttctgtgcctggtttggagatttctkcaacatggttgcatscctccatgaggctttcttgctgctgagt

SEQ ID NO: 10884 - DNA, 358 bp, Homo sapiens
  misc_feature 264,295,306: n=a, g, c or t
atttattctaggttttctaatttattggtgcatagttgttcatagtagcctgggcaacaacgtgagactccgtcacaaaacaaacaaacaaacaaaaactcacagagaactaagagcatttaaaaaggtttatgtccaaagataagcattagaacaaaaaggcaaaacttctgaaatacccaccccccaaattatttataaatttaaagtacgggccatgcacagtggctcatgcctgtaattccagcactttgggaggccaangtggacagatcactttgagctcaggagtttnagaccatcctnggcaacatggtgaaacctgtctctacaaaaaatacaaaaattagctgggtgt

SEQ ID NO: 10885 - DNA, 171 bp, Homo sapiens
  misc_feature 88: n=a, g, c or t
catgtttcatttattagatgtttattttttcaacttcgstttttagtagtcatttagttaggttcattctaaartgtgaagtaatganatttaatacagagaagtctctgaaaatgtttggtccattgtatattagtcttgaataaatggaattctttttcacamttacst

SEQ ID NO: 10886 - DNA, 429 bp, Homo sapiens
agttagggtcgcactcatcacggggcccccattgcctctgggcaccccacgactgacatctgcggggccttcgcgctaggcttcgagtttcagcttccgcaccaggcctgcctttctgcaggggccagggtgggggtcgtgtgctgattgggccctctgaaccgccaccgctgcagaggggctgttccttccgtcacatcccttgtgcccgaatccaccctgtgtcttctcttttctcagcaggacattttaaaagcccagaccccctccttacagagcaaatgtccaggcttcggaggtcactgtcacatcccaagaacccccttcaccaggtgccactcttgagactggactgaagccccctggagaggacccctcycstcscatggstttgagccatgagatggacttggacaaagcggcaatggg

SEQ ID NO: 10887 - DNA, 476 bp, Homo sapiens
  misc_feature 430: n=a, g, c or t
aaacagggctctgttttgtattggacagccaggctaccaagaaactgggcaaaagttacaaatctgtcttcgcttcacctttcccatctgcgaaatagggctggtgctgttcacgtctgaacaggtgcctttgtcactgtcactttccctggggctcttccatctttctaggcaccacagcatctactcacacttagctcctgctctgaagttccttgtccccagtttgggggactctgtctcttctggggcaaagggcagtgcgtgacctcctgtgggttttgcctgccctgaatccagaggttttcgatacctttgaagcccttcctctgcttcttgcaaaatatccctttcctgaggcaatgacagcgacastctaaatgctggaatggaggaaaggagtgtgtgtttggggagggggcacggatantgcattacagtagttcataccttccacctctggaaactgggaggtg

SEQ ID NO: 10888 - DNA, 301 bp, Homo sapiens
agagaagcatgaaggcccacagacgctcgggggcagaccaagacgccctggggtccccgaaacagagatgtacagagtcggacacggaaagggagagaccaactcacggttaagaaaggagggagaccagcccaggatcaagaaagggaaagaccagcatggtctcaagaaaagaaagagaccagctcaggctcaggaaaagagagagacccagagaaaaggagcactcgaggctgagacagatctggacagagatacagagacagggaccagcagacccagtactggggagacaagaggt

SEQ ID NO: 10889 - DNA, 407 bp, Homo sapiens
ttaaaatctctgtctattaatgctgctaggaatatctcttgaagtttgtcatctgccttttttcagatgtttctcaacctaaaagaatgtcctgtaatctcttagatgttttcatctgattatgtgttccaggacttttagcgccaccatttttccttagttaactgtattgaatttttaaaatattcttgtgctagttataacttgatttacattaagagaaaccactaacaactttatgaaatatgtaatcctttgatttaaaaaaaaagttcatgttaatatttacgatttgattttattggtgggaaagatgcagttttcaattacaacatcattaaagcatggctttttagtcataaactaatgtgaaatgttcacttttcctgtttcttaccctccatact

SEQ ID NO: 10890 - DNA, 497 bp, Homo sapiens
cagtgtaatctctatcaaaataacaatggcattcttcacagaaataggaaaaacaatcctaaaatttttatgaaacaacaaaatatactgagtagtcataacaatactgagcaaaaagaacaattctggaagcatcacactgcctgagtttaaaatgtgctacagacatatactacaaagttatagtaaccaaaacaacatagaactagtataaaaacaaacacagacacaaagaccagtggaacagaatagagaacccagaaataattccacagccaactgaattttgagaaaggcaccaagattatacgtcatggaatagaaactttctttaataaatagtgctgggaaaactgtacatcagtatgaaaaagaatgaaattagtccccccaccatgatatacaaaaaattaactcaaaatgaaagacccaaaactataaaattactagaagaaaacataagggaaacacttcaggatattggtctaggcaatgat

SEQ ID NO: 10891 - DNA, 53 bp, Homo sapiens
aggtgaccccagcccctgaaaatcctcacccagggccccaaatctcccagccc

SEQ ID NO: 10892 - DNA, 360 bp, Homo sapiens
  misc_feature 73,75: n=a, g, c or t
aagatggcgtctcctcaggggggccagattgcgatcgcgatgaggcttcggaaccagctcsagtcagtgtasnanatggacccgctacggaacgaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtkcaaattaagatccacgagacacagccactgctcaagctyaaacttgamcsggktmatgcagtacatcgtgtataagctggtgcctggcttgcaagacattctg

SEQ ID NO: 10893 - DNA, 436 bp, Homo sapiens
  misc_feature 414: n=a, g, c or t
aatgcctgggattaggcagatgattttstttttcccccatacccctctattatttaggtgattgagtttaaacccgtttcttttactgtcttcctttgtttagtgttttgggcctcagtatacttaaagagtaatactatttttcttgggttgcaggtttttttgtattttttcgagacggagttttgctcttgtcgcccaggctggagtgcgatggcgcgatcttggctcactgcaacctccgcctcccgggttcaagcgattctcctgcctcagactcccgagtagctgggattacaggcgcccaccaccacacccggctaattbttttatatttttggtagagacggggtttcaccacgtcggccaggctggtctcgaactcctgacctcagatgatccacccgcctcggnctcccaaagtgctgggattaca

SEQ ID NO: 10894 - DNA, 371 bp, Homo sapiens
taagctgagtgtgtttgaaacacaaatgtacctatatttgggagaaaggtaatgcctattaagagtgtggcctctctttgctgtttatcctttgtatgtcccatatataaatttaaatacattatatatataggttcaaacttaaggagatataaaactgtggagtccatttgcattttctcttccctgaccttattttgaaggccagtttgtgtgtctctgtgtgggggggaacacttgggtggggagaaggtggaggggtatattgtgaacacagagaaaagtaatgtggcatacacaagatgaagttttcacaagccatgaatctagacctagagaagcttcagatttctggtggagtttcatgcaag

SEQ ID NO: 10895 - DNA, 358 bp, Homo sapiens
atcactctttccacatgacaaaaaccagtatcaaaggcaacagcattgtctgtgaaagctttaataaaaccacgtttgtttttctggcgaaagaggcgcaagatgaatgcttcttgacaagactcgattattctgtgggctctatacaccaagatgcctgagggggagaaacataatttaaactacagaacaggaacatcgtaacaccaacaggcagagatcasagagatcatagaatgctgactatgtgccatgctaccaagtattttacatataagcatttcatttcaccctgacaatcctaggaggaaggtactatctttatcaccaatgtamgggtcacagatatttactgagc

SEQ ID NO: 10896 - DNA, 67 bp, Homo sapiens
ttcttagtcascaatrtattaatatatacatttgttatatatatgttttatatgtatttaatatata

SEQ ID NO: 10897 - DNA, 278 bp, Homo sapiens
  misc_feature 252: n=a, g, c or t
atataggaagtccagaaggacagtcatctgccacctccagttaaaaaagaacaaaaccctcacactccaggaatgagtcaagaacccagtgaaggccacaggtctagcccacaaccacctaggtatgtggggtcctccaaggctcacgcttgtgtcctgcaggctggagccatgcgagggtctgcagtctttgttccggatggggaactactgcttcactggttacccaggtgccccgatggggaaaggaangaaatggtgagaatcttcagcacagc

SEQ ID NO: 10898 - DNA, 156 bp, Homo sapiens
akcccactggaaagcttcaatacagctgtggaaatctgcaccctagaagatcctagtacagaaattctacaaccaaccataatcatggaagagccaacttccagcaccaacgagaataaaatgaagagcccctgtgaatctaacaaaagaaaagtt

SEQ ID NO: 10899 - DNA, 215 bp, Homo sapiens
aagctttactctgtgccctggcctcccctctcttcacctttagatttccattcaccgaagtggctttggacccctgggtactcttgggacctgtttcctggaggccctggcttgggacactcacctgtgaamtatgcagctgggagctctctgcctaagagtttgcactatttaaacctgcctgggagttaggacggatggttttaggaatgacc

SEQ ID NO: 10900 - DNA, 159 bp, Homo sapiens
  misc_feature 44: n=a, g, c or t
aagtctttagtagaattkcaaaakacagaatattagaaccaatnatagaaataattaagactcatcaatatagttattctgacaagtgaaagaaagaaagagaagaatagtcaaagtcatgatgtgctggaaaacagcctggaatcattaggtataatt

SEQ ID NO: 10901 - DNA, 375 bp, Homo sapiens
tttcctttggaactttatctttaagataatagtttacatgtagtagtacttgaaatctaggattattaactaatatgggcattgtagttaattggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagattcattatttctccactttgttctttaggagattttaggtgttgattttctgttgtattttaactcatacctttaaatgaattccccaaagaatgt

SEQ ID NO: 10902 - DNA, 479 bp, Homo sapiens
  misc_feature 386: n=a, g, c or t
atcctttagttgtttttcctgatcctctccctcctcccaccttccaccctctgataggccccagtgtatgttttcttcttcatgtgtccatgtgattctcatcatttagctccaaattcatctccggtgcctgaaaccttcacagtcatcatgctatttcgtgtttatcattaatcttcctgttgaaagcatccccttttctcccctcttgttcctgccctggcccatttgcagttcaggtgatcgaccctctcagaaaatgctccctgtgaagccaaaatatctgtggaaagctgaataaatgaacatggccatttgacagagtgtacccacaccagacctgttgtgcaatgccttgaacgtaagtccttttcaactaaacggangtatattttcttttrtattgttgactttgaccctkaagcttagcaaagaacacttgtgcaacattttctggatcaatttatcatctgctcaga

SEQ ID NO: 10903 - DNA, 476 bp, Homo sapiens
actttttaacttgcagtattgtagataagaagtctggctttgtctcactatttttttttaattttaataacctagtctttccatttggaagcttacaacataatttctatttttgaaagccagaatttttttgttttttcaccgtactcccatctctaattaatcctgcatctatwwtaagtgttttttcactctattcctatctctaattcatcctgcttgagacttcatgagccctttcagtctaaaatcaagtcttatttagcctagggattactttcttctagtatttctttgattgttttttgtttgttccttttatacttcctgtgacttctgtaattttaatattagagtttttagatttgtcttcttacagttttattaatgatttttggtttctttggagttacttacatgatatatattctagactactaatttgttattttcagtgactttttcactgcctctga

SEQ ID NO: 10904 - DNA, 373 bp, Homo sapiens
atccttccataaccgtgccacttgataatacatttttttctcatgccatccaataactttttttctctaaaaataggactaggatagtaactgcagaataactaaagacttcasttttttactgctcagatgaacattcaaaataagtattatatggaattttgctgtagttttatgcttacttggcaacacaagcctggcctagtttctgtaactcaaggtttttgacsatgaatggaagttaaattttataatcagagcattttctaagtcttgtcccacaaaaaaataaaatataataaaatggaaactgttcakgccctagagataatttgstggtcaagcacatatttacacaagtagagtgcatggc

SEQ ID NO: 10905 - DNA, 369 bp, Homo sapiens
tgggagtttatgctgttatttaacatattttgcttccaaaggggttaagatgttttacctaaatggaggtttctaggtcagtgctatacaatatttctaatctgtgttttatagtgtgagctacatatgtaattttaaaattttcaagtagccacataataaaggaaacaggtgaaatttaatgacatatttcctttaatacggtatatccaaaatattattatgtcaacctataatcagtataaaaacctgttactgaaatattttatagggcccatctcagttcagactagccacatttaagtgcttcatagccacatgtggctcatggccatccatatttggacaatgtactttagactattgcat

SEQ ID NO: 10906 - DNA, 103 bp, Homo sapiens
aaagcaaccgcgtggtacgagtaacaactccaccggctggcgtccgckgcgcttggcsacaagtcacttttccagatctaggagcaccatggacacctcgtca

SEQ ID NO: 10907 - DNA, 68 bp, Homo sapiens
ctcttcctttctccgcmwtcgtggtgtrttctttactccgctgctsgccatstcttctcacaagactt

SEQ ID NO: 10908 - DNA, 349 bp, Homo sapiens
cacatgaacaagaagttctagaaacagttcgttttatctgaagtgctttctcttcctgsccactccgtccagcctcaggcccgctttctctgcatctccgcagagctgtctctaatccttcaggagctccctctgaatactgggagtctggstctwcwctcactccacaacttgaaactaataaggagctgtcttacgtgacctgagatgtgtactctatttcctggctatttcctcaaatcctttcctgcagagacssctctctgcsataagtaagagcccasctcgtgtttatgcccattggagcccacagttggtattgygtaatcacytttcggagttttattga

SEQ ID NO: 10909 - DNA, 138 bp, Homo sapiens
acatttgtgcaatatttaggaagcaaaattgtagagcaggaatggatctgaagtcaatgaaaaactcttcatagctctagttgttgggcttcccagaagatgacattgaaaggaaggtttggatgcaagttgttcatt

SEQ ID NO: 10910 - DNA, 203 bp, Homo sapiens; identical to SEQ ID NO: 10104

SEQ ID NO: 10911 - DNA, 184 bp, Homo sapiens
acttctctcttcccacctctatctgccttattgaacttcatctttccttcattctcttcaacttccacttcttcttgtatggtcctgttgatgccatcttgtttccgtccccagactcatcatctttaccctctgtcaactgagttcccaccctggttctctctcaagatcttcctctcatagc

SEQ ID NO: 10912 - DNA, 197 bp, Homo sapiens
actcaagactgctctgcctacagagaagccattcttttagtttcttctttttaaaaaaattagagacagggtctctctatgttggccagtgtagtcttgaactcctggcctcaaccaatcctcccgccttggcctcccaaagtgctgggaggtatgagccaccatacctgacattctttggaatccttttttttttt

SEQ ID NO: 10913 - DNA, 227 bp, Homo sapiens
  misc_feature 127: n=a, g, c or t
ataaaaagacataagtgatactgtactatgcatacattgtatcttaatgctgtttcagatcagcattttaaattttggtttgcatttttaatattggcaaaacgtaaccactgttaattaaaataanaccttgttgtatatgtaacaacataattttccctctatcccttcccaccctttgttctctatttctccctatcagtgccaacttcatacattttgtagca

SEQ ID NO: 10914 - DNA, 229 bp, Homo sapiens
aacttattttcccaggaggccatttacaaggggatctggatgacctgctgatggagatccagcttgccagggacttaggtttatcctgttttgtttgctactggttacaaattctattttctgtacaattagtcagactaaagttttcactgtatttgtttggcaaaacaaattaaacaaaaagtaaggtttttaaaaaaaaaaaaaaaaaaaaaaaaaaaaaaaaaaa

SEQ ID NO: 10915 - DNA, 251 bp, Homo sapiens
  misc_feature 63: n=a, g, c or t
ttgactgtaggttttatagatcttacatacaaaacaccagattctcttcttcctttaggttanatgagtaattataagtatggattattatagtaacaagaaacaagctgggttgttttgaaaaagcagtaagatttttttcttaaagcaaaaragcctcactctatgacttaattcaagttctatattagattaagtactacttactgatggatacagtgaaattataccttaacttagacaaagtaaag

SEQ ID NO: 10916 - DNA, 59 bp, Homo sapiens
aagtgggsgggtcgcgaggagcctgaggaagagggcggcgacggtggtggtgactgagc

SEQ ID NO: 10917 - DNA, 477 bp, Homo sapiens
  misc_feature 309: n=a, g, c or t
aggtttctggagggtgtggcccccagaggcatggaagctctgcacccctgctcccatacctcaccctacgcatctcctcatctgtatcctttgcaatatcctttgtaataaaccgacaaggtcttgatctgtcaccaggctgaagtgcagtggtacaatcaaagctcactgcagtctcaacctcctaggctcaaacaatcctcccacttcagcctcccaaccagctgggaccacaggttgacatcaccacacccaggtgaaaactccaaagcttaacattctaaccactctagggatggaggatgggangaagagagctgagtgtgcaccaaggagcggtaagatgccagacctgtgagtgaagaagcatcttggaagtggaccctatagctccaggcacctgctgacacatagtcggaggcaaaccacccagtcaagttcaacccaaattcctgacccaaaaaatcataagcaaaa

SEQ ID NO: 10918 - DNA, 469 bp, Homo sapiens
tgattgtktttttaactagcattcaacctttaggttttacaatagaattatttccccaaatctgccatgtgctgttttctagagtggattgacaattattctctggactttttggtaaccaagaacttctagcaactaaccctggcatgaccaccagaatctgcagggctgagagaagaaagaaaggcaaaagtggatgaatgcagctgaagatgctgtggaactcctatcacattccaagtgctgtgttgatatctggagatatagacaagatcgaagcagatgcagtctttcacatgaatatttgaatcaggcagtatgttccccaaattagcaaagtatctcccagattttttctttgatgatatatttgaaatcctaatgctgaaagttaaattatcagggttttaaaactagaagcagtcattatcagaattttatatactattttatttttaagaacgtaatt

SEQ ID NO: 10919 - DNA, 353 bp, Homo sapiens
ctatatccaaaggaatgaagttaataggacaacctgaaaagtattgttaagatgagaactaaaaagaaatcagccaggcatggtgactcaccctgtaatcccaacactttgggaggccaaggtggaaggatgttttgaagccaagagttcgagaccactctggccaatatattgagacccccatctctacacaagctttttaaaaaagttagctgggcatggtggtgtgcacctgtggtggaggctgagatgggaggatcgtttgatcgtaggagttcgaggctgcagtgagctatgatcagaccactgcactccagcctgggtgatagcctgtttaaaaawaaaaaaaaagg

SEQ ID NO: 10920 - DNA, 112 bp, Homo sapiens
agttctgtgtcgctaggcttcggcccggccgccgccacacataagctgcgatgaggagctttacgacttcccggtcttcggggccgggcgcaaagggccagactctgcgcta

SEQ ID NO: 10921 - DNA, 247 bp, Homo sapiens
  misc_feature 8,147: n=a, g, c or t
agcatgtnggctccccaggttggagccctttccctctcccctgcatgtccatcgcaggcttcaatgtgtctggcaggcagatgagaaagctgaaatactgcaarttgaaatgactcgtcctagatcccaggtctagtgaagagtgangaccagaaatcacatgtactagactaccagcagtcagatataatcagcccccaaatctcctgtggttcactatwtttwaaaggaaaaaaaaaaacmaggg

SEQ ID NO: 10922 - DNA, 80 bp, Homo sapiens; identical to SEQ ID NO: 10797

SEQ ID NO: 10923 - DNA, 218 bp, Homo sapiens
attagagcccggaacagctaaccactggattagcggatgtccgctgtgtgagtctgatgtgcttttggcaggatctgaaacctttaacatgtctggaaatcccagaatcttcccaacagtctgctcctgaaagcatgtgatataaacagttaccaatctgctgctctgtacccagcaccttcctgggctctggcctggtcacagctcccgttcctcaa

SEQ ID NO: 10924 - DNA, 226 bp, Homo sapiens
  misc_feature 152: n=a, g, c or t
ttaggcagttctctgcatgaaaggaggtgactaggttctcttttcttccaaagtcaaaaccagataggaaacctttgaagatgcataggaacatgtcatggtagggtggtgggctcctcttcagatcccacatagcagctggggccagccanggcgagatcaagggtgaatgtaggtagatgccagcaagggaagagcatgatcagagactatgagtgggctggga

SEQ ID NO: 10925 - DNA, 243 bp, Homo sapiens
actctaatactggctctagaaattatctttcttagaaaaaaggtgacactcttacagaagttctctaagaatagatgtaacagtttaatattgagataattatacatgtctctaatctgtaaatttctcatgagaataagaagagaaatagttttctttactactactactactactactactatagtagtattagtaacagcaggtaataattacttagcacccaggacctcctgacacacc

SEQ ID NO: 10926 - DNA, 463 bp, Homo sapiens
gtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcarctataaacccaagaaactgtattactattactgttggtcatactaaacctgtctatttcctgaagtatatgacccacaagg

SEQ ID NO: 10927 - DNA, 512 bp, Homo sapiens
gataagagaataaaagcaggctgtgcagccagcagtggcaaccagctccagtccccttccacactgtggaaactttgttctttcactctttgatataaatcttgctgctgctcactctttgggtccacactgcctttatgagctgtaacactcactgcgaaggtctgcagcttcactcctgaagccattgagactacgaacccaccgggaggaaaaaacaactccagacgcgccgccttaagagctgtaacactcaccacaaaggcctgcagcttcactcctgagccagcgagaacacgaacccaccagaaggaagaaactccaaacacatccacacatcaaaaggaacaaactctggacacgccgcctttaagaactgtaacactcaccgcgagtgtccacggcttcattcttgaagtcagtgagaccaagaacccaccaattctggacacactgggaggtgattggatcatgggggcagatttcccccttactgttctcatgatagtgag

SEQ ID NO: 10928 - DNA, 463 bp, Homo sapiens
cagatgtcctaatgaacatgcacctacatttaataagagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcamcattgcttcatttctttgcaaaatgtagttaagatatactttattctaatgaaggccttttaaatttgtccactgcattcttggtatttcactacttcaagtcagtcagaacttcgtagaccgacctgaagtttctttttgaatactt

SEQ ID NO: 10929 - DNA, 131 bp, Homo sapiens
  misc_feature 15,41: n=a, g, c or t
attctcctgcctcancctcccgagtggctgggactacaggngcccgccactacgcccggctagttttttgtgtttttggtagagacggggtttcaccgttttggccgggatggtctcgatctcctgacctc

SEQ ID NO: 10930 - DNA, 312 bp, Homo sapiens
tgctttcaccattaaggttgcattttaatgcagttattgttttaaattagagaataaaatgtaaaaccaagggaggctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgttctgggggctgcagaatgac

SEQ ID NO: 10931 - DNA, 242 bp, Homo sapiens
atatatccttggttcagtactcaggtgatgtgactctcctgcctgcttctgcctacaggcacagtatccgacatgttgtttcatgccttattattttacacatgctattgcacctagagtctttgtatcctgactctgcactttgtctgtccttcccaatatggccccattatggcagcattttctatgcttttcagataaaactgattgttctcttaaaaaaaaaaaaaawtkcgaaaagc

SEQ ID NO: 10932 - DNA, 79 bp, Homo sapiens
  misc_feature 7: n=a, g, c or t
agagctntaaccaatctcactgtttccgtacctcacttctgattcctgtacgtcactttaccttttttttttttttttt

SEQ ID NO: 10933 - DNA, 386 bp, Homo sapiens
agaaaacttgtacagaatgaaaaaacctgatcaaatagacactgcatacaacatctgcacaatatatatgccttttagcagcaaaatggaatatatattttttttagttgaccaagttctggagcaaaaagcaaaactcaacacagtttagcggttttaaaatacacagcttgttgcctgccaaatcgatctatcatcttcggacctcatgctgagatccagacctgtgtatccaaccaacaatgtgctggaatggtcttgtaagagcagacagtgcccattttctttatcgtgcctaccattgatgggcatctaggttgattccatatctttgctattatgaatagtgctgtgatgaacatatgcatgcgtctgttttttttttt

SEQ ID NO: 10934 - DNA, 464 bp, Homo sapiens
  misc_feature 397: n=a, g, c or t
agcggagtcctggttgagtgaccatccaaggaatatgtcctcgcgcgcggccgccgttttccttttcggaatgtgggtaaagaatttaccgctaacagacgacctccaggttcgctcttggacagcaagattgagagacaaaacttaacaaagcgctgtgcaaactgaaatcccaggcttagctcgcttgtgtcttgaacacggaagtcacctagtcacccacaagatgtatgagtacagctaacccccagatgcatttgacagacggcgtgggacgcgccacttgctgattggctctactttcccagttgaccgcgacakcccccagccccaactcccttttgatggggctgtgaccacctgccggtcccctcacccacccctcacgcccggagantccgagttgattcgagtactcactatgtgcttatgtaacacatgttttcattattaaaatataacta

SEQ ID NO: 10935 - DNA, 412 bp, Homo sapiens
aatcacagcactttgggaggccgaagtgggcggatcccctgaggtcggagttcgagaccagcctgaccaacatgtagaaacccccgtctctactaaaaataaaaaaattagccgtgggctgggcgcggtggctcacgcctgtaatcctagcactttgggaggccgaggcgggtggatcataaggtcaggagttcaagaccagcctggccaagatgatgaaacctcgtctctactaaaaatacaaaaaaattagccgggcttggtggttggcacctgtatgtaatcccagccactcgggaggctgaggcagagaattggttgaacccgggaggcggagattgcagtgagccgagatcgcgcccctgcactccagcctgggcgacagagcgagactcgtctcaaaaaaaaaaaa

SEQ ID NO: 10936 - DNA, 531 bp, Homo sapiens
agcagaatgtaaggctggctttggctaaaggcctggatattagtcatgctggcagatacagtgaaatcactttgaaaacatgtgctcatgttgccttgtgccagtcgttcagtaggatttccaaaaatcttcatcatgacaatttgggattggacacagccttctcttcagagtgacttcagtgatctaaagaatgttggtcctgccctctggcattagaatgccataaagatctctaagtttgcctgtgcgtggaagcactgtctccataaagtttgagcatgtccattctctaaacacctcttatcctgatccaaaatcttgagccacaggactctaactgaagagaaagaaaatgaatctactgcctcctccgaagctagtccttcagatactagaagacaattatgccctctttatcaaaggccctacttaaaccagttcagtgataatctattttctatacccgtttttcataaatagaccccaaatgtgttgtttcttacataattatagaagtgttcaagagaa

SEQ ID NO: 10937 - DNA, 304 bp, Homo sapiens
aacgtgatgattgcgcaascagaaaatgggccctcttggccgtcgggacttgtactgttggtgactccgtctccttagacggtggagcctgcgtgacccagaaaggccaaagggcacactagccagctgttttgccacgagagtacaccgaacaaaggagacagggttatttataacctgacacgtctaccctactgctgtgtgtggtttccattgcctggaataggacctgaaattctgtatttgtcccaactggctagcaacttagaactttctaaaagagacaaaagcagaggagaacaaa

SEQ ID NO: 10938 - DNA, 372 bp, Homo sapiens
aaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaaa

SEQ ID NO: 10939 - DNA, 458 bp, Homo sapiens
gcgaaagtactgaccctggacccccagttgcctgggtccacctgtcgaaccaaacacaagcctcttttaggtctctttcactcatctgagcaggacttggctacccagaaacgccacctaacacccgcagcttcgccccatcatctgtgactacctactgtgcccgtgagactgtccagtctatagactgccgctcagagaagagcttcactccaaactccaggagaaacatcagtcaaagataccggtatacccgacctttttaagggggggaagacagtgcgaatgtgagaggtgtttcttcctcagagaagggacgtgtctcctgatggtcccacttcaggagccagcatcccagcgaactgataccagctgatagaggaggaaaaagcccgagaagccagttcagaaaggcctgasatcttctccctcccgsagagccacagacactcaccact

SEQ ID NO: 10940 - DNA, 203 bp, Homo sapiens
aggggactagttgatacttaaatattcccagccatagaattagtggtgcttagactgaagacctttcattttgcctcttcttgtcttgaacccgtttgatgactgtgtagagatattgcttgtagcactgccaaagaatggacttcgatgatgaagatggtgaaggccccagtaaattttcaagagagaatcatagtgaaatc

SEQ ID NO: 10941 - DNA, 185 bp, Homo sapiens
atatggtgaaacgtgtctgtactaaaaatacaaaaattagctgggtgtagtggcatacacctgaaatcccagctactcaagaggcttgaggcacgagaatctcatgaacctgggaggcagaggttacagttgagccaagatcacgcactgctctccggcctgagtgagactccatctcacaaaaa

SEQ ID NO: 10942 - DNA, 220 bp, Homo sapiens
ataaaataataaaacttttaagtttactaagcaaaagacaaaccccaaaagaaaaaaagggggggcattttataggaaaggaaacataattgtctaagaataatatgaaaagatgttcaagctaattagcaattatgaagatatgcaaatctaaatataccacaaagatatgatttcatattcattaaaatgacaaaaagtaaaatggcatgacaaaatt

SEQ ID NO: 10943 - DNA, 366 bp, Homo sapiens
  misc_feature 11,356: n=a, g, c or t
tcctgtcaggngcacttcgacaggcccgttcctacggcctccgaggttggtcacgaactcctgacctcaaatgatctgcctgccttggcctcccgaagtgctgggattacagacctgagccaccgcactcagccctattgtgtccagaattggtgggctcttggtctcactgacttcaagaatgaagccacagaccctggtggtttatttaacaatgtgaagtagtcccgggaagttgtactttgagcaaggtccgcaagcagtattcctgcacttctccagtcatgccccagcgccaggtcggaagctgtccacatgcggggatggagcctggcgtcctgggcccacaaggacanggccctgaat

SEQ ID NO: 10944 - DNA, 359 bp, Homo sapiens
aaaaaaacgtttcttcacaggtcagattgtaacaaacactcgttcctaatttatgaactcgccgttttgattttattatttaagcatgcgccasrattcgtgtttccttaagaaagaactgacctatttttggctggagataaacgatcatgttaacagatgttaatcttgtaatctgtttttcctgtaagcactttacctagccgggtttcagaccttaaaaataacatcttttccaaaaagacctgacgtcacaattcactccctgaaaaatcacactccccctccagtttcttcccctgcaatgatttcaaagacattaaatcttttccactttataaatgctgatctgttctgcc

SEQ ID NO: 10945 - DNA, 260 bp, Homo sapiens
ctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccagctcaggca

SEQ ID NO: 10946 - DNA, 331 bp, Homo sapiens
atcatactcaccatggctcacaaactgcctgtttgaaactcccttcagttctgagaggatgggaacattctttaagcggttcgtcttggcacgagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggca

SEQ ID NO: 10947 - DNA, 344 bp, Homo sapiens
tataacatacagatttgaactataattcttcctaattaagacttccaatttggctaagtgcagtggttcatgcctgtaatctcagcactttaggaggctgagcttgagcccaggagtttgagacaagcctaggcaacttagtgagacctcatctctgccaaaaaaagaaagaacgaaaaagaaaattaggcacgtctgtagtcccagctacctgggaggctaagttcacgggaggatcacgtgagcccaggaggctgatgttgcagtgagctgtgtttgtgccactgcactccagcctgggtgacagaacaagaccttgtctcgaaaaaaaaaaaaaaaaaaag

SEQ ID NO: 10948 - DNA, 391 bp, Homo sapiens
  misc_feature 64: n=a, g, c or t
ctcgacrcgsaactggctsaaagacaatgttattttccttccctttcttgaagaacaaaaaganagccgggcatgacggctcatgctgtaatcccagcactttgggaggctgaggcaggtggatcactggaggtcaggagtttgagaccagcctggccaacatggtgaaacctgtctctactaaaaatacaattagccaggtgtggcgcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaatawatatgagataatgcagtc

SEQ ID NO: 10949 - DNA, 87 bp, Homo sapiens
caaattgccttaaaagaaatcagacaaatgccctgagtggtaacttctgtrttattttactcttaaaaccaaactctaccttttctt

SEQ ID NO: 10950 - DNA, 369 bp, Homo sapiens
gcactggatgcacgcagccacatcagaaaggcggttaagaggggcgggggaagcgctctgatccacgatgtcctgcgagctgatcaatcagcttcacgctggaaataaccatataaaaacctgaactcaaagaagagaactggaataatcctccctaatcccacttcccatggtgagccccagctgggacgctgacacatggccccaactttttctcctgcctgatgtctggacccacaggggacagatggtggtccctggtcactgaagtacccacagaacccatgcaagaggcacaaaaccatctgcttagtggtcatgtggcagcagacagtatctcagaagtcctcgcagcatatgacttcactg

SEQ ID NO: 10951 - DNA, 364 bp, Homo sapiens
  misc_feature 197,300..301: n=a, g, c or t
gacacactgtccagttcagaggtaagaaaactggagcccagagatgtttggtcataagatttcaagatsgctmattggggttatgaatgaggccgggtgtggtgggtcacactgtaatcccacactttgggaggccgaggcgagcggatcacctgaggtcaggagttcaagaacagcctggccaacatggtaaaacncagtctctactaaaaatacaaaaattagctgggtgtggtggcaggcatctgtaatcccagctactcaggttcccaagtagctgggactataagcacacgccannacgcccagcgaattttgtatttttagtagagatgggtttcaccatgttggctgggctcttctc

SEQ ID NO: 10952 - DNA, 426 bp, Homo sapiens
attcagaaccttttctgtaatagctataaactgaaagcagcacatgtccaacaggaaaatgaataaacaaatacagcatattcatacaatagaatcctatacagagcaactaaaataacagctagaggcaacaacacggatggatcttacaagcctgatgtggaacaagagaagcctgtccagagactaagtgaatggatttatgtggtatgcaaaaacaggcaaaaccaaatcatagtgttttgggaggtatgcttacatagtaaagctctgaaggaaaacaaagaaaaggcgactaaagagaatgacaacttacacaatgcagaatcctggattggatcctagatccaatcaacgtgtagggatgctgatcccactccaagtctagaacatcattcacatcttggacagcaaatttcacatact

SEQ ID NO: 10953 - DNA, 239 bp, Homo sapiens
ctccatyyyyytgatggthaaatggcagtgggtgcccagaactgtcccaggtctctggctcactccaggaatcctcctcctagaagatggaagcttctttgacccggccaagcccagggtctcattctgttgcccaggctggagtgcagtggtgtgaccasagcttactgcagccttgacctcctgggctcgagtgagctcccasctccacctcccaagtagctgggaccacagatccg

SEQ ID NO: 10954 - DNA, 481 bp, Homo sapiens
cattaattttgatttcaaatggaagataaataatatcccaaatgaattatctgtaacagaaaagccaagactttaactttcattacatatctaatagttgatatcaccagttaccattttgaattttgtatagtactaggttagaacattgcttaatccttttaaaaaaaatgcatttacgtaaacacgaatactgaaattgttggattttttaactatatctgacataattttattcatcaattacattacacattcatttagcccagatttcaaatagtgggggaagaaagaaactgtatttcagagtaaaatctcctaaaggaaataaaaacacagagttgtaaatacacatgcttgcaaaaacattagtcgtgaaatccctagcaacaagtcactggatttttctctgtcagcacgcgtgtcagctgccaaagaatagacttaatgaagaagtgcccacatgctggcaggggccggc

SEQ ID NO: 10955 - DNA, 209 bp, Homo sapiens
gttctcgccggtctccgtgcggcggcatctccgtgtccctgtgactcgagaccgcggctgtcgggtctccccctctctgaccctgcgtctctgtccccgctgtgtccgccctctctccgtgactctgtgtgtctctcgctgtcttgctgtggctgtcactcccaggctgtctcccagtacttcctggactctacctcggaaacttcatt

SEQ ID NO: 10956 - DNA, 67 bp, Homo sapiens
gactaaatcaagggaaggttttcatggaaaagtcaaaaaaaaaaaaaaaaaaaaaaaaaaaaaaaaa

SEQ ID NO: 10957 - DNA, 428 bp, Homo sapiens
attgtgggagggaaacatacaaggtgatgaataccaagaggcaaggatcactggagccatcttaggaggctggtgaccacacatgggacatggattgaatatggaaaagttcatgggaaatggtcttctgtctggttcaaatgctgatttggccacttaacaaattttcccaagattaagagccgttaagtttgtaaaatgaggatagccattctttattctcaggatatttcataagatggaagtttactgttctgattttcatgctgaaagagcagcgagagagaaaattcatgaggaaaaggagcaactggcattgcagctggcagttctgctgaaagagaatgatgctttcgaagacggaggcaggtaaggaaaagagagaggaggacccagwgctcacatcagcatggccgtagaagaggtgc

SEQ ID NO: 10958 - DNA, 453 bp, Homo sapiens
gattctacgtgttgagaaaaaaaaaactcctctcttcctaaggcctccatattgcatattgaaagaatgcaagttggctgacctttaaatcatattgtattcatgattgtgaggatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtragaaaaccaagccctcatcacattttgtaccgaaacctattgaaggccttgcatctttaggacactgaacatccttgaaatttgggtactgaaactgtgttggaaaaatagtatcaagtgcaatcagagagaaacaaagtttaaatcagttttatactaagtactatctataacatcatacctgctg

SEQ ID NO: 10959 - DNA, 346 bp, Homo sapiens
acacccttcaagattgctcgaggscagcctccctggagcccgggtcccagccatgtgtctaaggccaacataatggtaatagttaaaggacttcatgtagcaagccagaactgaactaaatacatggasatctcaaacatgagtgtcatttaggactgaaggsaaattaatgtcataggggtggagatcaataagaaggtaaggagccactggcagtatgagtccaaacagggtataccatggaaatcacctgtggaagaggaaggtggattccagaagaaagakaacttgtgggagtgagcatttcaaggatggagagatcttgaagatactcacagggaagata

SEQ ID NO: 10960 - DNA, 506 bp, Homo sapiens
agattttcatttatttgccttagsaaaactgaatttttttgttcttgtttaaaattttcacatttcacagggaaagaaaaaatcctggatagctagaacatgacagtttccccatctgtgagaaattgctccaaaaacagtgattgactccctctgtctctgaagcagcttcctttggaagaaagcacttcctcgatatatatatgaacctacctttgaggatgaactactactgaagctcagcctaatgaattgtcagaactgtcagacagctctaaggaatgacaaatgtctatgatttgctgctgctgctgctattttgctggaaacacctgatctttcctggctatgtgacctgaggcctcagtttctccatcgacaagatgaaaataatgacatcacctatctgagagaactcatgagctgacactattttaacaaactcccctttcatgactgaagatgtcacctacctcagtgactgggggctcagcacagttgcttcc

SEQ ID NO: 10961 - DNA, 146 bp, Homo sapiens
aatactgggctaaaatcaacgtgtcaggaaggctgtgttccttcttgaggctccaggagaagtcgtttctttgccctttctgggttctagagactgccacattcggatggaatctcactctgtcacccaggctggagtgcagtggc

SEQ ID NO: 10962 - DNA, 493 bp, Homo sapiens
aaggacccaggttgacagaggctccaccatcttgtaatgtaccatctggaatgcattgcctccccgcctccccagcccatgatggggaagacaacaatgaagggcaactcatctgcaataaaatgttttggcctggtagaccattaactgtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcaaaactaacacatttttaaagctttcccccacttttctctctatttgtattgttagccatcttgaagtgatgttgtttaacataaattgtactgttgaatttgg

SEQ ID NO: 10963 - DNA, 597 bp, Homo sapiens
  misc_feature 490: n=a, g, c or t
taataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtgnaatttactactgttgtcagtatcggtgttttgaattggtgcctgcctatagagatatattcacagttcaaaagtcaggtgctgagagatggtttaaagacaaattcc

SEQ ID NO: 10964 - DNA, 507 bp, Homo sapiens
aattcccagagtgagtaaaaccccccttctaaagaaagcctccatcctgcttcacattcaaggggcttctaggccatttgcacttcgtttacacctcattaaactgcccacattatatgcctgggtcccaggtgactgtgggaaaagatcaaggtttcctgcaacctcactgggcattttcagaatgatctgtacaagcgttgactgaatgattgattccaagttcccccttcctaggatttcagacctcctcttgacaagtgatgaatgggccatcttaatcttgtttggatcagaaaggaccatacaactgagctttagacaagactaaaaataccaaaagtagcagtctgcaattttatgtgcatgtggcttgaagctctgacaacaacacaaaagaacctcctttagacgtccttcacttccaggatccagtccaaactcctgggcttggcacatgaaccctccatcatctggcacctggcagcccacatgctggagcctcac

SEQ ID NO: 10965 - DNA, 438 bp, Homo sapiens
taaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaat

SEQ ID NO: 10966 - DNA, 356 bp, Homo sapiens
tgaatttgatttccatgttcttggccaagatcttagagtactataggcattaagtttaattacttcttattcaaaattttcaacactccccagttaactggtacttctctgcattttccaaatatatgggaagtgagatctcaaaccctccaccctgtgaccctggcctacctctggagagcttgcagtacaatactaaaatttcagttcctttctaaaatttgcagacaccaactctccttcttcaatttgtagtatcaactatttgtttttgtttttgtttttttttggagacagagtcttgttctgcactccagcctgggcaagtgagtgagactctgtctcaagagagggga

SEQ ID NO: 10967 - DNA, 591 bp, Homo sapiens
  misc_feature 430: n=a, g, c or t
aggattcaaacactagactgcaatcagactgtggctattttaacaccagtgacgtcatatcccattgatgccttaaggacacgatgagagaagtttcttctttgaacatcacacaaagccaaatacatcagcagctgagcatacagagggcatgaggtctactcactctttggtcagaagaggacaggacttgagcagaaagcgtgagagccccgagtcctggaagtagaggtcaggtggggctgtggggctcttcaggttcaaacaccggacgatcacgtacagcacagcagccactgcagccagcttcactccatcaaacacggctgggagttcgggagtctccagcatggcattcatcttgatctggggagcagaggcacaggtctaagtttacaagcacagtgaggacgggtggtgcccaccaccntacagacgcatggtgggctaagagatactgccagtgacggtgtgtcacaattcagatgtttccgcagctcctgacaggcagacaccaccagcatcttacagctactaatcaactggccataatcaaatcacaaacagtctgagcatggataactggagatg

SEQ ID NO: 10968 - DNA, 485 bp, Homo sapiens
acacagagcttctaacattcttctcatttcctgagtgatagcggtgctaggagcattttttttgttctaatattttgtctttgaccccagttcctgacacagagttcctaagtcccttggaatttcctaggtgataagaacgtcttttgtcctaatctgaggtggctctctgtaagcccctgaacaatgtcagggtgggggctgattgccaggaagaccaaaccatgattagaagcttaggtctttcagccccactccccatgctccagagagacgagaggagctggagactgagttagtaatccgtcaagcccacgtgatgaagcagccataaaaatccctaaaagacaaaatgggagaacttctgggtcagtgaacgtgtcatgtgctggaaaggtggcacgaccgaagtccatggggacagaagctcccgtgctcamgccctctggagcttgccctacatgcaagatcttcatctggctgtt

SEQ ID NO: 10969 - DNA, 418 bp, Homo sapiens
attctgctctgtagagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggaagaacttataattcttcacaggtcacatagaagcatgagaatttgggttcaagcaagtaaattctaaatcagaatccatacataaagtgtttgcaatgtccagttatatctccatgatattttctttgtggaagttgattgttcttccttacaataaattgcttgaattgtctgtctaa

SEQ ID NO: 10970 - DNA, 397 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgacamccgcgcccggcctgagtgagtcttaatccgtggccatctgcgttcctgcaggcttcatctggc

SEQ ID NO: 10971 - DNA, 72 bp, Homo sapiens; identical to SEQ ID NO: 10311

SEQ ID NO: 10972 - DNA, 477 bp, Homo sapiens
agaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggaggctagagctaatggtctgcagtcctgtgtgattatcatacgcattcttcgagacctctgtcagcgagtt

SEQ ID NO: 10973 - DNA, 366 bp, Homo sapiens
atttcgtcaacggttaagttccggggcggggtaggctttccgcaagcgcaatggaaagcccagctaggtagacggaggagcgagtggcagatgaagccggaagtgctctataagatgatcattggtcggcgactggaagcggacacccgaagaacagtttccaaactctttacctgaaagcacaaaagacaagaaagtggaatctcactccgtcgcccaagctggagtgcgatgacgcgatatcggctcaccgcaacctcgcctcccgagttcaagcgattctcctgtctcagcttcccaattagctggtattacaggcgtccaccacccaccaccacgcccggctaattttttttttttttgaav

SEQ ID NO: 10974 - DNA, 497 bp, Homo sapiens
aagagttccttaatgaggagttgggagaggaaggatcctcattattccctcttcgctacctcctctctacaaccccattccaaagcgactgaccttcaacagaatgtatttctataaagataaaaacaacgaaactcccaagacgtctatatttggaatatacagggaaaactaggaatttaatagctgagttcacgtcctgccaacaaaacttagaaggaatcaacaaacttcaagttcaggcgcatatgtggtaccctgtggcctagcgagaagatcgcagatgacatgggaggccttcatcttctgcatctgtccgaccttttcagctcctcttctggtcactctgtcaagggggcctggaactcctgagaagtgaaaggaccagccctatctcagatggtgcgggtttcttcgccctgacctctgccatgtttgcttggagccccagagctcatccttcaaggcctttttaaaaatagcacagcctctgtcaa

SEQ ID NO: 10975 - DNA, 430 bp, Homo sapiens
atcatttttgacaatgctgtacaactgtggcccttcccatctgtctgctcaccaaagacatggagatctgggcttcccttagcacagagcaaatcagccaaagagcctgaggcctgggtagcctggggaagagaagcggtcttaaggggaagaatttcgatcaagtaatcctggagtattgagcctgggaaaattatttatacagactttctggcccatggacctcagtaaggcccagcagtgctgatgaaacatctactaggtacaagaccatacttttggctaccttctcctgccacagatactctatcccatttgctgtcatccaacgactaacaccgttttcacttcagaacgtcaagccttttctgttctcttcatggcctcctcccattaaagctgaaagtatctgctaaaaaaaaaaaaaatt

SEQ ID NO: 10976 - DNA, 520 bp, Homo sapiens
agaaatagcataaccttcccagcacgggtgccccagcctccagccagaccacaggccagctcctttctgagaccagaggccagcactgttctcaaaagagggaaggttttcagctggcagcgagctgagctgaggctggcacgcctctcctgggtcctgtcacgtgaagagggggaagtcctccaaggctcctgtggacagacagcaggggcactttcccagctaaagcacgagctctggcataggtctctgcatccaacttgaatagaccacatcagcttctccccaggtgatagttcccccaagcagaatgcacattgccagagtccctccgctaatttgtactcctctgttgtgataggaaatgcgagttccttggctggcattcctatttcccaccttttccctgatttcgtttgaagtggcgatatgcccagctatcacctttatttccagcctgtctcgcacctaggaattttccaaaaaatgtaatttacagtgatagagtgaaggtttcaat

SEQ ID NO: 10977 - DNA, 374 bp, Homo sapiens
tcaaacttttagattgaggcttttcttgaagcattgcttttgtccacataaagttgaagggaaaaaggaaggagagattatctaaatacacaaaattgaaagtgagagtgggggataagaaacttaaagaaacttaaaatattttgcttaactctgcaattacagatgctcctcaacttaggtctatgtctgggtaaccccatcttaagttgagttcagttgaagggtgtactgaatgtgtatggcttttgcaccgtaatcagagtgaacacattattcctggaaacctagttagagtttggcaaacacccggaaattcacctgtgaatttttgcttccacataggactcaaacaaacctttaaraaaaaaaaa

SEQ ID NO: 10978 - DNA, 478 bp, Homo sapiens
  misc_feature 448: n=a, g, c or t
ataactbcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgngtgttatattccaaggaaaattaaaagtat

SEQ ID NO: 10979 - DNA, 461 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasacmtgtgcctagcctgagccaccacgccggcctaatttttaattttttgtagagacagggt

SEQ ID NO: 10980 - DNA, 55 bp, Homo sapiens
  misc_feature 32,34: n=a, g, c or t
gtttctctcgcgccaccactggccgccggctnkntccaggtgtcgtaaccaccac

SEQ ID NO: 10981 - DNA, 456 bp, Homo sapiens
  misc_feature 189..190: n=a, g, c or t
gataatggatgggataatgtagctaaaactttgtttagttttatgagttgagaagggctgtcgccatcttatggcaataacggataggctaatgtagccaaaactttgtttcgttttatgatttcgattaggcatttcattgctacggtttaataattgaatatacaagaaatactataaaccatcacnnccccaacagcccccagccgcccagttcccccatctacttggcaaagattctctttttgaccaaactctaggcggcttcttctgagccctcttctggactaggtggccaccttggtctataaagacctgaacaaacccgaacatagttactaatagccccggtcttctcaagtgcctgcctgagaaaactcaattgatgccgccaaaggaatttactgtttgtttcagtcaacgtctgaagatagggccctcgtctcccaggctctg

SEQ ID NO: 10982 - DNA, 459 bp, Homo sapiens
aagtcagcaagaccacaaacccactgggaggaacaaacaactccagacacgccactttaagagctgtaacactcactgcgaagttctgtggcttcactcctgaagtcagcgagactacaaacccaccggaaggaacaaccagctccggatgcgcgccacctttaagagctataacactcaactgtgaaggtctgtggcttcactgttgaagtcagcaagaccacgaacccaccggaaggaagaaactctggacacatctgaacatctgaaggaacaaactctggacacaccatgtttaggaactgtaacactcactgcgagggtccatagcttcattcttaaagtcaccgagaccaagaacccaccgaaaggaaccaaattcggacccaatggtactatgttaattcttctaccagtcaacaattaagagcaactgtcttgcttgtagctcagcaacat

SEQ ID NO: 10983 - DNA, 209 bp, Homo sapiens
taaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagatccaggagctgcagg

SEQ ID NO: 10984 - DNA, 250 bp, Homo sapiens
  misc_feature 151: n=a, g, c or t
aacccactccggtccccttccacgctgtgaagctttgttctttcactcttcacagtacattttgctccctctttggatctgtactacctttatkagctgtwacactcactgtgaaggtatgcagcttcactcctgaagtcagaccacgarnccacccagggggggggacaaacaacttcagacatgccacctttaagagctgtaacactcactgtgaargtctgtgggttcattcctgaagtcagcaaga

SEQ ID NO: 10985 - DNA, 424 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagawaagagtaagggccaatactcaatgttcttaaagaaaagaattttcacctagaatttcatatccagccaa

SEQ ID NO: 10986 - DNA, 438 bp, Homo sapiens
actccttcctttatgtagggtgtaatcaaatacccagtgggaaacctctaaaggatatttaagccccagaaaattctgtaactagctctcttgagccacttgcacaatcccactcctagtctgtggagtgtacttttgtttcaataattctatgcttttattacttcattccttcattttttttgtgcattttgttcaattctttgttcaaaacaccaagaacctggacaactcgtagtcaagaacctccactggtaacattactatatgcttggccctgttctaaggactggagtgtgtatggttattcacagaagcagaaacaggctcagagacgtgaaaaaattttctcgcattttcagagctggaaagaagtggaacctggatttaaacacaggcaactctagagcctcaagttccactatgatccttattaga

SEQ ID NO: 10987 - DNA, 443 bp, Homo sapiens
aaaggaccctcagcccagggaggtggctttaatcttggttctccagtgtcaggaagagatccttcagtcatggggtaattaggaagtctcctaggataaggttattatattcaagtcctgccaaaaaatgtaagaaaagaagctcctatttgagtggaccaaaaagaacaattatacctcctaaaaataaaatgaacctaagctaagaaaatgaaaaggtttctaaagaaggtcagtacttcttttttggtctcctttcatcactgtgtgatttactttaatagtaccctgtcaaactagatgactcagtggcctcatcatagcttacagagcatttcatctgtggtcattcatcctgcctatgaagaaattgacatgtagtcactacagagaaacactgctcaccaatggttgttcaccaccataccctcctgatccttgcc

SEQ ID NO: 10988 - DNA, 397 bp, Homo sapiens
aaaatgaaattgactgtaattggtcagctatatttagaaatcttagttatatatcagactaagttgacgtgagaaatatttcttcaagagaagttttaggtagcagtaaaggttctaaagcatttaagaaaagtacaggagaaggagccatttacttgttcaatatgtgtctacagcagctgtttgaagtaaaagttttcaaggaaaaacaccattcttggtttataaatcaatcagttcaatcaggaggtcttctccattttgccacacctgtgatcctctatttctgcttctccactacctcataaaggctgataaggaggggaagtttcagccccttgatcaagttgtggtggataacgtgtttccaaattgcatcttgttgctgaaacttcct

SEQ ID NO: 10989 - DNA, 274 bp, Homo sapiens
  misc_feature 266: n=a, g, c or t
tgactagaccagggggtggtgcaggggagatggcttttgtgggaatttaccttggttgtttgcagttgggcctgtgttaaacgtgcagttttaccacattaaaaattttccagaaaggtagttgagagaagagcttttcaaactgttctcactccttataaacaacagaaggactcccctaccaataatctttaaaagcaaataacctctacaagctccttgttgtctttctttttatctatcaaaatgccaccattgtgcaaggnccccacag

SEQ ID NO: 10990 - DNA, 328 bp, Homo sapiens
ttccggcgggtcctggatgttgatgtcctgcatctaacgcggtgtamccccgaagccgagcgagctccggagaatttcagtatctgctacggtaacttcatcagcccgccaagatggcgatgcaagcggccaagagggcgaacggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagc

SEQ ID NO: 10991 - DNA, 442 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcg

SEQ ID NO: 10992 - DNA, 410 bp, Homo sapiens
  misc_feature 25: n=a, g, c or t
actattagctaggctgtttcgtttnaagaagaaaagatgtagatggaaagcggataattactttgaaatatggtaaaagcctgtgccttgaaaataaggttacacacaatctggctccttagaatcatggccaattccaggaggtatgacttttgaccagaactgatctcgactgataaggaaagtgttatagattcaagcagcagctggtggattctaagggctggattacagcctgtcatcagtgttgtagagaatatttgtactggagatacgattttagattagatgacctcctcattattgctgaatatgaaagcacagtgactgtgttttgaatgcttccagctgtgattatcaacctctgagccagctctccagtttyctgagtgcactgttaagaagaggtg

SEQ ID NO: 10993 - DNA, 322 bp, Homo sapiens
  misc_feature 154,164,285: n=a, g, c or t
aggtcaccaccaccaccatcaccaccaccttccacacctccctcctcctcacctgcaccaccaccaccaccctcaacaccatcttcatccggggtcggctgccgctgtacaccctgtacagcagcacacctcttcggcagctgcggcascgcancagcgstrrngtttgcmagccattgttaaaccctgggcaacaacagccatatttcccatcaccggcaccggggcaggctcctggaccagctgcagcagccccagctcaggtacaggctgccgcagctgctncagttaaggcgcaccatcatcagcactcgcatcatcc

SEQ ID NO: 10994 - DNA, 309 bp, Homo sapiens
atgggtaggagcatggtctctgagctggactaagtttcactcccagctctgtcatttcctggctgcttgacctgtaaaatggagatatacagacaacacttccttcataaggtgaagaaactaagaatcagaggagttctaactgagscatgaggactcgattcctgaaaaccttatttataaaaaacaggaatgggaactaaaacaaggcaacctgtgcaagcccttacaagtttttcatggtattacagtaaaaggtaaagcaacttaaaaaccacttgacattttttaacatttgtaaaattttgk

SEQ ID NO: 10995 - DNA, 412 bp, Homo sapiens
aagacaacattgtgagcttgacgacagcagagagcgagastttgttctggatttttcccagccctctgcagattacttagactttagaaatcgacttcaggccgaccacgtctgccttgagaactgtgtgctcaaggacaaggccattgcaggcactgtgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagcttgcccgagaagattcagtcttatgaaagaatggagtttgctgtgtactacgagtgcaatggacagacgtactgggacagcaacagaggcaagaactataggatcatc

SEQ ID NO: 10996 - DNA, 471 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacactgtgcctagcctgagccaccacgccggcctaatttttaaattttttgtagagacagggtctcattatgt

SEQ ID NO: 10997 - DNA, 246 bp, Homo sapiens
  misc_feature 41: n=a, g, c or t
taaaggtgtatgtttttaaatgtatcatcwrtgtgtgccvnvrttaatattcttattyaaaagttaaggccggacatggtggcttacaactgtagtcccaacagtttgtgaggccgakgcgggcggatcacttgaggtcaggagtttgagaccagcctggccggcatgatgaaaccttgtctctactarraataccaaraaaaatttagccaggcatkgtggsacatgcctkgtagtcccaagtag

SEQ ID NO: 10998 - DNA, 487 bp, Homo sapiens
  misc_feature 399,426: n=a, g, c or t
agaccagctccaataatgagcaatagtggctctcttaattttctgtgagccctttcctaggcaagcttcccttcattggaattcctgtcttcttaccaagaaacagagtctaagttctttctggactggcgggggtggagtggtgagggggagctgaaattacctctttcttgcacatagacctacatgctgagattctagcactcctcccactcgggtttttggaactgggtcacaaactggcataccctggtaagctcatgaagactctttccttaagccctccccttagcagaaagagatggactcatgcctgtctaactaaataggcaggactctggagcatgcaattaggaacaatctttkgggtactttcascccctggaggactatcccttnaggtccctacagttttggggggttgantttatattcagcatttcattttcttgcataaagatgttatagraaatgaaaaatgtcatgk

SEQ ID NO: 10999 - DNA, 167 bp, Homo sapiens
aacccaggagaaacaccaracggtgttgcttcactgttacacaggagtacgcaccaagctctttaggaaacagctggtctatttttctcattccaratctaaacctcaaagctaaatgccgcaaagtggaagctgdaaggccgtactcacgtccagagactccaggg

SEQ ID NO: 11000 - DNA, 341 bp, Homo sapiens
gatgagatcattggagtgggccctaaagcaacaaaactggtgtccttataggaagagggaaatgccatgtggacacaaacacgaggagaagacgactatgcgtgatggaggcagagactggagtgatgcatccacagccaaagaaggccaaagactgccagcaaaacaccagaagctagaagagtaaaggaaagcttctcactacatgttttagagggagcatggcctatgacaccttgactttggacttctagcctccagaactatagacaataaactgttgttttaggccaaaaaaaaaaaaaaaaaaaaaaaaaaaaaaaaaaaaaaaaaaaaaaaar

SEQ ID NO: 11001 - DNA, 73 bp, Homo sapiens
  misc_feature 14,72: n=a, g, c or t
aaccgctgcgagmnggcccttccctaagttctcccagggcgctgccagagccctgccggctaagggatgggna

SEQ ID NO: 11002 - DNA, 293 bp, Homo sapiens
attctggcggctgggcacagttgctcaagcctgtaatcccagcactttgggaggccgaggcgggcggatcacgaggtcaggagatccagaccatcctggttaacacggtgaaaccctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaa

SEQ ID NO: 11003 - DNA, 395 bp, Homo sapiens
  misc_feature 299,304: n=a, g, c or t
aagaaaatgttatgacccaaaaataaattctggaaatgctctggaaattcaaggactccctgatctgtattcatctcctaaggtgactgtgagaaatcgccacacactgggtgactgaaaacacaacacaaatgtgattttcagagttctggaggccagcagtccggtagcaaggtgacagtaagatccaattccgccccccccccactcacgtcacaggaaattaaacatttaagctgaaaaaatgttcaaaccaagcagggcagtgccatgcacagaagtgaggcccaacgggaaansgganctcatccaccctcctcatgccaacagcagctcaaagcttctcaatggcaaaacttctaccaggtcctgtaagccaagattcctcctaaaac

SEQ ID NO: 11004 - DNA, 544 bp, Homo sapiens
caaaaaatgtatttgaggaaacatcggtcaaaagtgaagatgaacccccagcactgccaccacacctggccagcagtttcttaaaaagttacacttaccttaaaacccagcaatccactcctaagtatatgtctaaaagaaatgaaaacaacaggctgggtgtggtggctcacacctgtaattccggcactttggggggctaaggtggtagctctccagaccacccagggcaacgtggtggagccccgtctccactaaaaatgcaaaaaaattaaccgggtgtggtggggcacgcctctggtcccagctgcttgggaggctgaggcaggagaatcgcttgagccccagaggcaggggtttcagtaagccgagatcgtgccactgcactctagcttgggctgcagagtgagactccgtctcacacacacacacacaaaagaaatgaaaacaacaatttgtacatgagccatccccatgataaaggttccattctgttatttgagcattgcttattaaaatgatggcactacccagagatggggaa

SEQ ID NO: 11005 - DNA, 223 bp, Homo sapiens
aaaatgtccctcccctttctctgaaggctcccatctaggagctgaacttctcagtgtgaaataagctcttccccattactgcacagcagggagtgtgaactccagtgaggctctggggttctccagggcagtactgggtgtgtgcccacaattcaaagaatgtgaaattacactagaagaaaaagaatctatacacacaaaaaaaaaaaaaaaaaaaaaaaaa

SEQ ID NO: 11006 - DNA, 552 bp, Homo sapiens
aagacagttggacagcccgctggggtgggggtcaggaggaatggctccccagactcctgaacagaggatggtgacccaatcagggaacacgtctcaacccaacattgaaaggacaaagttgcttctgcaggcttcctcttaattctatggatcatgcaatagtctttcaagaaattatcttctgcttagctagtcacttcctgttgctagaaccatgaagaggcctggtgaaagatgttcagtatactacctgcatcagctgctactgctatgtgacaagcaaattttccagaaacactgacatggaaacaggatctttcttctcctactgtttgttcctcgactacagttataatcctctatttgtgacatcataattagttgccactggagaagacgatcgtgtcacaaaaggattaggacctaaggtgagatgacaggagcgacgaccactttaaagttgctgctgctgctgttgctttgcatgattgatggtattttctcatccagctgccctaaagtggcagctgcttaaagaaagatggtgataca

SEQ ID NO: 11007 - DNA, 53 bp, Homo sapiens
attcatttcatgggtagagaactgaaacccagagaaaatagaaatgccaccam

SEQ ID NO: 11008 - DNA, 491 bp, Homo sapiens
gaaaggctctacagggtgtggagaaaccctgagggagcggctgggtggggtagcctttgggtgtggaccactgccaactaggataaaaggccttgggcactggtcggagtgaaactggaagtttgcctggtgacatttttttcaaggcggacgttctctctaacgcttgtcgcggcgctgtctctcgcgggtccaccctgcactgggcgggttctgtccattcgcagctttagatctgaabctcaaataagcacctgccttgagggactcgggaggttgtctttcttccccccggacagggcttggggtattaaacaagtgagatcgacccacggatttgggggttgtctcacgggcgttggcttttgtcgcccccactgaacagttttctcagtttgactacgtacggccgttagagaaattagcgagctgaagactgaacacgcttgggaggagagggatggggatcaaatgtatcagaaaggagctaa

SEQ ID NO: 11009 - DNA, 155 bp, Homo sapiens
acctgtaatcccagcactttgggaggctgaggcaggaggatgaattgaggacagaagttctagaccagactaggcaacatagtgagaccctgtttctactaaataaataaataaataagcaaaaaaaaaaaaaaaaaaaaaaaaaaaaaaaaaaa

SEQ ID NO: 11010 - DNA, 452 bp, Homo sapiens
  misc_feature 19: n=a, g, c or t
cactcccccattggcttynacccctcccccttcttcctccgcctctcccaccattggttccctcccctactccattccttctcaccttttcccttttacccattggcgtgagtatttttcctcagcttccctctttctccgtattctgctcctcctcagtcccatcctccacgctttggaagctactgccttactgcccggagcgccgtcgtccccgaacctcccctgcttctccctttccttctgttccggtttctggtcgtaactcaagagcaaaccaccgtactgcaaaggaaccagatattgtgctcgcggttccaaaccgggcatgggcacgaatgcttctcgataaatccccttatggtctctgagcattaaagaaagcaagggaggaaaacatgcgcccaagctcgttcgcagggaacatgttcgcgtgtctgcgcctgtgtgcg

SEQ ID NO: 11011 - DNA, 469 bp, Homo sapiens
tcattgcaatgcaaaacagactaatacagtttcttttcagtaagaattacaaaatttaggccaatgaccaagctgagtataaattactaatcatacacaaaaatgtgtttcactggcttgagtcatttttctgtttaacactgaatttacacttagattcttgtactgtcactgagtccccttgtaaacagctaggtatattttgtgaatggaaactagccaaaaatacagccaaagtctcaacgccaaactggtctacatcagtatggactccagaaatgcatctttcaaccacttgattgcattaagtagtcatttgagtgcatcacctagtggcctttggtcctgaaagttagcaatcatccccaaaaaggtctgtgttaataactgatagacaatcttcattaagcaactgctgtttttttttttaatacttcaagttctgcaatacattgtgcagaacatgcag

SEQ ID NO: 11012 - DNA, 498 bp, Homo sapiens
aagacacgtctctttcctcttcgccctccgccatgattagacggggtttcaccgtgttagccaggatggtctccatctcttgacgtcgtgatccacccgcctgggcctcccaaagtgctgggattacaggcgtgasacccgcacccggccgatattacaaaatctttcctgaggctggaagtccagaagtcggggtgctggcaggacgtgctcttctgaagcctccagggcagggccagccgcatgcccgtctcctcgcttgggcacctgccagcggtccccggcggtccccggctcattgctgcatggctccaacgtccgcctctcccaccatgtgcctcctcctggtgtctctgtgtccaaatctcccgctctgtctaaggacaacagtcactggtcatgggacccatcctaatccagggtgacctcgtattaacttcatcacatctgcaaagactatttccaagtcaagcacactcccagctgctgggggcggga

SEQ ID NO: 11013 - DNA, 376 bp, Homo sapiens
aattggatcatagcgacgtccgttggmagggtaatcagaggaactacgtttaggaaaggggccgagttcctgttgaaagtgcgtggcctgtctttgcctgtccttgggctttctccttagataggtccttgatctaggtgacagccataggggcggtggttagggaagtggtagtgcggtgaagcaccactgaaggtgagcgtggcgaagtcaggagccctctttagagccaaaataaggtttttctctcgaagtagtgagattgcaagctcccaggcgattgcacagattagcaacctagacaggatctttatcatttaaacctattaaaatgaaataaactaatgtaaccagtactttaaaaaaaaaaaaaaaa

SEQ ID NO: 11014 - DNA, 460 bp, Homo sapiens
agtcttttagatggcccgaggagcatctcgagtgtccgcgatttgggaaagagcttttaactgggctgttaaagggctgccttcttttctccaaatgcgatctggattcctgcctcggggaacagttgtgctacagagagatattttaacgccctgatattatatttcagtgtcaattttacgaattaaaaagaacaatcaaaacactagggggaaaaaaccgacaagaataacctagcaattgcataacctgagaattacttcttttcttgaacatgttcctttgagcttcttgcggaagaaattctcttaggatgagtcgtccccgacagaagatacatatttggttttctgtgtgcttcactttttggtttttcatcttggactgcacactgaatttttaaaaaacgttcatccatcaaacatttgagcacctatagggtgacggctgcctctgggc

SEQ ID NO: 11015 - DNA, 468 bp, Homo sapiens
ataataggctccatcgctggtgccatcctggtagcagctattgtccttgggggcacaggctggggatttaagtaagcaacgccgcatgtctacttctcagtggctctggcatttctcttttctgcttacataaccaagttttgagttcctgctacaagagcttaggttctgtcagtcaaactgcaaaaaataagtctttttattcagaaatgggttagaaatgaagaaacacggaccctcaactgtcattttcagaaatgtcaagaagagaaggttcgatcctactcagcaaggccccatctgaatcagctgcgctgggatggacaccgccttgcactgttggattctgggtacatattctcagctcctaaggacctccttcctaaagaagaaagagttgattgaagatttgataagcatgcatgtgcgtaggagtgggtctagtgtcattggaaaagtgaacctgga

SEQ ID NO: 11016 - DNA, 419 bp, Homo sapiens
agcccgctggaggtgccggggggaaatgctggcgtctgctcctccgtctcccagaatcctgccctggaaaaaaccagcgccaaccgccggtttaactgaggacggatttaaggcattacgaaagacagctttcccctttgctcggctctccttctctctcctgctgccctgtgaagaggtgtcttctgccataattatttctcccccttggtaagagaatgtactgccaatcaacatggctgcttgtcagttctacttcttgaacaattttttaaatgttaaaagaacgaaagatttcacccattacttttggaagaatactgaagaccatttgaaaggatttaaaatgtcttttggaatcttctcgttctgagagctgctctttgctgaaaactcaaaggtaaatgagaaaaaataga

SEQ ID NO: 11017 - DNA, 403 bp, Homo sapiens
tttccaactttaataatttgtgcttatcctgtaggtaatgggactcttactgtaagtggcacgatgaaagtgttacaggaaggttactctgtggactcagatgtatgactgataggttgaggaaattattagcctgcattaggatttttttttagaaagtagctgaaaatagcaatttctagtctagacagggcagggatagagatgaagatcttggcttggaagttaagattatgggaatttttaacatccatatatagatatgtctatggactgtttgtgttacttatgacaattactggcatggcttcagatttagataatctctatttctcttttatgtaaaattgtaattcttagcccaaagtgactgaatttttgcttttgagaacaccattactat

SEQ ID NO: 11018 - DNA, 365 bp, Homo sapiens
gttgttactctgctgcaagatcctttttgcctgacaaacctcccctctggttcagatgtaggcagaattgatgggtaccatgtgggactattgagagacctaaggacaggaatcaggacttaaattctctaagtgttcagccaaccaatcttcattcattcatcattcattcagtcaacatacattttttttgagctgcctctcttatgtcaagcactttgatgccctgggcctttgaagatgaataaaaagttggcacggagtaggggcccagtgatggactgaagaaggaatgagtgggcacacctgctgcactgaggtgctttttgtccaggagattagctccgtttgacaaggcagtgaac

SEQ ID NO: 11019 - DNA, 458 bp, Homo sapiens
aaaactcaagccgcacgaggcttctcagaggttcctctcaccacaaagccccatcacagtacagaaggctttttgcaaaacagtgatttctcagcttttccgaagaggttcctaaatgtggctgtaaccctgacgtgagagtcgctcccgcccctacctacatcccacacatttcaggagtcccctacgtattctacaaaacacagaacgaccatatgagccacttcagtccttctcagcattaggtctaatttccggagagccctaactgtcctgtcctgcctacattgcctgccctctaacatcctgggaatgggaagtaacactgggatcggtggcggcagaactgcggaccctaacaacttcagattgttgaaagggggaggggagaatggaagagaggaatggaaaggcaaaagaaaaaacatttgtgttcatttacacatttcctgtgcaga

SEQ ID NO: 11020 - DNA, 96 bp, Homo sapiens
attttgtctccccatgttgggagacgatatcccagccgcggtggtgctgccgctttcgtgtgactttgggtttcccgagcgagcccgcagctgcac

SEQ ID NO: 11021 - DNA, 499 bp, Homo sapiens
aaaagctctggccaaggccttattcttgctatttgctgatttatttgttcaatgctggtctcccacactagaccatgagcaggaaggagaggcagcatgcaactgtgctcgttgtctacacagggcctagcactgggcctgggccagggcaggcacctgggaggacctgtctccaaaggcaggaggacatttaaaaatgcatgggtctctgctaggtgacacatcctgcttaggagtctgctggcctccagtctgggacaacagagcacttcaaataggcacctgtgttcatcgcggtgctttctgtccacacagggctttggtttctgaggctgagagaggataagctaagcaaggggcagaacaggacaccaaccatctccagaccccagtacaacacagatggcaggccaaagagggactgtgtcgtctgattcaagagtacagactacacagccagaataatcggggcctggcttggactctctttaaatattca

SEQ ID NO: 11022 - DNA, 80 bp, Homo sapiens; identical to SEQ ID NO: 10797

SEQ ID NO: 11023 - DNA, 452 bp, Homo sapiens
actttgtggcctggcctctctggatgggggtcaagagcccatcacatctttctccaggggtgtgtgtgtgtgtgtatgtgtgtttgggggggcgggttcatgaaatttagcattgcctcacaatgtcagctttcagctcctcaaaaaactacatgaacgagttggccatacctgcgtacttccccctggacttagcttgattcacttcaaaggacaaatccatctctgagcaattctcaaggcaaagacactcagccagacgaaaaggagggtgagccctcctacctctttcggctgacactcaggggagcttgccatcatctgactggctgccaacaggccggtggacaggggctggggttagacatgtgggaaggaaacagtcaccttgttttcctgccttggatggaattggcagaattccagttattcsctaccggggctctagctca

SEQ ID NO: 11024 - DNA, 418 bp, Homo sapiens
gaatttgcctttctgcctgaggcaggatgtcccatgaccactttagcctcttgttggaaaacaatgaagaaaatagctaccattaatggagctcctgctctgtgccagggactgtgccatgtacttcactctgagaagcaagggccctgcttatccccatttgaaatgggagaaagcctctgattaaaccgcttgcccaagtctcctggcagtaagtggtggagcaggatttcgtcccaacctcatgctgtttccacatccccacagtggccccgggctgtgctccttccctggacctgagcttcactattggaccagatgagcctctcggatccatcccagcctggcacgtctagatcctgcctcccaacgcaggctgctgagatgttcacttgaatctctcaccatggacattacc

SEQ ID NO: 11025 - DNA, 497 bp, Homo sapiens
tttattcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttctttattctatcagatattcattgtcatgcagtagtagtaaaaacatcaaagatgcagcaagcttattaagtattattttctaaaagaaataggaggcatttycayctttattattgtacttttggttatgcaaacactttgataatataaacagttatgtcccctataaatctggtcagcaacctcttttgatttt

SEQ ID NO: 11026 - DNA, 470 bp, Homo sapiens
atttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggatacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaaatgcgtttagatcttggatgcagacctttcaaagggttaaatgtaa

SEQ ID NO: 11027 - DNA, 482 bp, Homo sapiens
aaccttcagcccccagggcctctgaattggagctcagcttgtccccgcccagcttctacctaacttgatggactcagcgggtggagcttatagatacaggctcctccccaggacaaaagccccagctggtctgaaaacagtctttaactgagagccacatcccagcaaatggccttcatggatttgaaaatgggatcagagttcttgcagagtctccagtgctaccgcgagagggcagtcggatgggtctggtcccggaaaagaacacaagaggaacccaatctgaccttgcacgcttcttttaaattgaaatggtaaaatatatcttctacccctgcacctctcagtcggctaaaatgaagggaaaataacctaacttcattagtttagaagcccaagccagcaactctgaaaattgctattcccttgtaagattatcttttctggactttcataagggggtcttcacagagggtggacta

SEQ ID NO: 11028 - DNA, 498 bp, Homo sapiens
agatttctatgccaaccagaagatggatggatgtcaagacagatggtggaaaagttgtgagatgcaaagcctcatggtacagcagtcaccttgcaatcatgaagataaaagccacaaagaatggtagctcagaaggtggaaggactctgcatagttgaagacactatgattagatgtatcagccctggacttaagtacctctgcttttcttaataggagaaaaataaccctcttccttccttatgccaatcttctcgagttccttgctacttgcagctgagtccactcttgactgatatcacctaatctcagtcgctatcagattaaacaacagcattactttcagagggccaccaagaaaaaattgcctgggagaagagtaaggagcctgaagatctgactaactttctctgtagccctttaccgaatagcagattagctgagctcatatgatcgtatcaactagtcatcaccttgattagaacacagaagaagtaa

SEQ ID NO: 11029 - DNA, 479 bp, Homo sapiens
ctgtttgcctgtgaccctcacaccttgttcttcagggttttaatgattttctgttaacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagg

SEQ ID NO: 11030 - DNA, 357 bp, Homo sapiens
  misc_feature 118: n=a, g, c or t
taaaggtgtatgtttttaaatgtatcatctgtgtgtgcccccattaatattcttatttaaaagttaaggccggacatggtggcttacaactgtagtcccaacagtttgtgaggccgangcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatc

SEQ ID NO: 11031 - DNA, 470 bp, Homo sapiens
acttccctttggagtattagaagatctttatggtgacaaagaggcactctttgaccagaactttatcaggctcctccgcgtccttttagactaggtctgaccttgtgtttccctctctttccttgtggaatccagcttgagcaagaatcttgctgagtccttaatcaatagagtcccacccttgggatctgaccaccctctgtgtctcgtcaccctggcttgacctcagcacaagtctcattgagtgggtctaacaacattccccttgtccctgtgattcctcttagtaattttccatcaccgcccactgcctacttctaggctgcaaatcccctcacccatgctgtgctcagagttgagcccagcctctctccccacagcaagccctcgttgcagtggtccctacactgatcaccatgcaccccctgaataaagtctgccataccattttttaaaaaaaaaaaaaaaaa

SEQ ID NO: 11032 - DNA, 416 bp, Homo sapiens
  misc_feature 59: n=a, g, c or t
acacaatttgacccataatgaaggacaatgatgccactgggtcatagactgacttcttntgtgaagacgataaacgcacaccttccactgcagcccagaagggtcaatagaggaagcaatagcaggaactccttttcatacatcaaaactgagcttatcacctctaccctgaagtcatcctggacatcactggtcccagttaatcactcacttatctttgccatccttgacctgggaagagaacgttgccctcattggtctggaatcagcaggtacctcatggctggaggtgtattttcagatggagtctcamtctgtcactcaggctggagtgcagtggtgcgatctcagcttactgcaacctccgcctcccgggttcaagtgattctcctgcctcagcttccccagtagcaggg

SEQ ID NO: 11033 - DNA, 414 bp, Homo sapiens
  misc_feature 168: n=a, g, c or t
tactcctcaccgcgcgcgsgsggaaccagtagccgcggctgcttcggttgccgcggtccggtggtcgttatggattctccatgggacgagttggctctggccttctcccgcacgtccatgtttcccttttttgacatcgcgcactatctagtgtcagtgatggcggtnaamgtcagccgggagcagctgcattggcatggaagaatcctatttcaagctggtttactgctatgctccactgttttggtggaggaattttatcctgtctactgcttgcagagcctccattgaagttttcttgcaaaccacactaacatattactggcatcttcaatctggtatattacatttttttgcccgcatgacctagtttcccagggctattcatatctacctgtttcaactactggcttc

SEQ ID NO: 11034 - DNA, 484 bp, Homo sapiens
  misc_feature 480: n=a, g, c or t
aacagatatggtcgttctagagtggttcttcatcttgggttgctattaatgggcatctctgcaggccctctgatcaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggwtngcac

SEQ ID NO: 11035 - DNA, 489 bp, Homo sapiens
aattttgagctgaaataattcctgagtagcattaaatttcctacctccttgcagggaaaggccacaatattcttaaattttaacttgtgggcgaaaaattgcaaagctaaaatgggttttgaggaaacaaaaaatcaagaaacaatgaaacagaaaaaatattaggtggagctacagatctacaagtattgaaatcaaaggacagaagaagagtggcttatggatgatacaatagagaaaaggaaacaaaatacagaggcaacaggactatttttgctgtaacctggggatcttgcccatttcaaacgagccaaactaaagttagatgtgtttatgccctgggaaaagtgaaaggtgactcacggccaatatggaaggaggatggtggttttatgcccagtttccccatcgtctgtagagacggggtttcaccgtgttagccaggatggcctccatctcctgacctcgtgatccacccgactcggcctc

SEQ ID NO: 11036 - DNA, 501 bp, Homo sapiens
aatgcagctagtgatgctggaagtgctcccaaggagagaaatgtcacaacattacaagaaaaagttgaatggcttgatatgtaccatagattgaggtctgcagctttggttgcttgccatttcaagagaaatgaatccaggataaagaccatttttttgttttgtttttgttttgtttttaaaagaaatctgtgaagctgttgctacagctacaccagcaggtgcaaaaatcttgcactttttgtgaaatacctttttatctcacattgaaaatgcagcttttatattagtgcaggattgctattagaaaggcacacgtatagactctaatatgatttgagtaaaagcaaagtcattatatgatgacttaaagcaaaagaaaggtgaaggatctaaagctggagaatttaacccaatccaaggatggtttgatagttttagagtttggcttaaaaaatgtcaggataacagcagcttctgccaaccaagaggcaacagatg

SEQ ID NO: 11037 - DNA, 76 bp, Homo sapiens
atttttttccaaagccatggtgaamatctctgtgctaatttcttttgttttgtttcctaatttttttttttttkgg

SEQ ID NO: 11038 - DNA, 469 bp, Homo sapiens
  misc_feature 425,464: n=a, g, c or t
cagctgcagaatatgcattcttcacctcagcacgtgaamactcttcagaaaagaccatatgttaggccacaaaacaagtctcaaaaaaatttttaaatagtaattatatccagtattttctcacaccacaatggaataaaactagaaatcaataacaaggaactttggaaactgtacaaatacatggaaattaaacaacactctcctgaaagactgttgggtcaatgaagaaattaaggcagaaataaaaaaaattattgaaacaaaaacagcaacataacatactagaacctgtgagatacagcaatagcattgctaagagagctatttatagcaataaatgcttacatcagaaaagtagaaagagctcaaataaacagtttaatgatgcatctcaaggaactagaaaagccagawcaaaccangccccaaatttagtcgaagaawaagcaataaagatcagngcaga

SEQ ID NO: 11039 - DNA, 487 bp, Homo sapiens
  misc_feature 221: n=a, g, c or t
tctgtggaaaggcgaggtctggaaagcagcccctcccctgggagagagcscagggcaggcatgctgtcctgtttcccccactcsscaacagggctggcstccggctctgtcataccctatctactcctgccttcttccagctggcattccctggcagcgatggcggggaaactggcagacatgagcaggtgccatctgtatccaccacatactcctgctgntgtggtgtggcgaagacaaggctgcccagccccaacaccacgaggcaccctcgggcatgctgttgcttctgggaccagtgaccagcctgstgsscctgctggaccttaggaggccaaggcaggtgaattgcttgagtccaggagtttgagaccagcctgagcaacatggtgaaactccgtctctacaaaaaacaaaaaaaatccagcgtggaggcatgcacctgtggtttcagctactcaagaagtgaggcaggaggattgcttka

SEQ ID NO: 11040 - DNA, 475 bp, Homo sapiens
aaataactttttcttttttaaaacagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtatgtatttttattcatcatgtaaaaaagagttgtttcctttaaaattggttttggcatttcaaacttattaaccatgtaaaactattttaggtaaacttttggttcttgttagtaatttagtcattattcctatgttctggaaattttttctgcagtttgttgttcgggttaaataatattttaaatatatcawactgataacattggtaacctttggggggtcacttattggctagtggatggagtgggttccttttgattcttaaactgaatacattttataaaacattcaattgaaata

SEQ ID NO: 11041 - DNA, 482 bp, Homo sapiens
ttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccggggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcg

SEQ ID NO: 11042 - DNA, 498 bp, Homo sapiens
tatatgtgtacatttcatatatgtatgtcttaatgttttttccatgagtaaaagggagacatggaaggctgctcaccaaaccataaacagaacttaacctttttgaaagggggcctgggaatgtgaggaagatgaagagagatttcatggtttattctgaatattcatgtattctttgaatcttttatagttgagaatacgttgtattactagtgtagaaaaaaatttaaagatgtttcataataaaagagaaaaaccactgtactaaatgatctctaagctcaaaatttgaggaacactggcagttactgtgatgtagttgtctatgttaaaatatttctaattcatatactaagtgatttttatttaaattcttttgaaatattttttaggtgtggaatatcaaacaaatgattaagttgacacaggaacatatagaggccctattggacaaatttggtggggagcataatccaccatcaatatatctggaggtaa

SEQ ID NO: 11043 - DNA, 424 bp, Homo sapiens
aggattttcttcacatacatggcagcagtagtatgaagataaatctagtgtttattgctgcccctttggttaactagcagaaagctccaagttagagtctacaacagaatcacttccttcatgatgcctgtagcatactataaatgctctaaatactcaggaatgggatatcatgtaacttagtggttaaaacatgaatgttagaggcaggtggacctgacttatcagctgtacaactggcaacttatcaaacatctcttcagttttgttacctggggattatcataatttactactaagattgctttgaacattaaatgagctattcaggccatttgattaaaagggcacctggcatacagaaaagtgttcaataaaagatagtagctattaaaaaaaaaaaaaaaaaaaaaraaaaaaaaaa

SEQ ID NO: 11044 - DNA, 481 bp, Homo sapiens
aatgaccctggtatctaggtgaaatcacaaccctgtttttatatataagaagtccttgcttaaagtcaatagcatcttggaaactgcaaccttaaggaaatgatatacagcaggtcctcaagtaaaattgttttgttcaaagtccattagttatattgttgataaggaaaaacacacggtttcattataaatcatttcacttaaatcacagtttccaaaaacatattgagggtgttaattgaggacttactgtatttcaaatttaagttaattttcacagttcgtgtggaaattatttacatattacatctgtaaaatcactttaagcaggctatgtgtgacgaacttgttcacgagccctcaaccttggcttttattgacctcacctggggagcttacaaatgatgatggatgggctctcttacccagagattttgatttacttgaacctgtgtgggtctgagaggttttaaaagcacca

SEQ ID NO: 11045 - DNA, 306 bp, Homo sapiens
agttcttaagatctccacagcccctccaggasacatggttatttagtctcatgcttcactattaatggaacgctgtgctggttcctttgtgaggcatgctcttccttctgggtgttccatctgtacctccaggcttacagccacacatgagcccttggtctctgcttaacaaaccacgctctaagaaaaggtaggagacctactcacaggaagctatgacagagtaatagcggcttaaaatatgtcctctctttggagtgtgtgcctataaaacaaaatcgaaattttgaggcaaaattctaaact

SEQ ID NO: 11046 - DNA, 443 bp, Homo sapiens
atgatggccataatgcccacgctggaaggttgtgggtttaggggaaggagggcaaggaacagctggcccacccagggtggaaaaccgcttaaaggcattcttaaaccaccaacaacagcatgagcgatctgtgccttaaggacatgctcccgctgcagataactagcccaacccatccctttattttggcccatcccttcatttcccataagggatacttttagttaatctaatatctatagaaacagtgttaatgactggcttgctgttaataaatacagtgcatgcctattgggaagaggaaaagaaaaagaaaaatgaagacaatgaagaacaaaacaaatagatttaacagagatggaagacgatagtgtgtcataaactgagaaatttaactttttcctttacatctgaggttataaaagagaaagaaaatggaagag

SEQ ID NO: 11047 - DNA, 491 bp, Homo sapiens
taagaaaaatttattaaaatctacataaataataaataattttctatatgtatgttatatttcccaatgctatgaaatgaattgtgtctccccaaaatgtatgtgttgaagtcctagcccccagcacctcagaatgtgaccgcatttggagatggaaccctttttttttatttttgagacacagttgcccagactagagtgtagtggcgtgatctcggctcactgacctctgcctcctggctcaaacaattctcatgcctcagcctcctgaggagctgggattacaggtgtgtgccaccgcatatggctaatttttgtatttttagtagaaatagtagacgccatgcataaataccaattctctccaaattgatctatttctcaatctacacatattctactggtgatctcatccaaggttgtggctgcaagtacaccactacaagccaaaaaattatgtgtatatctccatctcaggcttgtcttccaaa

SEQ ID NO: 11048 - DNA, 252 bp, Homo sapiens
  misc_feature 148: n=a, g, c or t
aaactctggttgttttcttagaatggattcctgggagtcgaatcactaggtgaaagggaatgaatatttttcagctgtcaatatgggcttgcagactgccttccaggaaggttattattcacttccacttccacctgcagtgaagcgngtgcgctgcacatcagcagtgtggcttttggaatgaccccaagtttatcagaaggctcctgtggctccagggtcaactctgggcatatctgactacatcactcc

SEQ ID NO: 11049 - DNA, 414 bp, Homo sapiens
aaaatagtggagatggggtgggcagatgtggaggggtgaaagagcagttgtgaamtgagccatcaactgtgcctagagatcgctgaagtgaaggaccggagacactaaagctaagagttaacgtttattgagcatctacagtataccaagccctcttctagaaacaaatgaacacaaagttcttggcacagtgcctggcacagtcaggctccatcaagtttcatttcctttctccctgctattaaatgagaaagagggcatgaggaggtgggagtaaaggagccagaaagggaaggtaggagactggcaagaagaagctctggctgctctgggatgcaacatgcaggttcccgcaaccctcctggagtaggaggagaagctgcccctcactgaccactcaggaaggagagaagc

SEQ ID NO: 11050 - DNA, 416 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctga

SEQ ID NO: 11051 - DNA, 89 bp, Homo sapiens
aactctgttttagagaagatctcaatgttttagtaaagtacaaacaccatcaaaaaaaaaaaaaaaaaaaaaaaaaaaaaaaaaaaaaa

SEQ ID NO: 11052 - DNA, 436 bp, Homo sapiens
caaatagaattatagggagttaacagaagaaaaatacatattcattgaactctttctgtgcatggggcactgtactatgttgagtgctttaaatgtacttttttaaattctgaaagtaaccatcttactaacaataccttgtagtgaaacttaatgcattaaagaaagtgccaacttcattttcagctcctttaccagactgccatacttgggaggtagaagatggtccattcatccggaacctcttagaatgtgaggtcaactcagagttaggaggaacctttactttctggatatagagaatgaaagctattaattactctaacaatccaaggtgcctcttacttatatagagaaattttatacaaatattctgattttcaagattacctgttaaattcttgtgattatagtttttcatttgcttcatatgtca

SEQ ID NO: 11053 - DNA, 466 bp, Homo sapiens
gactcaacccctcttaatgattcctgtgtctccggcttttagaactgaagcagttataagaacatagacatattccactcagtcggagtgttcataaaggtgtttattttgtttgtttatttatgtatttatttatttatgtaatccctgcaggataattctaagttggtttactgacaactatacgcgatattaagcaccatactatatctcagcaacatgcatatgtttgaatggagttcatgaaaggcactctgtstatatgcaaatggaacatatttttctctcttaatatttgattctttctgttgtggcagacagaccctaaggttttcaatctcttggtgttaaagcctttgtgtaatccccttctttagaatgtgaactagatttgtgacttgcttctaactaacagaatatgacacacataaagcaatgtcacatctgtgattacattacactgtgt

SEQ ID NO: 11054 - DNA, 483 bp, Homo sapiens
  misc_feature 340: n=a, g, c or t
tagttttcattagttctagtcactgggcttagcgttttccatattttaccctcatagcaacctatgaaacctgtgtaggaattgacatttgatgacaaggtctgttcaaatccagcacccatgtgttacttaccactctttataattttttaaaagagatttctccttctgaataccactatttttttttgaatggcagaataagaaaaattaaaatctgaaaagctcttagaaaatactgctacaatatctggaacctagtaatgctgcttcatgtagcctctccagactcttgcctgtggsttcccaaagactggcataaacaagaggaaaagaaaantggacaaaatggggattactagtggtaatcttaactacttggtttgagcagagccctctaggatgtgtgggaggagcaggaaaggccagaggctgggaaggctgggccatgcacagttctgctagagaagaaagctgtacatt

SEQ ID NO: 11055 - DNA, 442 bp, Homo sapiens
  misc_feature 361: n=a, g, c or t
aaaaaaagatgaaaactaaaaaaataataaaacaaagccctaatggattgagataaaaaagatatctatagattggaagtcaggtgaaattgaaaaacaattatggtatgagtaatagaggaaccttaatagaccagtcttccaaaataactgaagaatgtgctggaatgcaacatcctgagatatggaggaactcactggagcagcctcattctgttcctttccttcctagaaacagaatgttcttcttcatggcctactatgccatgagatccccaagaaagaaggacctatttatttgacttgacttccaaacccttggtcccaggaaawtaaatggggccacatgatggagcaccgnttaccacgttcaagctgcagggcctaggttcattcagctaccctgatagagactcggattcctccttggtagagtggggat

SEQ ID NO: 11056 - DNA, 347 bp, Homo sapiens
acagatgtgtaagggtgggcgcggacrrgacccccgaagtccctgaggtcaggctgaggcattggaccaaatccgtacataggcatttctctgaactgcgcgccaccttttgagtgccatctgtttccgtccaggactctgatacaactatccagtccgctgcagggaccggtcactgtgtcacagtaagtggtgggatttaagaggcagttttcctcctcatgttctaccattatgaacgtctagcttgaaaaatacataccattttcataactacgtattattttgttagtgctagcatagtagatctttttcmgttattttactctgtgggggggggggggttt

SEQ ID NO: 11057 - DNA, 492 bp, Homo sapiens
tttagatgtctagggctgccataataaagtaccacaggctagatcgcttaaacaagaaacatattttctcaaaattcaggaggctagaagtgtgtaatcaagtgtaatcaaggatcaaggccatcaagctgcaaatggacttacaaatggaacctcaaatgagctcaactcacggcttctactgagaacccctggatccacctgctggtccctcactagcctaaaaagttcccctctggaggacaccacaactgcagggccccttcttcacccctaaccatcaggaagtagccagaacgactgctgccagttcccaacagcaattggtgtgtcctgtctagaggggggactgaggaggttccagctgggcttcctgggtcgagtaggggctcagaaagctgtgaamtcactcatttcctgtatcaggacttactctcatactggatgaataatattgaagatatatgcttaawatattcctaacatcagaat

SEQ ID NO: 11058 - DNA, 432 bp, Homo sapiens
cattattaccctcactatcatgaagcgccacgcagacaccacgacaaagtgagatgaactaagacctcttcttgattctaagcagggaacgcacagctcaccctgtcacatgcagcgatcataagctgagaattaccctcttccttcccacagcgtctaatctttttttatgtttttgtggcaaggtctcgcttagtcgcccaggctggagcgcagtgcgatcatggcccactgcggcctcgacctcctgggctccagcgtgcgtctaatctagaaccaaatcctccttccttagatcatcccccaaatcacccaactacaggtgaaatcctgtaatagtttcctccgaacaccctgttgctgagwsacctcaacgtctcaacctggtgtgtttgtacgtagagtaaaagacccaacttgtttaaaaaaaaa

SEQ ID NO: 11059 - DNA, 306 bp, Homo sapiens
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaaaaaaaaaaagkaa

SEQ ID NO: 11060 - DNA, 478 bp, Homo sapiens
ccaccatgctttgaccaaagtacattcacagtaactagagaaagcagatcatccatttctggataggtgaactacggcaaggtaagaacagaaaaaagtaaagtagtattgagtcatgcaggtatcagattaacagacattcattgaagataagtgaaataactttggagatagcagagaagagcaagaagatgttggacgttggcagtaagccgcagcaaggcagttaggaaagtacgtgagcctgatgacgcgaaggtgatgcctccatctgtccgcttagtggttattaaattgctgggaaagacctgcctttattttcctatcatcttttccccattactttgcattattcaggaaataattatttattcccaaatgcagttttctaagcagtgaccacaaaaatttcttattctaagggraaataattaagaaaataaccctatctgtggcattgttttaaaatgtgggatac

SEQ ID NO: 11061 - DNA, 436 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgavactgtgcctagcctgagccaccacgccggcctaatt

SEQ ID NO: 11062 - DNA, 500 bp, Homo sapiens
aaaataggtgcctgataactcagttaacttccctcttggcttttccctttgaccttaacacttttggggttatctctgaggcgaatgctaaaggagacgctccaggactcgacctctgaaggtccttggagccaattccgtaatatgatcatggaaactgatcattgcctgatccttctaccgccttggscgctttcttgaggaatgtctttggttaatggcttcacggccatggaggtgacatcatgtggacaacaggctaggatgccagagttagctgctcggtggagatcatttgagctccgactcagattttgaacggatgtttgcatgtataccacagtgctacattaaaaaccagtcatgtggatgtggagaagggtgctgatcaggactccctgtttgctaacaaattctacagcagaaacaaagtattaaggtttgcagccaggaagcaagtgcatggggaataagcctgcagcttcttccaaatgagacag

SEQ ID NO: 11063 - DNA, 85 bp, Homo sapiens
attctagagctgaacctggtacgctcgcccaccaaactgccgtgctcggggcttagtatctcacgcgcggcagttcaagaacatc

SEQ ID NO: 11064 - DNA, 337 bp, Homo sapiens
agcaacccggtgggtcctcttatgtggtgtgaaggcttagttcctttgctcttcggaataaatcttgctgttgctctgtaatctcagtactttgggaggccgagacaggcagatcatgaggtcgggagatggagaccatggtggctaacaaggtgaaactctgtctctactaaaaatacaaaaaagaattagccgggtgtggtggtgggcacctgtagtcccagctactcagaaggctgaggcaggagagtggcgtgaacccaggaggcggasttgcagtgagcccagattcctccactgcactccagcctggaccacagagcgagactccgtctca

SEQ ID NO: 11065 - DNA, 468 bp, Homo sapiens
acacagcagagaagactaataaagtgttcacatcagattcttccaacacacttcttcaggtcctctgggactcacctggctccgaatccagttatctttgaggtgaccagtcttgcttgggctccagtcaccttcatgcaggtggaatctggtccgactttgcttctgtcttatattgtacctgtctcctcccacctgccttgcacccacgcatgtctattttgcagataagttaacttgctatggtgcaaatctttgaccagagggcaatggaacaatggataatacatgatttcccctttcctttttcctggaaatggcatcctgagatacatttcttactgcttttcaggaactgttgtatggtaactgtgaaagtatgcaacaatacctacagagacagccacctgggaacacttgcatcagcaatctctccttccatgatttgcttcctgactctctctcctg

SEQ ID NO: 11066 - DNA, 484 bp, Homo sapiens
aagttcttcaggtatagtctgcccatatggggatagctcatgtggttctcttgctggtggcataaagtttctcaccttgggggtgctggtggtttgccaccaaaggcatgggggatctgtttgcctctccagacagtcctcttgtttaggatccaaggtgatctcagcctgccgtctcttctctgtggctgatatctgatctatgggaaacactcaagctttctctactctgactgcctctgggtgaactgtctgatcacagtgcagccatccctcttttattccactggagaggtagcctgctagcccttactactcaccctttacgtggtttatgcatgagacagacacccgaccactgtgaccccattttcagtccacacctattagagtggaccatttatgccagcttcccttgatttcagataaaggaaaagcacccacaacgcttaccccatggtgggagtgggactctcagcacaaa

SEQ ID NO: 11067 - DNA, 531 bp, Homo sapiens
tctttgcgtctgcgtagttcgctcacctccctttctaactccgctgccgccatggctcctgtgaaaaaagcttgtggtgaaggggggcaaaaaaaaagaagcaagttctgaagttcactcttgattggcacccaccctgtagaagatgggaatcatgggatgctgccaatttttgagcagttttttgcaaggaaaggatcaaagtgaacggaagaagctgggaaccttggtggaggggtggtgaccatycggaaagggrcargrscarggwtcaccgtgtacatccgaggttgccttttctccaaaagmgtatttgaaatatgctcaccaaaaaatatttcgaagaagaataatctacgtgactgggttgcgcgtagttgctaacagcaaagagagttacgaattacgttamcttccagattaaccaggacgaagaaagaggaggaagacgaggattaaaatttcatttatctggaaaattttgtatgagttcttgaataaaacttgggaaccaaaaaaaaaaaaaaaaaa

SEQ ID NO: 11068 - DNA, 483 bp, Homo sapiens
aatgtgaatcacttaaaagacatttgttttcctgtaataaataaaagattagtaattagttttacgtttgctttcaagggattctggttgtatttattgtcaactaaataactttgatcaaatagccaagactctaacatataggcaagagtttgtagggaatcgtgagttgcttggcttatactgtgttcttggtgttaagtattaacaggaatatggcctggtaattagaacttgtccatcagaattgccaaaagtgggattcgggggtctctgcctatggaggatgtggttcagaaataaagaatttgaataggataagctgtaggaggatcttagtatgagaatgagtatctgaagattagctgtgagagagggcagagcgatggagggaacaatgtgggacagtgtgaagcatgtgatccaggggccataactttttttgttactatttttttaaatcagaaacttagatttcagtgt

SEQ ID NO: 11069 - DNA, 312 bp, Homo sapiens
cacaacaagcttaagagggaggtgctactatctgttctcattttagagaagcggaaattgaaattcagacaagtttacacacctgcccaaggttacacaggactagtgtccttataagaagaggagaagataccaggaatgcaagtgtagagaaaacatcatgtaagcaagaaggcagtgatctgcaagcaaaggagagaggactcaccagaaatcaacttgctagcaccttgctcttggacttctagcttatagaagtgtgagaaaataaatttcttcggtttaaaaaaaaaaaaaaaaaaaaaaaaaaaa

SEQ ID NO: 11070 - DNA, 488 bp, Homo sapiens
actttgattgcttttctaacaggctgtaaaactgcggagagtctgataagaaatccaggctggaatgcaatgcggatctccgctcaccgcatcctccgcctcccgtgttcaagcgattctcctgcctcagccccccgagtagcttggattacaggcatgcgccactacccccggctaattttgtatttttagtagagatggggtttctccatgttggttaggctggtcttgaactcccgacctcaggtaatccacccgccttggcctcccaaagtgctggaattacaagtgtgagccaccgcgcccggccagcaaagctacattttataccaacccgttaatttctttctcagtacctgaggaatatagggaaagcaacagaatgggtgatttcctttaccgtactcaattgaatatagagtttatcatatgtatttttctaatacttgtattattgtcttatgacaattaaaacaactaaccatgca

SEQ ID NO: 11071 - DNA, 253 bp, Homo sapiens
aatatagagtgtacttacccaaacctaaacagcacagcctactacacacccaggctgtaggctgtgcttctagactacaaacctgtacagtgtggtactgaacactgtaggcaactgtaacacaatggtgtacctaattcctctgcctagaaagtgtgctggaattactgcctggcttctgatgaatagggcgtattgagagtgatgctttgtgagttctgaggctaggtcatagaaaggattgaacttattc

SEQ ID NO: 11072 - DNA, 398 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtga

SEQ ID NO: 11073 - DNA, 499 bp, Homo sapiens
aaggaccagcgggaaagataaaagctggggtttagtctgtgctgcgtgaaatatgtcttggcctcacttcctgtcctctgagctgcctgcaaccgggcgaggtggtgttgaactgtgttttttgtgacgaagcttacttttaagtttcatccctaaactaagttgacctgtttctttaagacggcttgcaaaatgtgttttcctcaatgtgggatatggaaagaagcagttgctcctgttattttgagctagtacctgacgctatgagaaattctaaaagagcgaatcagatcatgcaacatgaataactatggaggctgagtgatcaagaacagaagttaatattttggtgttacaaactttccacggattaggtgaataagatatttataatttggtgtgttcatctcaagttatggattacgagtgcggggcactagtgctttagattggtaaatgaatcatcaacagtcgccttgaaaatcgaatatttttgtca

SEQ ID NO: 11074 - DNA, 401 bp, Homo sapiens
ctttgcctcctgccacccacataagatgtgacttcttcctctctgccttctgccatgattgtgaggcctccccagacatgcagaactcaagaagtccctcaccagatgccaacctctcgatcttgaatttcccagcctccaaaactgtcagcttttactggatatttttgaggaaggaagagcaagcagctgtagaggaaggaaacaatgaagcacctaagtcaggatttcatggattttcagcaatgtagacagaacagatgaaagcactactggagtaatcagaatgagaacggtgattgaagagtgagatgtggcctaaaaccatatccatgtcatgattcattcacatttgcatgtaatcatatttgcattctaccatcatcaaccaaactgagggc

SEQ ID NO: 11075 - DNA, 444 bp, Homo sapiens
agtttgagctgaattttcgctttcagcagccgcatttgtagcagctcttttgtgatgacttagtctctaagcccgtgaaagaaaaagaaaactctcggtggcaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggcaggttaaccacaacaaggaaaacaccacaaggaccaccagaaatctacagtgatacac

SEQ ID NO: 11076 - DNA, 448 bp, Homo sapiens
ttcctgtggtataggggaagcgctccgggcctggaatccctacgcgtccctttggtttagcacgatgagctcaatcggcactggggtgagttcgctgtctgtcggtgtaatagtttaacctaaggattggggttgaagggaactcggacagaccacatggggttcgcggacccggggtgctctgagaccgccttcggctgggtgggccatttgcagctgtttggagaccggtcgtctttatcccctatatgctaggcctgcgtctcaggtgaccgtgactcctgaagcttttcagcgcaggtgtagccgkcttggcgtcgcgcagtgaggtttggagccgctttggattgctgagtcactttcttcagccacttagggaaaccgaaagtggaaactcgtggggcttgaaatagtgtgttctcttgagaaccaccgaggcagtgagatt

SEQ ID NO: 11077 - DNA, 482 bp, Homo sapiens
actaggaagagacttgtgccacccggggcaagaacatcagagatccagtgacagcccagcgacctccgggatcaattgcaatgggaggtgtgttttatggaccatgtgctgctatgtatgcctgaagaagtacttgaaatgcaaatttggggagactttgccatataaatgcttggctggattaagcgcttaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagggtcaaagaattgactgtagatccaactgctgctggtgatgttcgtccaataatgcaccatccaccaaaccagattgatgacttagagacacagtggggtgtggggagttccctcagagagatgatctaaaacttctttgtgaacaaaa

SEQ ID NO: 11078 - DNA, 273 bp, Homo sapiens
actttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaaaaaaaaaaaaaaaaaaaaaaaaaaaa

SEQ ID NO: 11079 - DNA, 331 bp, Homo sapiens
aatagaggcctcagctaccctggccaacagcaccccccaggcacactgcagaagctccctgtgcccatggggccatctcggcttgtccgtggccctcggcccagggcatgcgttccccctaccgcagccaggtatgggctggcccaggccccgatttcccaggatgttcaagtgtagccgcagaagatatcaacagggtctccgaggtcgaactgccagcagtgcagccatcaatcctgccaccagggccatgggtatcaacaacacccacacagacaccaccatagtgtggatcttcccacctcaagttctcagacatctcaggcaacct

SEQ ID NO: 11080 - DNA, 391 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattaca

SEQ ID NO: 11081 - DNA, 488 bp, Homo sapiens
tattctggttttacataagaagtatgggagcttgcccatttttctctgaagtaagaagatttgggcccagcagtgaggatcagacgtcaggcagtgtggaagactgaagccatccacagagaactgaaaatagactgaaagctgctcacagccaaagccagaaggaaactgcagtattgacagagagagagaaagaggagaaagaaacagactcaaatcactcggggcaagagagggtttgctggtgtggaaaccgggtggtggggaggctttcagcagaatatcaggaggggacttcagcagggacccaaggaaagacgtgaaagaacagacactatagaaaaggtgaacccttttgatccaatctcactgtaaagccaaaaggagtgagtactgtttgaagtgaccctggcctcattccatattggtgctctgcctgttgggtcagccagctcttcggctggtccctgatttggaagttacgtctt

SEQ ID NO: 11082 - DNA, 258 bp, Homo sapiens
agaatcagatgcctgtgaagtgggccctggcttggaaggggaagaggatgtgctagccccccagttgaaataacttggatcagactgctctttggaatcaggaaggactttctgtagataatgataagcagaagaagttataaaagagaactgactgggttggctaacctcatacaaataagttgttttttgcatgtaaatgaaataaatgaaaagacaacaaaaaaaaaaaaaaaaaaaaaaaaaaaaaaaaaaaaa

SEQ ID NO: 11083 - DNA, 468 bp, Homo sapiens
  misc_feature 187..188: n=a, g, c or t
atgaacagtggatgagcccttgattggcagccatctcccttgggatgtaaacgtgggtcaggacttggaatttccaacttaggtaggcagcacactagattatttctgctttacttttatttctctaaggcagtagcccttccccctcaaaaaaaaaactatctgtaaccaccacaatgaaaaaasnntattgcacagaagaattggaaagccaccattattatgtcacataatcaagacaagattctgaaactcgattgaaaaagatgaacttgtttccaaccggccttctgaaggataaaagccagtctctcttcgtggcaggcaactagctggttattcctctgattgcgtcacaaagggaaatctgtatattcaccccagatttctaaaagaagcaagaaacttcaagttcacaaatcatctctcaaggcaggtgccctgtatgacaaccaasgttatggccct

SEQ ID NO: 11084 - DNA, 339 bp, Homo sapiens
taggaacaccctggagaggctgcaggtccggccacgmgcttcagctgagccccggtctgctccttcagcctccttgctcttgttggagcacaggccccaggcttcctgccagggccccgattcttcttatgtcctccagccccgccctggcgtggacatccactcactccttccagcaataagaaccgtccttggtcgtggagagtactgtgaaacaaaccaatgcacttaccaggaggcacaagactcttgaagaagatgtaaaatgaaccttttttttttttacaaaaaacaaaaagcaaatattcataaagagaaataaaatgtaattttaaagta

SEQ ID NO: 11085 - DNA, 488 bp, Homo sapiens
aactggctctgctcgcttttcattctgtgggagctttgttcttttgctttttgcagtaaatcttgctactgcttagtttttgggttcacactgcatttgtgagctataacactcaccgtaaaggtctgcagcttctctcctgaagccagggagaccactaacccaccagcaggaaagaacaactccggacccgccgccttaagagctgttaacactcaccgcgaaggtctgcagcttcactcctgagccaacgagaccatgatcccaccagaagaaagagactctgaacacatctgaacatcagaaggaacaaactccggacacgccgcctgtaagaactcttaacactcaccgcgaggtccgcggcttcattcttgaagtcagtgagaccaagaacccaccaattccggacataccttcatagtaagtgccctatacagatgaaccattttttctcttttatactgtttttattgtacttgtcctat

SEQ ID NO: 11086 - DNA, 478 bp, Homo sapiens
aaaaatgcagggagaacccaattacagggacacgatttccaaagaagacataagaaactgatcatagctgatcatcacctcaatagaaaaattcctggaactgaacgaagaactgagattagaaatcaaaaggacaaaaccagtcttagtttatgcacagaaattaatgctaagtttcataactgaacaatgcttaaatttcaaagaaaaagagagaacctctgatgaggaaaacggagcagctgtggcctcaaaaaggtgggcgctgatggctggacacaggccaacatgtgctgcccagctgtgcccttaaagctgcaggaggagctataagaacatgaagctgtttcctttsatgacccagccccctgccctagggcaagtggcctagcctagcctctttgcaagctgtcagccctaacagtttaacccaaaaatgtaaagacaagattctgtttccagacctctgcagtcttta

SEQ ID NO: 11087 - DNA, 135 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaaaaaaaaaaaaaaaa

SEQ ID NO: 11088 - DNA, 438 bp, Homo sapiens
attgtaggggaggagccggccagccagggcaggcaggggcggcctctctgacgagaaggaggccactgggctgaggccaatgaatgggaaagagccagccacgtggtgagctgggagagggcatcccaggcagtgcaaccagcgcttgcaaaggccctggggctggacagttcttggcggagtctgagcctcgggaggagccagtcctgctgacacctggatctggaacttctggcctccaggatgtgagacaatgaattcctgttgttgaacctgcccagtcggtggcactttgttaaggtagctccaggaaacaagcacaggggccctcctgggtgccctctccctcccttgcgccagttgggagcctgctcctcatggacaggcatcggcctccgttggsacctgagagtsagaagtggctggaatggtggatgg

SEQ ID NO: 11089 - DNA, 77 bp, Homo sapiens
cagaaagggctgtgtagagtagggccctgttctccttaggatgttgcttcttgattttttttttttttaggggtggg

SEQ ID NO: 11090 - DNA, 275 bp, Homo sapiens
atattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaagggacatggcttgcagtgtggcaggcataacttctgatgctaatgttctgactaatgaactaaggctcattgctcaaaggtatttattacagtatcaggagccaatacctt

SEQ ID NO: 11091 - DNA, 62 bp, Homo sapiens
aaaaaaaaaaaaaaaaaaaaaaaaaaaaaaaaaaaaaaaaaaaaaaaaaaaaaaaaaaaaaa

SEQ ID NO: 11092 - DNA, 336 bp, Homo sapiens
aagagcttcgttagacttcagtgaaggaccacttgttccctgaaggcatcttttgttgatcttgctgttcggagacaaaattatcctggaacagatttttttctatttttaggtacattgttgattgtgaamtggagtctccagtgatcttttcataaacatgccagagacggtctcaagagacaaacagactgatgttcttgccccgagcagtttaggcagtcaccctttgtgggattatgtccagatacccaggactgcattttgagaccacagcactttctagaggaaaactccagactgctactagattccttgttgtactccatggccagc

SEQ ID NO: 11093 - DNA, 454 bp, Homo sapiens
attaggatggcacaagagtgaagtgagcacacctccaggggaccgtcttcagctcggttcttgttgagtggggaagaggtggtctgatataggaaaaaacttgctttggtcaaccccgaagctgaagagatgggttttccatgagatctgtctctgagtccagtggcttttcttaccccagaaaaaccaggagaaaatgatctttcctatactgcagtctcccttgatttcactcctgtaggaggagcgatatatggtttttagttctaacttggtatctgcaggtagtgctggggggacagaggtgggagcaccactctaagccatttttatgttacaaatggcaaaacaaaattaatgcgttgacctgaaataagaatgcatgagttatagaaactcagggctgggtgcagtggctcattcctataatcccagcactttgggaggctgaggc

SEQ ID NO: 11094 - DNA, 125 bp, Homo sapiens
atttaggggcggttggctttgttgggtgagcttgtttgtgtccctgtggaggacgtggttggtgattggcagttttcgcattttttttttttttysttttttttaaaagtkggaaataattttat

SEQ ID NO: 11095 - DNA, 67 bp, Homo sapiens
actccaagtgcggggccgccgagcccactcaccccagaacttgcgctggcccacaagcaccctgcgc

SEQ ID NO: 11096 - DNA, 489 bp, Homo sapiens
actgcaacagactatggctgttagagcttagacccacactatcccatgggtgctcatccacagggatgatccctatgcaagtatagaggcttgcaagcttgggcaccaaggtagtaactctcttttagtccacacgcacacctccagtctcttccccagggtggaaacaggccacaagctggccccattagtgcccaggcaggtctggttccaggccctcatgcagactgcgaaccactgtctccacttctccatctccgccacctctctggctgcccataggtaaggctgccttattttcagacctttaaaatgtaatacatcttgaaaacatgcttctcccttaacaactgaggctactttccctacacatagcctttggggaaagctacccccaggggcatcaaagtggtttctaatgaagctagaaactgtgacatgtgacatagaagataacgtcctctcactaaagaaaacagagcaaagtgc

SEQ ID NO: 11097 - DNA, 387 bp, Homo sapiens
  misc_feature 276,283: n=a, g, c or t
ctgaggtgttcccagcactggactctgcagagctgggcttcctttcccctccctttctccatatgctgcaagatttagttagtacaaatccccagcagctgcagcctgaggctcactttcaggtgcagctggagcaactgcgtccatgggctttctgaatcgtgaagscaatcttcaggscctcattgctamggggggcgacgtggawgctgctgtggagaagcygagacagtcgtargagscttattcattcaaaccataagttttcctctgtgnctttttnccatatyctagktccctaggtctyccatttttgaatacaggstgsattatwaaccaaatttactatgaagtcctttgctgtggaggcaatgttgttccagagts

SEQ ID NO: 11098 - DNA, 132 bp, Homo sapiens
ttgtcagttacgtttattaccaatatcttttcatgcaaattctttctaatctttctacttcatggcttgctctttcattctttggtattttttgataaatgaggttttaattatttttttttttttgaaata

SEQ ID NO: 11099 - DNA, 395 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggc

SEQ ID NO: 11100 - DNA, 485 bp, Homo sapiens
tcattttcctttatcttccacatcagatctctcagcaattcatgttgatttttttctccaaaacaaatcatgaatttactgccatcatctagtccaggccactctcatgtattcacatgggttgttgtatcagtctcttaattggcctcacattatttatttgccaaattcttctttacttatcatccagagatattttatcaagatgaaaattgatcatattattattctaccttaagcacttcaatggctttccattcaacttaaaataaaatggaaatttgacatcccctccaaggctctgtatgatctggcctgcctacttcgcaacctcctctcttaccagtccttcctcttagttatgatgcctccattatactgatcttccagggcctcgaacatctaccaagctcttgcttgcctcatgttttctctatggtctggaattttacccttccattcttcatctgtggacctcttaccag

SEQ ID NO: 11101 - DNA, 422 bp, Homo sapiens
aacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagctaggttcaacccttgcctcaagaaatcagatgggaccaatttagtgtccttccacctgtgagccaagcccccatttgaggacatctatcgtattcttgtgtgctgggtctcaaatagaatttttaaagattaaaa

SEQ ID NO: 11102 - DNA, 517 bp, Homo sapiens
acacttagaccgaatgccaaaaattaataccaagcatttaatgaatctgggatactagcattgtaaatgatatcttggtacagaagctagaattacaatggcctggtacagtaagaatggaaatgggaagagaagatattcacgtcattagctttcttttctccctagggcttaatatacacaaggccatagagctagacccaggccatggaggagcatggaggaccgcaattctaaaagctttgccagcttaaaagtaagtgcatccaggaagcagctgaaacttcacgcagatttgtggatatagacatgaagggaatatggcttcctttgtagtgagttctgtctgcagatggacactcaaaccatgaaaagctcagcctacgccgggcagtcgacatcgtggctccggccagcaattcttccactagatttaatgagagcgtggaagtccctgaacaacctgaaggcacatttgaggagaagcacacactcagtcaggggaatggagccagaa

SEQ ID NO: 11103 - DNA, 304 bp, Homo sapiens
taactttaggcaagataatcttctgtgagggctgatatgatcaatgagagtaagacattagaaatacaagaattgtcctgctgctcacccatcagcattttcagtttctccttgcaaaagtagtaattaactttgtactttgagctgtatgttcagttagtgataaaccgtagataaaaagcagatttaattggctgaccccaggtaagacttgcctctctcatgtaccctttgaaggtttaacaaataaaatttgagggaaaggttgatgttacttatagggtgtgttagttagttttttggg

SEQ ID NO: 11104 - DNA, 457 bp, Homo sapiens
aatgaagtagtgttatgtcatcagaatgccataagaaattagagggggtagctgagatggccaactaaaagcagctagtgtgcactgctgtcatggagaggaatggaacctcctcaacacaggggaactccccagtccagggaagtgttcccaactgttaatttgttatccagtctcstcatgcaccatattgaaaacagagccttcagttaatcataactcagaaacccatagcaaattgtaaaaatggccacatcataaagtcttctcatcctgtatgcacactcatttatgactttacagttcttcccatcaagagatgaagtctattctttactccttgaatttgggcttagctatgtgacttactttagtggatgggacattagcaatgtgtcaggagcaaatgcttgawaagtgcttgtgcattggagtttactctctggatggtctttgg

SEQ ID NO: 11105 - DNA, 476 bp, Homo sapiens
gagtagctcttgccagtaggccgggactagctgtctcggggccttccatccgcttggccccacaggttttgttttgttttgttttgttttgttttgtttgagatggagtttcgctcttcttgtccaagctggagtgcaatggcacaatcttggctcactgcaacctccgcctcccgggttcaagtgattcttctgcctcagccccctgagtagctggggtaacagcacaggaaaaagaagataaagtaggagagggatcagtttcacattcagtcctaagcagcaacacggttgagatgtaatcataaaagcaaatatttcacccaggacatggaaaagcggcggatcaccagaaagcagagagtcaaacgctgcaasaggaagcagtaagaagacgccacgtttggagcaaggtcttatttacacctgccatggtcatcggctcgctcttttaggtctccccaacccggccccaa

SEQ ID NO: 11106 - DNA, 108 bp, Homo sapiens
atttaggggcggttggctttgttgggtgagcttgtttgtgtccctgtggaggacgtggttggtgattggcagttttcgcattttttttttttttscttttttttaaaa

SEQ ID NO: 11107 - DNA, 446 bp, Homo sapiens
cttatgattaaattattagtccaattttatataggagaaaatagactcaaagattagttttgcctaaggtcacacagctaataatttatctgaaccagtatgactcgtttcaaatcaccatgtaaaaagtgtttgggttcttcttaagtgcttatcataggttatcattccacaggagtactatgaagtgggattcttttcaattgtgtgagaataatttcatttttattctataataatgattttgaagaaatatgttagctagaaatcttagaagaaaaaatattttaataattttcaagataagaagatatagttgcttaagagagttccttggaaaaaaacccaacatcgaatatgctaggtttcacagtaaacctttggaagttccagctgagtgcttttgctgaatctctatgaaaaacaaaatccattatttttttaga

SEQ ID NO: 11108 - DNA, 397 bp, Homo sapiens
tacactgctggatctgctgtgtggacttgaccctgaccagggagctccaaaaaccggtgatgataacatgatgtaattgagagtgaaaggaaggcaactgagaggataagagaacgtaaacaagaggcagggtgaagccaagagaccagaagatgatggtcattgaaaagagattttgttacagttcaagagaagcaagcacaacatgccatgccttcatcttctgctatgattgaacaagagattaggacgcagacaacacagacttaagaggtgatcatgtgaggatacagcaataagatgaccatctataagccaaagataggcctcagaatgaatcaaccctgttgacacctgaatctccagaactgtgagaaataaattttcatggccgtga

SEQ ID NO: 11109 - DNA, 379 bp, Homo sapiens
atacaaaatggaagcctgggatagagatcatctcctaggaaagggggaggccacccaaggcctgtcagggggagggctccacttctcagcccatctgcagtaggtccacattcggggtaggcaagagcaaggcctgctggaaagggaaactgctcatcaagaaactgagggaggctgggcacggtggttcatgcctgtaatcccagcactctggaagtccaagcagcactggctccttcttagtcccatggaagcacagatcaacatcattgcccttgcaaacttctctcagcttaggagagtctactcgctctttgcacattgttgacatgaaatgaatattaaacaccaaacctcatagaggccagccctgctggcg

SEQ ID NO: 11110 - DNA, 488 bp, Homo sapiens
taggtttttaaaaagtatcttgatggttcttttctatttataatttcagactttcataaagtgtaccaagaatttcataaatttgttttcagtgaactgctttttgctatggtaggtcattaaacacagcacttrctcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcat

SEQ ID NO: 11111 - DNA, 414 bp, Homo sapiens
aaagggtgtcctgcctgggagagcatgttgtcctgcttgagagagaaaaggacacagatgaagagtcacatagggtgaagtatagagtggttgagcgccccgtctctacacttcaccttttgtatctcttcatatgtatcctttgtaatatactttataataaaccaataatcgcaaatggagccccactctgttgcccagactggagtgcagtggcgtgatctcggctcaccgcaacttccgcctcccgggttcaagtgattctcctgcctcagccttccaactagctgggattgcagtgtcatgatggccccaatgtgactgcaacttctaggtgttatgaaacaaaagggacaacaacaacagcagcaaagtttccttaatctgaataawacatatttatatttaataaaa

SEQ ID NO: 11112 - DNA, 399 bp, Homo sapiens
aagggcacactttggagccagcattttcggcctcggaaatgagacccagagcgcctcgcrrgcagccccaacctccccgcagacgacatgcgacaccgcccgggtgacccaggctcgggaatctctaggcttcacggacgcagaaccagggaagacacgcctcaatgcgcgtgtgcaactctatcccgtcctttaaagaaggccatgtggctcttcaccaatcggaatcctgctttttccctggtcccgccttattcccagacttccggcgtctcgctggccgcaaaacaaccctaaactacagggctcggcgactcccagagacttctgggtattgtagtcctaaaggttcagagcgacaagagcacgttttagtaaaaagcagcttagaataaaaaa

SEQ ID NO: 11113 - DNA, 432 bp, Homo sapiens
atattcacagtcagctttaaagctgtagtcactcctctggggtctgaataaacatggccattcttgatagacatgttgactgatggactgagagatatagatacatgccatgagatctctttatgaggaaatgaaatcagtatgtggaagagatatctgcactctcaagtttactgaagcattattcacaatcatcaagatacagaatcaacctaagtgtccatcaacagagtccttaggatgtttatacataaaatgtccacaaatacgaaktggtcttacagaactggggatagtacctctgatatcgtttgagtgaattgctagttacataccaccaaaagctatgactggaccagaggcaaacaccttgatgcaaggccacctcgtccattggttggccatgaacgatcaagtcattttgggaaaaag

SEQ ID NO: 11114 - DNA, 471 bp, Homo sapiens
acaggtgtgcgccacggcgccggctccaaagtcaacgttcttaacgtctgccttacactgtctccatgttcttacctttcatccattttctctggctcatcatcttgtccatttcccttctcagggtcaccacctccctcagacgtttctgggacagatccaagccagcagagcagctgctcgctccagagccgtggtgtcttcctggtgcatcagcgccaccgcgtgsaaaaacagggcaactgtaggaatcgactttccatctatttggagctcatcagtgcttttcttttagactcatatggcaggaacaagaagtgcacatgccaaaagaaaggcagaggactgcaggagcaagacgggttgcaaggggcgtgatgrctagcacaatcctggcccctcttcttccagcattattaagacacagtagaataatagtgtatgagttattgtgacagtagcacttttcaa

SEQ ID NO: 11115 - DNA, 452 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaat

SEQ ID NO: 11116 - DNA, 474 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacagggtctcattatgttgc

SEQ ID NO: 11117 - DNA, 376 bp, Homo sapiens
  misc_feature 147,160,358: n=a, g, c or t
catacagattaatttaatataaatttttttttattatactttaagttttagggtacatgtgcacattgtsagggttagttacatatgtatacatgtgccatgctggtgcgctgcaccactaactcgtcatctagcattaggtatatntcccaatgctaknsctsccccctcccccsaccccaccacagtccacagagggtgatattccccttcctgtgtccatgtgatctcattgttcaattcccacctatgagtgagaatatgtggtgtttggttttttgttcttgcgatagtttactgakaatgatgatttsbaatttcatscatgtccctasaaaggacatgaactcatsatttntgatggctgcatagtatt

SEQ ID NO: 11118 - DNA, 434 bp, Homo sapiens
  misc_feature 102: n=a, g, c or t
agtttcttaaccgctttcggctgttggtcgcagggctaccgcctacagtcccagcaagcgccgggctgcggggtggtgagcagtcccggagagggcgcaabngtggacctctctgcttccaaacctatgctggccactgattctgtgccatccctggctaaggggagtgagtccagagagggacttaaggggcaagtcggggctgggcagtgagtagagtgtgacgctgcgaagtgcacctcatctttgcctaaatcgggcgggtctcagcctcaccccacctctcgctgctcagctcggtttccctccagagcatcacgcctcctccagcacaggagccgcctgctttcctagggctgctgtggaactgggcctgagggtcccagacgctgtccattgtgctgccgccctccgcgctctccagccagagcgcc

SEQ ID NO: 11119 - DNA, 457 bp, Homo sapiens
aacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaataagggaaacagctctgtgctgccccagaaccacagctttgtctacagaccaggattctgaaactaaaagaaaaaatactttttatcaacctgtgtcagtggacaaggatcccagctccccaatcaaccactcatccagtacctctaactggcaaaccagaagatacaactgagatatcagatgcttacacagtcattgatgttgcctacaatcctgatgttcttcatgcagcagaaaaggaccaagtgaaaaaaatcagttaattcagat

SEQ ID NO: 11120 - DNA, 421 bp, Homo sapiens
gatttctgaaatcccaagtcaatttcctcgtttctctcctctaagcttctatatatagaggataaatacatcagagttaatagttgcctaatttagaatgagaagcaactggcaactgcccaaaatgctttgacagtaaggactattccccaaatctggcgaaagtccaggcctgtttatcatacagagagaaccaccaccacacagcagccagattctgtgggatattttggggaaagcacccaggatacggacaacttgggttgtagatctggttttgccttttctggtcacgactcttgtgagcctcagtttccccacctgcaaagtgagacagaacctgctagcacctgtatgcaagacccctgctagatgtctacacgaggcatcccttttcatcatcatattcactcgtcagcca

SEQ ID NO: 11121 - DNA, 399 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtga

SEQ ID NO: 11122 - DNA, 168 bp, Homo sapiens
gatcttaagacaaaaaataaaaatttaaaaattggccgggcacagtggctcacccctgtaatctcagcacttttggagactgacgcaggcagattcacttgaggtcaggagtttgagaccagcctggccaacatggtgaaattccgtctctaccaaaaaatacaaaaa

SEQ ID NO: 11123 - DNA, 469 bp, Homo sapiens
atgaatgctagcacagtgaaagaataatttggtatgaacaagcctataaaagagaggggacttaagtgcgtctggtttaccctccgagaacaatgcagctgccaaaccaatctggaagctccgacatcattgttctataaaccccacaatctgctctgactgcaggaagtgcatttaatgggcaacatttttgatctcccctgaaaagtttgggttttgtataagtgctgttgtgagataattcttcaagataatgacttgctgaccaaatccctgaattgacctaggtaatattatttaatattgagcagtttggggcttgcttttgtttttgtttttcttttacaccagacaagatgaataccttatgaaaaatacaactagtgacaaatattagaacaaaatgttctgcttaaaggataagtgaaattattttcacatttttcaaagtaacaaaatcagatactgc

SEQ ID NO: 11124 - DNA, 338 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcaga

SEQ ID NO: 11125 - DNA, 446 bp, Homo sapiens
actttgaagttagtgagatagttgtctcttgctatagatttttgccacttgtatttcttctgattttcttgtccaggtactcttgatcatttttctctttaaatttttctttttaaaaacttcttcttattattattatttgagataaaagtcccactctgtgacccaggctgggagtgcagtgctgcaatcacaactcactgtagccttgacctcccaggctcaagcaatcatcccacttcaacctcctgggtagctgggactacaggcgcgcatcagtttccagctaatttttaaattttttgtagaagcaaggtctcgctatgttgcccttgaactcctgacctcaagtgatcctcctacctcaacctcccaaagtgctggtttactggcatgagccactgcacccagtcgggtttcataattttctaattgatcattaaaca

SEQ ID NO: 11126 - DNA, 398 bp, Homo sapiens
  misc_feature 309,329: n=a, g, c or t
aataggcagctgcagcagtggagtgacaggatagagaaacaactgtagaggagcaagagatgatggtgactcagaccaaagtggaagcagtggaggtgaggagagctggtcaaattccaggaatcatggtaattgtcttgcgcaaagaatcttcctttaatatggcagaaatattagtgtgaaagacagaggactctgaaaagcaggagcaggaaatttaagaaaaacagcaaaagcagacatgaagccgaagaaccacagaggagccaaattacaagcagtacctgaaacacattcatcacagtcaanaggaagtgaagagacacagnagggaagcgagatamtgagatgctgccaagtatcccagagtccatgatggagtagagatgaaacaatag

SEQ ID NO: 11127 - DNA, 478 bp, Homo sapiens
tatgctataatatatgcttatgatttctaaaaattatgcagtatacacaaagggcataaagtcaaaaagtgtgtctccctctgtgactttattctcataccccagaggtatataatttcttgtattcttgtgtagtctttaagaaatgttatcgtttattttatatatggctctctctctgtatgcctcttcctgttcttattttaaatgttcaagtttgtgacttggttcttgtttaacttggttgtctttccatattgccaccttccagctctaacattaatgtctccaggattccattatatggatgtccctttggagaacatttgtttatagacttttctactaaaaatattgttataatgataatatccttatgcatatatgaagattactcttgattctgcctgactggaaactttattaataaagtagacattattctattttgaggctcaccagctgtgtaggtatgatc

SEQ ID NO: 11128 - DNA, 481 bp, Homo sapiens
gattaccgttctgctgtggttagcgttccctcatccattggggtcgaggtcttgtaggtccatttggggcctattgaagattttttacgaatccatgcattttcttattaaaccttcattacgggcctggaaaatagatactgtgtttctatagtacaaatgccatcttctcagggagcccttgcccagacatccttttctaaaattgcaaccctccctttcccttaatgtacattctccctaccttcgttctcttccattccccccattcactttagactcatcaccatttaccttatacatttaacgtacatttgatgattttctgaggacctgctccgccctagcatgtaaagtccacgagcacagcrttttgttcttgctctctgctctgtcccagagactgggggagagagagaccctctcattttgttttatattgttttatactcagtacctgttttaagaagaaacaacaagg

SEQ ID NO: 11129 - DNA, 397 bp, Homo sapiens
  misc_feature 383: n=a, g, c or t
ttcttttctcctgaactacatgattctaattggaatgttcatttgcctctttttactcttttaaatgcttgtaggtggcttggggtgtgctatcgtgctgttcctactcagtaaacaggtgtgatgagttaasaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaasagtgaacatttttaggcacacttttcactggggatatctctttatgcaatacctcaatttttcatattgcaaagagtagctttttgtactnttattactgagaga

SEQ ID NO: 11130 - DNA, 474 bp, Homo sapiens
  misc_feature 344: n=a, g, c or t
caaacatataacaaacaaatgatgttaactttctaaaactcaacatagataaacaaatcctatgcgtgaaaaagaaagtatgtggtcacttccccgtattgtttctaatcttcttccaagctgacatatataatctcaataataaagarattcatcctccctaaagcaaataaaagagtcctaatgaaagtaatgtaccccactagcattcagaccctaaaaacgacaaatgtgatcttagagaagaatctaatgaaaacaattacattaaacatagctcttctgtgctcagtgctcagtaagtgagcagcaggctctctctgtctagcttacagaatacaggnggtagcagtttgcaaggcgcagcgttttaatgtgattggactataacaggcaatctatttacagcatgctctggggagcttataaacaartgttgagtaatttcagccagcagtaattacccttgcagct

SEQ ID NO: 11131 - DNA, 460 bp, Homo sapiens
gaactgtgtggagtggcagcaactggaggaagcagaatgtccccgagcaagattgtcaagagaaaaaagttacatgtataaaatatacagtagaattggaagatggatctaatgagaataacactaaggaaacaccatccttcaaaaactaaaagctccttgatgagacaccaggcgaaaggcaagatgccagagtataaatgactttgagacaagaaaatgaagtgtcccagaagaggaaatgcacatcagccattttcatttcacgtgggaagaacaatatgagacaaacaacctaagattaaatgaaaccagttggattggagagatgcatttacattttaccacctggataagtgtattttcctcttgtggctttataggcttgggggctattgaaaaatatctgtctataaattgaatcaacactcattaaactcattaagagaaatgtagttag

SEQ ID NO: 11132 - DNA, 214 bp, Homo sapiens
actatagcttcagtctctaatcctcccgcctcagccttccggtagctggaactacaggcggasaccatgcgcmkatttttagtagagacgggtttcgccatgttgcccaggctagtctctccaactcctggcctcaagcgatcctgccgctttggcctcctaaagtgcttggcttacaggcgagccaccacgcctggctccagacttttktttt

SEQ ID NO: 11133 - DNA, 509 bp, Homo sapiens
aaacgttggggaggttggagagggacgtttacctggggccggtccccactagtgaagaagaagtaaaatattcacaagatgaagatttttccagaagggactttgagtcaaagatggctttttatatttgacaagtcttgtcatctgtaatgaagatcattgtgaaacagaagattgattaaagccttgtaacattggacctagattagagatttagaaaagaaagtcaaaattagtcactttagtgttagtgttcccatttcataatatttattctttcttctaaatagatttagggagtagaaattaaaattcaatgctataccaaagggtatactaatatttgtttggstttttttccctttttgtgagggagaaaaaagtagataacgaaaagctatagtcattcgtaatgaaatatactaaacagaattttatgatgtcagttcttggcattatatctacgtaactgatttaattgtggacatatgggtatctgtcagattttc

SEQ ID NO: 11134 - DNA, 312 bp, Homo sapiens
  misc_feature 198: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccanaaaaaatttagccaggcatggtggcacatgcctgtagtcccaagtagctgggattggaggtccccaccaccatgcctggctaattttttgtactttcartggagatggggtttt

SEQ ID NO: 11135 - DNA, 469 bp, Homo sapiens
agtggatggcttgactccaggagttcaagaccagcctgggcaacatgacgagaccttgtctctacaaaaaatataaaaattagctgggtgtgatggtgtgggcctgtagtcccagctayttggaaagctgaggtgtgatgatcacttgagctcaggaggttgagactacagtgaaaagagatctcgccactgcattccatcctgggtgacagagcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagrtgttgaaaccactgcccagagtgacaataaaatcacatggtccattattcgtgagcacatgggagacatcctctataaactttcctccatg

SEQ ID NO: 11136 - DNA, 495 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcacc

SEQ ID NO: 11137 - DNA, 53 bp, Homo sapiens
ttttctacttgtctatgaatgacaacttgaattaagacaacgcaggctgaaaa

SEQ ID NO: 11138 - DNA, 468 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactagcttcataagcgarggagaaataaaagcctctacaaaca

SEQ ID NO: 11139 - DNA, 415 bp, Homo sapiens
aaatctgcctcacgcaatctctgaaacattaacaaactagaaatgagagagatttctgcaggtgctttcacaaaacaacattgccatgagctaagcctactctgtaatatgaagttatatttcatatgtacacatatatatcccatccacatatattcgatttacatttttgaaaatgacacacatgttcaatcaaattaacaagattaacagaagaaagtttagaaaatttacacagaaagtacatcacatttttctaataatcattttgatagagcagcttagaatctatgctttcaacaaagcaagaagcttacgtaagagaaaaccaccacaaaacacgagattttcaatgtgatcatcactgctactgttaactagaaattacccagtaaatgtattgtgaactgcgaaa

SEQ ID NO: 11140 - DNA, 102 bp, Homo sapiens
aaatcttactgtacttgaatgtgccctgttttgttagcacacctagacttgctgtaactgtactcatgtcccagtatgtacgttctttctatgaaagagaaa

SEQ ID NO: 11141 - DNA, 121 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaa

SEQ ID NO: 11142 - DNA, 437 bp, Homo sapiens
gcgartcaaactgttgctgtttgctgatgatgtaatcatatacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccaaaacaccaccatcattcttcacaga

SEQ ID NO: 11143 - DNA, 439 bp, Homo sapiens
agaaccttccgacagtatgtctagaggtcagtttggacagggacaggaacctctagacatgtttttctgggtgaacgagataagcggagaaatcacctaccccccgcagaaggcagatgcacctgctgtttctcctgagagcccacaaaagaagcccccatttcagcccaggagtgtgcaggaggctccttgcagtccccagggcccgcctgcacagaggcctgcccttgcacctccatctaagccttctctgaaagactcaggctcaagaaacccctgcccatctgcacccacctgggccaggccaaagccggaggagtgaggagcccccaccgttctcagcaatccctgtcaccatctcatcaccaggagtgactctgcccatactcggacccctgggaccagcccttcagccaccggtctcgacctctcctctcag

SEQ ID NO: 11144 - DNA, 540 bp, Homo sapiens
acatccatacccacgcttattaaaaatacatatccccctccacactagctttttcttttaataaaaaaaaattgaactcttaacaaagcgccagttacttattccacagacagatgaacttagtattttgtttttgatttttcattacaagaacaaatatcttttggttattttgagtatttatgtgacatttatttggaaacagaacatgttctcgtgacaatgaaaatattttgtatatgatacaaaagaaatttaaatgttaatatgaaacttgttctagcataatatactaactatactcatttgggagttaaggttagagcatcttttgagaatgaactgatctatgatgatctacaagtatatttttgatagagctgaaggttaacacttctactgccaacacttatgtattttaatgatggaagtttaaagtctttcatggtatttgaacttttctttgacttaggcacattcgaaatttatatctttttttgggctgggcacagtggctcacgcctgtaatcccagcacttt

SEQ ID NO: 11145 - DNA, 449 bp, Homo sapiens
cattggctgttcagaatcccagcacttagacgtgagagaactacacaggtttagagctggaaggacaggtgtgaaccacatatctgaacaatagcaaccgtgatttgtcaggtgccatgttaaggactatattacctctttaattctcccaaccacccaacaggataaatgctactatgatcttcatttttctgatgaggaggcagaggcatttggagatgtagtgggccgaatcattgccccctaaaagctatgttcaagtcctaactcctgggacctgtgaatagggccatatttgaaaataaggtctttgtaaatgtaatcaagtatctcaagataaaatcatcctggatttagattgggccctaaatccaacaactgatgtctttataagagaaaggaagatctgagacacagagaagacggccatgtgaagacaaaggcagatc

SEQ ID NO: 11146 - DNA, 481 bp, Homo sapiens
aataaagggtgtctttgtcaattcattcagtactaagagtgtttttgcacctagcatattttactttgttatttgtcattatttggcattcacaaattacagtttttacccagtgccttgtcatgagttacgtctaaagagagtaaatcttgctgagatacttggcatctttgagttttgagacggtctatttatgttaatggagtatcactgaatattaggttattttgattgtgcattctctgttacacattttatatcgctttaattttatttatggtgctgtcacacaattttctcttttcatcttatgtttttttcctgcaaacctgaggttgatgagtagctagggaaacaaaaagggagagattatgtgagcgtgtgtgtcaggcacagtgtgtccatatgatgggaggcaaggacagaggcagaggggacagcaagggagagawatgaaaatgatacagtgtgcagctgggcg

SEQ ID NO: 11147 - DNA, 273 bp, Homo sapiens
acaggattagcacatcagaacaagccccagaactgctgctgaacccgaggtcctcccccaggccctgcatccttcagaggcattctctgcccatgggcttgcactcccagaggaacacagtctacaagatctagcatcatacttatttggaatacactggatgtaagaaaaaagaagaatgtscaatgccaacactattgttaacattatataaaaggtactaaccaagagaaatataagagaatgaaaatgagagttaaaaacgtacctagg

SEQ ID NO: 11148 - DNA, 240 bp, Homo sapiens
gagattatgcatctggagtgggaagaagcaacacatcaaaaatatgaccagaccatccacggcggctcatgcctgtaatcccagcacattgggaggctmaggtgggaggatacgtggagcccaggagttcaagactaccctgggggctatatggcgagacatctttattaaaaaatgataattaaagttcaaaaaaaaaaaaaaaaaaawaaaaaaaaaaaaaaaaaaaaaaaaaaaaaa

SEQ ID NO: 11149 - DNA, 362 bp, Homo sapiens
acctcactcaggtactaggcaaagatatatctcacaaccacatctgtggaaaggtccagagaagagcttaacaattccacacatgtcctggcttcaggtggagtggctcacacctgtaattccagaactttgggagtccaaggcagacagatcacctgaggtcaggagtttgagaccagcctggccaacatggcaaaaccccatccctactaaaaatacaaaaattaactgagcatggtggcaggtccctgtaatccaagctactcagagggctgaggcagaagaattgctcgaacctgggaggcagaggttgcagtgagctgagttcacgccactggactcaagcctgggtgacagagcta

SEQ ID NO: 11150 - DNA, 491 bp, Homo sapiens
ttttttcttaaatatcaagctgttctttgaacagggaatgaacatgagtttttgtaacgtgactgaagttgagtttaagtaggaagcgcaggaagttcccaagtgccaggtgtgtgtagctcagagttccttttacagtgaggtgtctctcactgggggagcttccaggatcctgagcagactggacacaatcatctctcccttcctctatgtcaagcactgttacaaaagactgtgagcaaatttccatctaaatattaataattctgaagaagaggcaaaactgttgaatgcaagcaatacctattgttgaagaaacccacaaatttctgattctaagatcaggggatacaacaaaatctacaagtcatttcaaatagcacacaggaatcaaactttggtaaatcatttctgaggcacaattaaatatattgtagcactatgttaattaattatattaaatgtcgattcatcttgaaaaaaaaaaaaaa

SEQ ID NO: 11151 - DNA, 438 bp, Homo sapiens
  misc_feature 34: n=a, g, c or t
acaatgattagtaaccaccacatgtccctgcctntcaaggaaatccctcccgccttgtctctagacagccaagtcccacggcctgtcctctactcttccagaatcctgttgttctgacagcagggagggcaaatccatgcagcatctcccgccatgacctccagcctgtagaggagaggcgccacaggacctttacaggcacgccgctgttcccctcacccatgcatttcttaatgccttggtgaggagaatgcctctgggkcttccttggtgggagctaaaggwacaaagcctcgctcaattatgttttgaagagtacacagagactgccaggctkagggacgatgcaagagaatagaagagatgctcacagagaaccacagaccacacggccctagagtcaggggcagcaccagccactgtcagctgctcatttgt

SEQ ID NO: 11152 - DNA, 98 bp, Homo sapiens
cacctgctccccgaggctgatcgttaacagccgtgggcaggggttgggccagggtacagctgtcaggacctcactggacaggaccggagaggaccccg

SEQ ID NO: 11153 - DNA, 503 bp, Homo sapiens
atttcatcatgagatttggaggggacaagcatccaacccatatcaggagcccatcatcttaaattatgtggaggctgggttgctattttaatagtttgctatccttatttttccttgttttttcagatgttgtcttctaaggcattcatttcaaagcctattggtcttgtccctttagcaatgccaaaggtaggaaatttcactttgcttttcaaagttttttagttgactttgtagccttttaccctgcacggttttaaaattcagcaaatatgctgaggggagataccacctttaagcttgaggtccttgcgtgaaactttttaggagaattagtctcctagtgttgttattccagccctgtgtgaacaccaaaagctgtcctggcttctgtgttcctcagcaacaatattttacacaggtcaggcctcaattttcagcctctaacccaagcaataattaggaaatactcccagggaaaagacagatactggtcatctaaa

SEQ ID NO: 11154 - DNA, 479 bp, Homo sapiens
agttagagaacattagcagcagcaaagtggttatctcaaaacagatacataataacttcttagtgatctgcacccactgtgtgtggcccattcattacaaggcaccaaagctttagcctattgtgtttaattcccttaaagttcatgtgactgtcaattcctgttatccacaatttagagaaaaattagaatgcttgaggaaacaaattttgaagtgaccaattttattgtaccttaatgccctgtcacatggctttgcttagttcactaagggaaaaaaaatgtgtgagaccttggtgttttatgtcctactgtaaataattatatcgatttgaataacatctggaaaaatcttgaagccctttacttgaaatgattttatgaacaggcactacattcactcaaccactttagtagtgtcactagtgtgatgaaatgtggctgtgaaagacctgagacataatcatttggatagccag

SEQ ID NO: 11155 - DNA, 493 bp, Homo sapiens
cttgagattataaaaatatttaattatatttcttctagtacttttttggacttaaaaaaaataagttgttaatatagctgaatttatttgatgtgggatttgtagtagggaatcatatttcccccaaatgcctagccgttgtactatcacttattgagaaatatacttttcctactgaattaaaatgtcacctgtaatataataaattaaaatatattaatgactggatctctttctggcctctcctgttttgtgaccagtgccagggtattcttatttctattttagcatttaagtgagatatagtgtatttaaatacctaaatgatctttgtgtaaataagattttaaaggtttaawatgaagcatagtgtagatttattagtttagttctacccatatctccttactgagtttactcccttcttatgcttaagacaagcatttccatttcaaagcaacaaaaataaaatacggtagcccacataagcagg

SEQ ID NO: 11156 - DNA, 476 bp, Homo sapiens
tttgggttatttttcatgtgttcgaatgccaccataaaatattctttttttgtgtgtaatcaatctttttatatctgagaaacctggatattgtaattctagttttggaggtttctgaatatcttcttttgaagtgtttttacatgccacatggagagagatgcaaacacagtcccagttgttccagtaacccaacctagaaatggagtctccttatgttgtcctgacttgtcttaaactcttggcttcaagtgatccttccaccttggcctccccaaaactggaattacagatctgcagcttgcattccctcccaggtggtgttttatgagagtatgccctcataaacttcctgtatgcaaatctgcacgtgagagtctttcttagagcaccagacctaagacaattagtcccaagagaggatcaagaaaacagatcctaaattggaatgctgaatcatcagtaaatgtgaaaaa

SEQ ID NO: 11157 - DNA, 370 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggc

SEQ ID NO: 11158 - DNA, 566 bp, Homo sapiens
ttcaaatgtttttcttctgcaatcatctttgatcttgctgctcagatcctttcccttcctttctgggttcccatagcactttaatttttctctatttatctcaatttgtagtgtgttatactcaattgtccaagtgacccatgtgtcctctggaatcatcctggctttgagattctaatggcactgacttgaatgcccattgatgtgagctgcgaacttggtcttctcctaattagggttttgggggtgggactgtagagaggtgcccattaaaatcacctgtatcaccctctagcacttttatgagttaatttttatactcacttcttttctccaattctaattgcctttaatgatcaagaatgagaatctgattcagggtgtttaaaataaattattatggaggattttaacttttttgtttagttggtttatattttctacactttctgtacggggcatgcgttgcttttatacttagaaaaaagtattatggctgggcgtggtggctcacacctgtaatctcagcactttgggaggctgaggcaggtggatcatgaggtcaa

SEQ ID NO: 11159 - DNA, 293 bp, Homo sapiens
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaa

SEQ ID NO: 11160 - DNA, 505 bp, Homo sapiens
agaaaactggtctcagggaaagagtagggatggagaggctgccttccacataaaggtttttaaaatctgctgtcaaatccccagatgaaataattaggtagacatttgagaacatgaaacacttgtgaccaaatcgtatgtattttcagaatgaaagcttgtgtgagaggatcagtttggcctaagttatctaagtaatagtttctcctttcacttaaaatactcagactcaaagtgtactaatcatttatataaaaatattttttagagcaaataagggaaagacaaaaatatcaagagaaaactaaagccagagtacttcatggctgaattttctttctccacaattttcccctcaaatgctctaactccctatttcattgtttgggataggaatttgtatagtgaagacattgtattctgggaaaaaggtgacttgcttgtgtctctcccatagcctttgstatattgtgcamcttcagtcaattgtttaaccccacgagga

SEQ ID NO: 11161 - DNA, 176 bp, Homo sapiens
attcatttcagttcagtggacttgaaatactgctttttatcttgctagttagagagatttttgagtagttcactaggtgacaacctgccgttttctaagtacgagactagtcaacagttggttattaaagcagaaaatactgctaaaaaaaaaaaaaaaaaaaaaaaaaaaaaaaa

SEQ ID NO: 11162 - DNA, 394 bp, Homo sapiens
atcctaggacacccaccccagcctcctaattggactctctgattctgtcattagtcacactattcttaaagcctctctcattgctcaggcattttctgtcaggagacatcatcagctcagtgccaaatacaaggtgaaggaaaaataattgacctggawttgaaagawtgaaacattgacttcagaatttattcagaccatggcactgtacaatctgatttccaaagcagaagaytaggaccatatatcaactccccmatctctctccaawttaatattcacacacatycactttcaacyttccttttggcgccccttagcagaactattctctttgaaaagaaagttmaccagcagaaytaaactcggtcmagaggawaggaaggtgtggatg

SEQ ID NO: 11163 - DNA, 126 bp, Homo sapiens
tcagatcaactcgtttttataatggtgttgttgtggaactgaaagattggggatgatttggttttttccttggtccacaggtaggtgtcacaattgctttgaaaaaaaaaaaaaaaaaaaggtcag

SEQ ID NO: 11164 - DNA, 460 bp, Homo sapiens
catggaatgttttttcatttgtttgtatccgctctgatttccttgagcagtggtttgtagttctccttgaagaggtcctacactttccttgttagctgtattcctaggtattttattctttttatggcagttgtgaatggttgttcattcatgatttggctctcagcttgactgttgttggtgtatagaaatgctagccatttttgcacattgattttgtatcctgaaatgttgctgaagtttcttaccagcttaaggagattttggggacctggtgtggaaactcacacccgtaatcccagcactttgggaggcgggggtaggtgcatcacttgaagtcaagagtttgagatcagcctggccaacatgatgaaactgagtctctacaaaaattagccaggtgtggtgggtcacacttgtaatcccagctagttgggaggctgatgtgggaggatcactt

SEQ ID NO: 11165 - DNA, 478 bp, Homo sapiens
aaattccaccagatgtacaaagaagagctagtaccaattctactgaaactattccaaaaattgaaatcaaggaggagggactctctatgactcattctatgaagccagcatcaccctgatatgaaaacctggcaaagaaacaacaaaaaagaaaactacaggccaacatccctgataaacatagacacaaaaatcctcaacaaaatacaagcaaaccaaactcaacagcacatcaaaaagttaatttaggctgggtgcaatggctcatgcctgtaatcctagcactttggaagaccgaggcaggaggactccttgaacccaggaatttgagaccagcttgggcaacataggaagaccccatctctacaaaataattagccaagtatagtgatgtgtgcctgtagcccagctactcagaaggctgaggtgggaggatgacttgagcccaggaggctgaggctgcagcaagccatgttgg

SEQ ID NO: 11166 - DNA, 80 bp, Homo sapiens; identical to SEQ ID NO: 10797

SEQ ID NO: 11167 - DNA, 311 bp, Homo sapiens
ttcttatttttttttggagataagcccttactctgttgcctagattggagtgcagtggcamcttcatggctcactgcagccccacctcctggagctcaggtgattctcccacctcagctttctgagtaactaggacttgagtgcacaccaccatgcctgactaagctgttctttattcttgtttgtttgtttgagtgaractctccatcacccaggctarattgcagtggcagggtcctatctcagctcactgcaaccaccgggtcctgggttgaggcgattcttgtgcctctgcctcccaagcagctaga

SEQ ID NO: 11168 - DNA, 488 bp, Homo sapiens
attcgtgtaattgttaatatctcactttcttggaacatcctaacttcaacctctgaaggaaagggattggcactcaaaggactcaaaaagccctgactttgcttcccatcctggggaagtcagagcaaatcacagaccaactgaaagaaggagtttccattaacactgacataggaatctttacaaaaatcttccaatcatatgaggattgcttttgcctagacataagggctacaaaatgcctacacctggccaaagggtctaaattgctccagcagccaagggggaaatcagcctgacccatttctaccaaatattcttattctcagcaaatctacaactgatgagtgggacatctatggctttaaggagagtctgatgtgtgaattgtagcttgaatttgtattaacattctcatctgccagccacttcctcagctgccggaggatctttgcaccatcttttccaccctcagttatgtggccaca

SEQ ID NO: 11169 - DNA, 507 bp, Homo sapiens
gttaccttctcaacatggcgagcttgctggacgtcacgtcgccttcgccttttccgctgcggactctgctcaccgacctcctcagtagagccggccctgctcactaccgcgcccacgtgtcctgttgtgcttcattcccacaggccgcataagataaaccttgctatgctggagattacttaggtaggccaggatttcttgaaaccaaaactttactgaatcacctcttcaccatctgtatgccgtgcatttgctgagagataaaaacattcctgtgaaagatgcccttccctgcaccgggagaaaagaagcattctgcgaccaggagccatagcgaagataattctgtagaaacagaccgtggtaaaataatgcctatcttcctgcagcctccccacgtaatttagttacttttccacagctgcttctttttgctcaacctaatatcaaagcagttaggtattgccatttctttgggtcttcattttcttattcaggctcctgtgc

SEQ ID NO: 11170 - DNA, 495 bp, Homo sapiens
  misc_feature 489: n=a, g, c or t
atacaccctcatccctctatatgagcaaggaaaaaattaagcatgataaaatatatctagagtgttctccgtaagaaagaattactttttagggaaaaaaagtatttattagagccttctatcagctgagagaagagaaatgcccccactgcagaccgcttgtcttcatgcttcacctaaggaggaaaataagatgatgtttgtcttgtgaaaagatatatcgggctgggcgcggtggctcacacctgtaatcccagcactttgagaggacgaggtgggcggatcacctgaggttgggagttcaagtccagcctgaccaacatggagaaaccccatctctactaaaaataaaaaattagccaggcatgttggtgcatgcctgtaatcccagctactcaggaggctgaggcaggagaatcgcttgaaccgggaggcagaggtagcggtgagcaagatcacaaccattgcactccagcatgtgcacaagangtgaga

SEQ ID NO: 11171 - DNA, 309 bp, Homo sapiens
  misc_feature 258,304: n=a, g, c or t
tctacctccagaagtccagacacctcccctgtacctctcgtaccacagaggacaggtctcctccagctgtgcscccactcccctaaaagccttgtattcscccctgcaggttccctctggccccaccaggagaagaagatggcctatgaaaaatcaactgatatctctgatgtctccaggtcaatgttcctgtaccatggctggaatatccagacaagassaaagaactcagaaaagcsatggctcctgttcatctgnccttgtcctgctacbagatgccaaaggaagagtttccsccaagtcnagagt

SEQ ID NO: 11172 - DNA, 529 bp, Homo sapiens
aaggtatttttaccttccttttttgaaaaacttgaaagacaacttacgatttgaaattacctgcatttttgcaatataagcaaccattaattcatgacaagctgctcaaaaatcaattctatatgggaatattccagttacatgtcctgaaatctggcaaacctttgtctcaatggctagaaattatctggctgaggaagtcagtgagccaaactacatggactgttctaacctcattcttccaagtaaaatcagaggcataaaaagattctttgtttctgtttttcacactatatttctctttttgatctgcttacttagtatagctcttatgtttgtctaagagaatatggcccagatttttatatcagtttaatatttcaccataataaatgttttctttagaagacattcttgtccataaactgaaattcaaaccacaaaaggaaaagtttattaagaacaaagtaaacttggtcagaaatacactaactaattttattaataaaaattcgaaaaaaaaaaaaaa

SEQ ID NO: 11173 - DNA, 482 bp, Homo sapiens
ctcctggctccgcccaccgcagtccgctcttatttccggagtggaagagaaatggcaccttagacccttgctggggatagttactgaaaggggcacttttttcttttacagcccataaagagcgctttcccagatgtggtctccctgtgttgcccaggctgctctggaactcctgggggaaagtgatcctcctgcctaggccttccaaagtgttgtgattacaaacgtgagctacctgcctggccaaggatctggaatttttgttgttaacactccaggaggaaacctggctgaggataatgactgagattacttattgtaagagaaggctgctgaagtttagaaaaacacacctatccaccatcaggcgggccactggcttcacattcttcttttatctaaaaaattgaggcctccatcccagagagatctgtgctaccatatcactaactccaacacagtgactgggtcctaatcaagaa

SEQ ID NO: 11174 - DNA, 127 bp, Homo sapiens
attattacacgcttgggttttgggctcagcacccccacccataaacccgccggctttttgttgcgcctgcgscttcccgcgaatattgaacttcggagtctcaaaaaaaaaaaaaaatgcgaaargc

SEQ ID NO: 11175 - DNA, 391 bp, Homo sapiens
actgttctagacactgattatgttgtaatcttgaataatagttgcccatttatttctgcaccttttgtaaattttgaaatctttgaagatgtaaacctcaccttaattcctattttatcttcatgggccagcacattgctaggcaaaggtaaacaatgttgtggaaggaagaaattgtggaaagagaaaagggaaaatagggtcaaagtttggcaagacttactggagcccctgctgggccctgtgcacccccagagcctcgatctcctctggctcctttaaggcctggaagcaattgagaccccatggaccaggtgggcctggttccccgggtggtccagtgttgggaacaccaccgtcacaagcacagaaacctgagtctcctgggaga

SEQ ID NO: 11176 - DNA, 282 bp, Homo sapiens
ataaattagctgcagaccttgatgactatttcatctcctagaataaatgaagaatacagtcatacatcacttaacaatgggaatatgttctgagaaatgctttgttaggcaattttgtcattatgcaaacatcacagagagcacttacacaaacgtaggcggtgtagcctactagataactaggcgatatgatagagcctattgctcccaggccacaaacacgcacagcatgttactatagtgaataacgtaaggaaatggtaagtatttgtgcaataggaa

SEQ ID NO: 11177 - DNA, 437 bp, Homo sapiens
cacattctgagattttaggcaaacatatctttggggggccaaaattcaatcccctaatccatgttagtaaccatgcagtgttccttcttatttctatgttgaccttttcagctctttctatttattgttattatttttgagatggagtttcaatcttgttgcccaggctggagtgcaatggtgcaatcttggctcacggcaacctccgcctcccaggttcaggcgattctcctgcctcagcctcctgagtggctggtatgacaggcatgcaccaccatgcccggctgattttgtatttttggtggaggcggggtttcgctgtgttggccagactggtctcgaactcctgatcttgggtgatctgccctcctcagcctcccaaagtgctgggattagaggcgtgasaccatgcctggccagctctttctaactaaaaa

SEQ ID NO: 11178 - DNA, 122 bp, Homo sapiens
acagtggcttctcagcctcccctggcccaactgaggctgttgctagatatgtttttcctgtatcaggtggttcatttctttttttctttttttttttgcctcttgatcttttttttcttttg

SEQ ID NO: 11179 - DNA, 522 bp, Homo sapiens
tcattagtagaatttcaaaattttatattattatctatcaatgtctaacccaaataagtcactattacgcctagatgtataaccaaatcatcaaaaacttgaaccgattgttcaaatctaggaggtaacttaattcaatgtttgacattggtatttgactatataacctattccgagtctcatacaatgtaactgacactagatagttcaaattagtcaaaccaatttaagtactgcgtcaaacaagcagatatccactttataaatatctagcctaacattttggaaactctttgctggtatgaacattcaggcaacattttcagcctttaactacgattatgatacaatggttataccactggattttatcaattattagaattatatgttcaaatgcttggtaattcctgaatgtgtaatgatgaccatcaagctttactgaatttcctcgaattttacagatttattttatattcacactttaatacatatttatttaaagattactatctgcaagac

SEQ ID NO: 11180 - DNA, 137 bp, Homo sapiens
attctcttgcctcagcctcccgagtagctgggactacaggcacccgccacctcgcccggctaattttttgtatttttagtagagacggggtttcactgtgttagccaggatggtctcgatctcctgacctcgtgatc

SEQ ID NO: 11181 - DNA, 386 bp, Homo sapiens
  misc_feature 19: n=a, g, c or t
aagagttctcttctcagangggcttcgcaacagacttttgtcactaaaagcccaggtgactccccagatgcttacggatattaaaaccgattatgctgaaggagtggaaggagagtcaagtaaaagaagaagatcaagtaaaaagaactggggaacagtgactttgtttccccttattgtacctcctttctccttttgtgctttcctggaaacatcgaatttcaaaaagaagcttacaaagtccaccatacagcttgcaggtctgaatggaagtcaacagtttatatttgaatatttgatggaagattgctttcatggcttatgatattaaaaacagcaasaacaaaaaaaccattcttatttccaagaccagaaacctcccgtgt

SEQ ID NO: 11182 - DNA, 473 bp, Homo sapiens
  misc_feature 418,421: n=a, g, c or t
acggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcagagtaaaaatacagagtcagcttgtgatggcattccctcaaaacatggaaggaattgcagtaatgaaagtcatcatgtattctaagagactgttctgcgagasacaacacagacggggctaaagcagggattgtctaagcccagtgtggaggaaccatcaaggatttcagcacgtttttttagccattgtgagaagcaaaagtgctcaggagttaagagaagcagacgtccgaaattatctccatgcattaccaaaaaccgtgggcacmgngcnacggggaaaacttaccaggtacaatgagccagtgactgttactgaatttctt

SEQ ID NO: 11183 - DNA, 278 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaattttttgaatttttagtagagagtgggtttcactatgttggccaggctggtctggaacgcctga

SEQ ID NO: 11184 - DNA, 478 bp, Homo sapiens
ctttttgcttagtacgcttttctgctattcctgccgcataactctctcttccccaggcttttcccatctccatcctattctctcgcaggcaggtttttcttccgcctctctggggattttcgcgttggttctccctgcccccaggagtgaggctggtaacgcccacgcctacctccggtgctgggggaaaagattacttcccagatgcagtatttacatctcctccgccctactcttccaaccctgcctgaaataagtgtggttctcctgtctgtcagactatgaagagttctcaaatatgtctttcccagcgagggagaggagagtgagtatccaggaactttaatgcgataggacatcaatatgagtgtttatagggaaagccagtgatcctattgttagacgcgaaatcaagacatatgatctgattttttgttttactttttgtttttgaggtataacattcagtaaagcgcac

SEQ ID NO: 11185 - DNA, 518 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcaccaccaggcctgccttacaagagct

SEQ ID NO: 11186 - DNA, 307 bp, Homo sapiens
agatcagatgtatttgaatcagaatggcacacagggcccctgaattggttggcagagcctatgggactgctccaagtgaagggaatctccatgaagacaattatccaagagaaatagcctatctcagcaggcatcgttctgctttgcttattgagccaacatttatgaagcatagacttcataccgagctcaatgcaaacagactcacctctagcaaggctcaagggaggcaacaaaagaaatagaaaacacggcccttgtcaacaaacctaggattaagttggagtggccgggcgaatatactgag

SEQ ID NO: 11187 - DNA, 502 bp, Homo sapiens
aacgcaaatcatcctgaaagcaacaagaataatggttgtaataattgtttccaggcctgggaccctgcatcttgttttttaagttgacctgatgaactagtaattgtaggaataaactgaatgtttgccagcaggagtcactctaggcttcctaataaaacgttagtaaattaaactctgtccttaaagctctgaaaggctgaggtgattgtgtgatatcagatggctttagggaaacactgactcttttcgttaagcatagcagcattcttagattattccttgggccttcttttgttcaccatcggttcttggatcttgttcctttcaagattggtccttaatgcatttttaaaaagcaacgtatatgggtaaggatatcaatatcttagtatgctgtattctgtatgttagctcattttggctttctaggatgaactgactctatcccacatcatgtaacttgaaatgaatagactcatatccttttccactgattgct

SEQ ID NO: 11188 - DNA, 408 bp, Homo sapiens
atcatctcagccaccttttttcacatgcaacttgttaaacgttgtccaaggatgagatggaatgaaatgacacctttagtgtacagataacatggacggaagttctgttgtaacaaggctcactgtttccaaaatcaaatcagtgacaaaaccatgagatcataggatttggaaggtgaaaaatcatagcattcaggactgcaggtgccaccagctaattgggctcactgggctctgaaactgcaaggaggtgctgtgacaagttactgagaaccaagaaactttggtaacccctgaaatttggtgaaaaaatgaaatcaaaactgtgtaaatacagtcaacaatctcaccctttcgtgtatgtgtacgcacatgtgtctgtgttaaaatggtgtaaaawatacacca

SEQ ID NO: 11189 - DNA, 488 bp, Homo sapiens
aagtaagtgatgattgttttggcttctgcagtagcctcattgatgatctgccattaagaagctttcaacaagcaaatttttcaaaaacttgaccttctgaaaggaggtgcccacagctcataacctacctgaggttatttgggtctcaggaaacacacagcacgtgccaatgttccaagaatgaagctctggttcccagcttctgctgctccaacttctatagcagcaaggagaaaagagtaacagacatactgatcacatctaattagaagggaaatctcccagatgcagtcaatgtgtgaaaaccaatcactagaaaggaaagaaactgcccttcctttaaggaatgtggaatctttccttttgaagatcaagatttggagcccataatcctgtggatggatgacgccaacattcagctctgckcttattccccataatttctccgcttgacctgtgacgaatcagcttctgcctttccaggggac

SEQ ID NO: 11190 - DNA, 461 bp, Homo sapiens
  misc_feature 204: n=a, g, c or t
atggatgtggtcgtctccctggtcactatcatgttggacacgggcctgccctgttttcgcggccaatcaagttcttgaagcacaggtttagccccaacatgactgagcgcgaggctgcaaatttcatcatgaaggtcatccagagctgcttcctcagcaacaggagccggacctacaacatgatccagtactatcagaatgacntcccctactgaggaggggaccttcgagggcctctgcccatgtgcccttgaagctgccccacaatcatggagccctgcrcctacccgscctgccgccacatgcagtggaggagaggcctgtggccgaagagcctggtagcgcctcctggggcagcacgtgggtggcgcaggcttagtaacgccgtggactgcagcgacaatcagtggatggtgctgtctatgcacaggtgtgagtcctctgtttgcactggacatatt

SEQ ID NO: 11191 - DNA, 428 bp, Homo sapiens
aagtaggaatatgccaagggaaaaagatgggaaaagcactccaagcagaaggaagattgtgtgcaaggatacaaaggcttaataaatacgtcacttccagacaactacaagtagttcacagctggtacacagaagatggtgttagaaaccaagacctgggtgctacgtgtgcttgttgctacaggggtgtcgtttccagatcccttcaactaacagagtgaggttcctcactttcggctagcccacagtctacctctagcaattcatcaaaattatcatttaattaccgaagttatcagtggsttctaatccaggggtcagatcaacatcacaactgggtagtgctctcagcctcstssatctsstgstscttctscttcacaagcatttttcccccaataaatcssttgsacatctaatcgcaaaaa

SEQ ID NO: 11192 - DNA, 80 bp, Homo sapiens; identical to SEQ ID NO: 9659

SEQ ID NO: 11193 - DNA, 130 bp, Homo sapiens
aagaaggagtgtgctagtaagtgtgcacgtacgatggaaaatgaatgaagaatgaggacattccaccactctccaagttatcaagatgaagacccaagatggtggcattcactctgaagggagatgtccc

SEQ ID NO: 11194 - DNA, 83 bp, Homo sapiens
attttgcatttccaccagcaatatatgatagttcgtttatttcacatctttgacagcatttagtgttgtcagggttttttttg

SEQ ID NO: 11195 - DNA, 139 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctag

SEQ ID NO: 11196 - DNA, 470 bp, Homo sapiens
  misc_feature 414,465: n=a, g, c or t
cataattattactaatcacaatgaaatgaggattataggaatcataattttggaatacatatttacatttatataaatataatgcaaagaaaattcaacaccattttgtatttgacaatgttttctgtgtggtcaatataccaaataaggcaaatacgtcttttggagttcagcggacccaatacttaaaaggttaattaggtagaaaaaaaaaagacttaatttacaatttgatttttcaaagtttttcaaatattaaaggtttaaaacacttcatatcacaaaatggaatcccagataaccacacatcatttatttagaaaataactcawtttcaaaaagtcaaaaatctctactcattgatagagaagggagactcatctctccaaacaagaaccattaaagacagcwtgnggccgaccacatctgtctcttctctctcggtgtttttcagtttatttarwnggcga

SEQ ID NO: 11197 - DNA, 391 bp, Homo sapiens
ataatgctctccgcgacggaatgcgcaatcgccggcgacggctccggcacttcgctctgtgaagtaccattagccgcgggaatatcagtatgtgagaacgtggccatggacaagaattccaagtagtggcacttctgtagacgacgcggcccttttggggttactacagcccaggaaactcacatgcgacacggcgccastgaagtccatctagacccccgcagacccaaggtcacaagttgagaaccccctgccgtggacattcttctgcacctagtggtgaagcaggtggagctgcaccttgctccgcccatttggagactggttctgcacatatgagtgtgccctgcagcgatcctgcaatccttcgtgactaacaaggactttctgt

SEQ ID NO: 11198 - DNA, 104 bp, Homo sapiens
aaaaaactggtttggtccgcttccacgctgttggaggtttgttcttttgctgtttgcaataaatcttgctgttgtttgcaaaaaaaaaaaaaaaaaaaaaaaaa

SEQ ID NO: 11199 - DNA, 55 bp, Homo sapiens
attcatttcatgggtagagaactgaaacccagagaaaatagaaatgccaccacct

SEQ ID NO: 11200 - DNA, 499 bp, Homo sapiens
tttactcctcccacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaaactttaataaaacttta

SEQ ID NO: 11201 - DNA, 307 bp, Homo sapiens
agttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaac

SEQ ID NO: 11202 - DNA, 492 bp, Homo sapiens
atatagcaagttgactattcaaaccaaaaggcctccagttgaagttgtgttttaatttaagcactagtagggcccagcaaatcaaatattgaaagatgctaaaattagtctgattactttgtgagtcatcaaattgatttgactgtccttgcccttcatataatgtcccaatagacacttaacctgactctacttccttgaatttggcaaagtaagcacgatcattggagttactgcttttgggattatttatttatcacatcacctctgccatcattacttcccactcgtctttgtttggcttactttctactgtgcttctctctatcaaatctttgcacctccttaggaagatctggaagtcacctctctgtaaatctgagaagttattttcattgttgttggatgataatgcttaagccagtgttggaggctgcacaagtaaattacatggttttagaagcacctcctccttccatctgtgctgtttgg

SEQ ID NO: 11203 - DNA, 494 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaacaagcaaatgctgagagattttgtcac

SEQ ID NO: 11204 - DNA, 68 bp, Homo sapiens
acatgacgctcaggtccgggtggccgcggcagcgcgsgccagctcgcactcgtcgcgattcagcaaac

SEQ ID NO: 11205 - DNA, 515 bp, Homo sapiens
cctttttctccaatcgcatgaagccgccagtcgtgcttcctaagtgaatgccgtctatggagcagagctggttgccaactcttacaccagctgactccacctcgggatcacataggaagtccaccaacaccactcaagaagggatggcagagtgaggacttcttgtatccagagattctggggcctttatgccttggaattcattgcggtcgagtgggcatcacacacttcctattttggcgtcgtaaatatgcaacatgtcccggactctttctacaaacaaaaaataaacacaaaaataataacagttaaagtgcctgggctgcagaaatgcgacgttagcctctgaatggaccttgagaagaactggggggaaaattctggccttagaacacagctctttttawatccttaaccacagaagagctccctctgtctgggagaatggcttcttcagttgagcacacagtgggacagctgtaggagtgtgctgagcccaaacacatcagtaacgt

SEQ ID NO: 11206 - DNA, 108 bp, Homo sapiens
aaaaaaaaasaaaacaaaacaaaacaaaaaaaacacgagtttttaaagargggttgatccccagtcagagtcatctgggaatggagagttcccaggagaaacaagagc

SEQ ID NO: 11207 - DNA, 108 bp, Homo sapiens
gattggctgaacaaatagtccgagggtggtgggcatccgcctcccgacaaggcagaccaggccccctgcaggtcccctatccgcaccccggcccctgagagctggcac

SEQ ID NO: 11208 - DNA, 381 bp, Homo sapiens
actcctcaacttaccccaggcagaaaaacagaagacacccgtcagaatgaaggcgtccagctactgccatcaaagaaacagcctccttcaataagccactttggagaaaacatcaagcaattttttgagacgattttttcaaagaaagaaaggaagccagcaccagtcactgctgagagccaaaaaacagtaaaaaacagatcatgcgtgtacggcagcagtgctgaagctgagaggctcatgacagcagttggacagataccggagagaacatgtcactttgccatgcgcgccatgcctcgaaggtaaatcagcaaagacagcagtttcaagccccagtctgtgggtttccctgcaaccacagacacccgttctactcag

SEQ ID NO: 11209 - DNA, 205 bp, Homo sapiens
attcattgsccctgtaacctgtcaaagaagagctaagggagctttcggggttggcttcttggaggctgctttctcctttacttggaaggcttcgctagtgatgtacccatacatgattcagatgagcagcaaaggcaacctcccctcaattctggacgtgcatgtcaacgttggbgggagaagctctgtgccgggaaaaatgaaa

SEQ ID NO: 11210 - DNA, 96 bp, Homo sapiens
actcacaagcttctcggscccgaccttcgccctgggaggktctggccaggtgccgggaggggcgctgtgtccagggcgawccccccaaagcagcgk

SEQ ID NO: 11211 - DNA, 257 bp, Homo sapiens
acarrtatttaccgccgcgcggagagtgagggcccaagtccgccctgctccgccacttaggccgccccagacgcttccctcggggctgccaccgggtcgggcgcggctgccgcggctcgcgggccttccccgcaccggcgcggcccaaccgccaccgaaccttctggaagcggcggctgcctgggccctcacgccgccagaatcgtacgcccgcgcgagctctctgcagccttggcggcctgggaggcggggctcgs

SEQ ID NO: 11212 - DNA, 247 bp, Homo sapiens
actgtggtcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttc

SEQ ID NO: 11213 - DNA, 201 bp, Homo sapiens
aachwtgttgctgctggagatcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggc

SEQ ID NO: 11214 - DNA, 381 bp, Homo sapiens
caaatataagatttttcattttgataaatccattttatcattcttttataatttgtgcttaagaaatctttgtctaatttggccgggtgctgtggctcacgtctgtaatcccagcagttttggaggccgaggctggcggatcacttgaggtccagagttcgagaccagcctggccagcatggtgaaaccccacctctactaaaaatacaaaaaaaattagccgggcgtggtggctcatgcctgtagtcccagcttcctgggaggctgaggcaggagaatggcttgaacccgggaggtggagtttgcagtgagccgagatcacgccattgcactccagcctgggctacagagcaagactctgtcccaaaaaaaaaaaaaaaa

SEQ ID NO: 11215 - DNA, 285 bp, Homo sapiens
gagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttc

SEQ ID NO: 11216 - DNA, 251 bp, Homo sapiens
tcatgataactaggtcaatacacaccattatcaaggttacattcatgaaagccttttaactggtggtggacatgagataagaatgggaacctctccagcaagcatccttttttgaatatttttaggtgcaaatttcttcattctgtatagcatttcagctcatcttctgttgaagacagaatttgctgccagggacctaccaaaccatactcagcccaagcagcatctstaaggcaaagaactttgcctgt

SEQ ID NO: 11217 - DNA, 207 bp, Homo sapiens
  misc_feature 24: n=a, g, c or t
atrtstrtcactcccccatctcanatatcccccctaatcctggataccatttgttgaaagatgttattactctagctgaacttacaagagactttagaccagggatctaaattacagtggccttagtgaccttgtccttatcttcttaggacagctgagaagccactgggacttagagcctttaaaaggagattaactgtcccaaam

SEQ ID NO: 11218 - DNA, 334 bp, Homo sapiens
ctccssttcccgctcccaggaacccatccagcctcaggaactgcccccagccatcgagccttggctacttaagggacctgggcccaatccacagctgggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatgcggcccaggaggggctattggctctgcagagtgagctgctcaggatcacgctgcctgacttcaccggggacttgaggat

SEQ ID NO: 11219 - DNA, 245 bp, Homo sapiens
gctccgtcctgcggctgcccactgccctcctacggtccaccatggccctgctgcactccggccgcgtcctccccgggatcgccgccgccttycacccgggcctcgccgccgcggsctctgccagagccagctcctggtggacccatgtggaaatgggacctccagatcccattctgggagtcactgaagcctttaagagggacaccaatagcaaaaagatgaatctgggagttggtgcctaccgg

SEQ ID NO: 11220 - DNA, 235 bp, Homo sapiens
  misc_feature 224: n=a, g, c or t
attgatcagagatgtctgcatgaggaacagaggctgctttgtggattggggagctccccattagcggaggcagagccagatttcacactgagcagctgcagtcggagaaatcagagaaagcgtcacccagccccagattccgaggggcctgscagggactctctcctyctgctccttggaaaggaagaccccgaaagacccccaagccaccggctcagacctgnttctgggctgs

SEQ ID NO: 11221 - DNA, 321 bp, Homo sapiens
catctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtc

SEQ ID NO: 11222 - DNA, 281 bp, Homo sapiens
aatatgatccacttcctcctcagggaataaaggctcagggaccggcagttctactctggagcccaccagcctctcagagcctccggtgactggcctgtgtctccccctggatggacatgtggacggcgctgctcatcctgcaagccctgttgtycccaatgccccattccacacggcccgggaaatggccaatgccaaggagatcgctcggactgtgcakatcctgggtgcagacttcatcctgtctstaggggacaatttttacttcactggtgtgcaag

SEQ ID NO: 11223 - DNA, 306 bp, Homo sapiens
actcttcttttgagacggtctaatgatgcctgggtggtgccttcgtaggatggtcgtcacacctgaacaagggggtccctggccccaggccccatgctttactgggccctgttctgtccctcttctggcatcatctcccatggagaaaagaatgtgttgaagccaagaagatgctccccccgcaagaatatcatctctgctagaacaggggctggagtgtaacggcatgatctcggctcactgcaccctcgacttcctggattcaggtgatcccctcacctcagcctccctagtagctggtgtgtc

SEQ ID NO: 11224 - DNA, 169 bp, Homo sapiens
aatattgtatgtgtggtttgtgtatctgctgctgctttttcaccattgatcacaaggggcagtcatctgattccagggaatagaagatggaggcttgctctggcgyggwtccgctatggaagtgatatagkkcctttctctaaagwggatgaggaacaaatgaaatatw

SEQ ID NO: 11225 - DNA, 260 bp, Homo sapiens
ctagagcggtccttggggagacgcgggtcccagtcctgcggctcctactggggagtgcgctggtcggaagattgctggactckctgaagagagactacgcaggaaagccccakccacccatcaaatcasagagaaggaatccaccttcttacgctatggsaggtaagaaagtactcattgtctatgcacaccaggaacccamkkctttcaacggatccttgaasaatgwggctgkagatgaactgagcaggcagggctgc

SEQ ID NO: 11226 - DNA, 270 bp, Homo sapiens
  misc_feature 55: n=a, g, c or t
aactccgtagtgtgcacttggtgagggcagcagctcgscacagctgscagccatntgtccattcacccatctgtccatctggcagcccgctgttcagacctgtctgtctgtccgsccatytgtaagcccatctctgtcccattgkctatctgaccatctttctcttactggcctctttgtctagctatctggcctatctgtcgatccatcttcgtgtctgtcttcagcccccacctgtttgtccatctgtccaattacctgtgactctgk

SEQ ID NO: 11227 - DNA, 481 bp, Homo sapiens
ttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgktctcattaatgaatacttcctaatatcgktggctctactaatattttccaatttgctgggatgtcacctagcaatagtttggattatatagaaagtaaactgkggkcaatacttgcatttaattagacgaaacggggagtaattatgacacgaagtacttatgt

SEQ ID NO: 11228 - DNA, 318 bp, Homo sapiens
  misc_feature 133: n=a, g, c or t
actatccgtgcggccaggcggaggtgagtgcgcggcggccggatgggcgggacgggcgtggaggacgccgagcaccgtggcgcgcgctyacgttcgsgttcccaarggctgsgctyccthaagcgcagtgccnaraactcggagccagcccggsccgggggaccctgctggccaaggaggtcgtcagtccggtcttgtcttccagacccggaggaccgaagcttycggacgacgaggaaccgcccaacatggcctcggagagtgggaagctttggggtggccggtttgtgggtgcagtggaccccatcatggagaagt

SEQ ID NO: 11229 - DNA, 425 bp, Homo sapiens
  misc_feature 385: n=a, g, c or t
aaccactctgasttggagattaggggctcagacagccgtggatgagagtccagctctactacttattagccttgattagaccgtgagasggatgggaaagactggtgcttggggtggccatctgacccctgatggacaggagaccaggacaagcccacaggatgagccggagggtccaggaggagggagttgagagctcctgctagggttgacacattctggtaaggagttcatctgctgtccaccatgggagacaataaaaaggtcaacacagctcccacctcgaagcagctgcsaktttattacatgaagtgtcaggctgtggactgcaggcatgccattttgtcttcaagaacagaattcccgggcacacgaatgattccanggttcctccagcactttggtattacttgaaagactactgg

SEQ ID NO: 11230 - DNA, 356 bp, Homo sapiens
agttggtgaacttgctgcctccagagaaccttccctggtgtggaggcagccagggacccaggatgctccggacctgttacgtgctctgttcccaagctggtvccccctccagggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcaggcgcatttctccgagcatccgtctatgggcagtttgtggctggtgagasagcagaggaggtgaagggctgcgtgcaga

SEQ ID NO: 11231 - DNA, 248 bp, Homo sapiens
ataagctgcactgcatggttgctgctggatgtgttgtgttcctggcttccctctggatgctgacagaaacaagggaatttctgctgaagtgacaaggcaagccagagccaaagcaggttggacccagcttgtccccacagagacgtgtgcttccctctctctctgagagcgacctgttaaccgsaaatacctggaagtctgggasatggagaacgacccctsgagasgaagagagtcsatctctctca

SEQ ID NO: 11232 - DNA, 407 bp, Homo sapiens
  misc_feature 319: n=a, g, c or t
atccgccccggccaacagggttcagagagcaaaccagtcaggtctcctgaccccaagcccaaggaaaacagacacatgccacccgaaaggtgaagatttttggtttacggatttcttttgttttatttttaagcacgttttgacaacagcattacaatagccaaaagcaaacagcccaagtgtccacggacaggtgagtggatcaacacaatgtggcctagccmacggacggaacgctacgcagccatgaaaaggaaatcctgaccaggctacaacatgggcggaccttgaggacgtcgcactcagtgaaataagccanaaacaaaggtacaaarcctgtgtgactcccctcctaggcrgtccctagagtcgttggattcacagagaccaaaagtggaattgggggt

SEQ ID NO: 11233 - DNA, 62 bp, Homo sapiens
agaagagcaggaggacgtctgagccatgctcgcggcgatgggctctctggcggctgcctctg

SEQ ID NO: 11234 - DNA, 201 bp, Homo sapiens
tagagccctcagtggaatgagggtgaamtgctattgccggcgstcctgttttaccgcgtcasrtgctggtgcatttatttcgggtcgggattcggggtggcccattcccaggcaggctgctaccgcccctccgcttccagacattctcagctgtcaggtactctgatggctaccgcagctcctcsctcctccgggccgtgg

SEQ ID NO: 11235 - DNA, 102 bp, Homo sapiens
agcaagggatggtttaacaaaatgaaggcactcattgcagcactgcttttgatcacattgcagtattcgtgtgccgtgagtcccactgactgcagtgctgtt

SEQ ID NO: 11236 - DNA, 405 bp, Homo sapiens
tagatattgagttcttttaatggatacatccacatgctccaactacaaagataatccatgtttaaaggatgatccaagacatgggaatctcaaaatgccttatgaatcatcagagatcaaacagattgagtcatccaggattatttacattttttatgttgcaatgctttgaaaattggtaatagtatagagttcactccctgttgatgctaacagcaattggccttgacaagcatttcccaaagcctgctttgtggaacactagacctgtggcattctcactaactttaggtaaaacatatacccacatatttccagaatacgttagctcatgcacagcacagtccctgagtgcagaatcccatttatgttctttaccctagtagaatttcctttaatcccttg

SEQ ID NO: 11237 - DNA, 473 bp, Homo sapiens
catattcgtatcatttacttgattttctctttagctgttgctttttttattgattggtaaaaagtctttatgtaataactcctgtcatattttgggaaggtgtagaagttgaaattttaggaatcacagaacacccagaaataatgttcaaagacagcaaaccttgaaaacctataatgtgtgtgtgtgttcacagctccgccgcatgcaagagatgattgcaaggatgcaggcgcagatgcagatgcagatgcagggcggggatggcgatggcggggctctcgggcaccacgtgtaaggtgatgtgcacatatcaagaagtcagaggtaggccctgttgtcccttagcctggaagacaggcagttactaacattgtgtcagcttaaatatgacaggttcctccttaagcctcattaatattttgcattttgaagtaactccatcactaatcttaaacaaggagagattgctc

SEQ ID NO: 11238 - DNA, 362 bp, Homo sapiens
gctcgcggcggcggcgacggcggcgggaggttcggttgtcgcccgttggccgcgcggcgccgcgctcggcggccgccattgcagcttgttttcacttgctttttaaagacaggaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatyctgtatgggaaaatcmtccacctggagaaaccttttgcagtccttgkcaaacacactcctggggatcav

SEQ ID NO: 11239 - DNA, 343 bp, Homo sapiens
atttggtaaactgggtcgtagaccagggaagtgacttggatgagataaactaaggcaaaatctaaagtgatttgcagaactgaggaaagaaacaagatttatgctctaatgctacaggaagaagaaattaatcgcactgcttcaagatataaatggaaagcaaaagcgctacagatcagtaatgttcttacctatacctggatggtcagccacaatggtcacgcgatactctttacagaacacctggtaggccgacatgttcttcttttttggstaatgccgcmtagaagatacamcaggcmscagcmtggatggagcaaagaggtcattatcctgagaaaat

SEQ ID NO: 11240 - DNA, 151 bp, Homo sapiens
atrrggaagaaactcccaacattataaggaatgaactccggacacaccgcctttaagaactgtaacactcaccgccagagtccacgtcttcgtcttcatttttgaagtcagtgagaccaagaacccaccacttccggacatcgtatagcct

SEQ ID NO: 11241 - DNA, 358 bp, Homo sapiens
aaccgtgttgtagaactcggcgatagcaggcacgatggtgtagttgtcctcgcaccagtccacctccgagctaccagcctgcagctggtcccaccagtgcggggcgcccatggccactccggggcattggagcagctgctcgcgcagctgagaagagcccagagctgctgcggaggcaaaacgcggcgacagccagcggcgaaagcggctttatgaagcaccgggtaaccgccggatgtgcgcctcccaactggcctcccgcgctccgccccgsctcgcctagcctgcgggaggttactcgttcgccagaccctccccggcccctccccctggaagccacgcccaccgtggggcgggg

SEQ ID NO: 11242 - DNA, 310 bp, Homo sapiens
acgttgctagtgggcgcggctggcggggccgggggcggyagggggctagcgtccggctgagcccggcgggttcctgcacgcggacccacgctttgtcgggctgctctgctgagtgacaccgccgtggcatccgaggagctgyggtccagcctgcgcggcgggaagcggcggcggcggctccagcgtcctaagagaagaaagaawttgactgatgggcgtaagcaagaaaaagagaccgaggcaagtttcagagaagtartggaagatttttyaaaaaagctgywgaacaagaaagaaagthtgcttggga

SEQ ID NO: 11243 - DNA, 370 bp, Homo sapiens
ccttaattagactcaggaaacaatgggtttttgttgtcgttgttgytgytgatgttgtttttttatatgcagkcttgctctgtcacccaggctggggtgcaatggtgtcatctcgattcactgcaacctccgcctcccaggttcaggcgattctcctgccttagcctcccaagtatctgaactacaggcatgtgccaccaagcctggctaacttttgtattgttggccgggctggtctcaagctcctgacctcaaatgatccacccgcctcagcatcccaaagtgctgggattacaagtgtgagccaccgcgcctggccttgkttttgttttcttatactcataaatagagtgttattgtgggggtgggg

SEQ ID NO: 11244 - DNA, 103 bp, Homo sapiens; identical to SEQ ID NO: 8028

SEQ ID NO: 11245 - DNA, 186 bp, Homo sapiens
acacacgccccaaacgcacctcggcgagcywyycgaggaggaaaactagkggggcagagccctgaaccacctctctttctccataagcatctcaagacttggaaactaagaggacagaccttttcctcctccttcccgccctccttcccacctccgacagacccaagagcaggagcgggggcgccw

SEQ ID NO: 11246 - DNA, 444 bp, Homo sapiens
attggcgagcggctggagcgcggggtttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattatctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgrggdatcttcctgatgaatttacagcaagactt

SEQ ID NO: 11247 - DNA, 374 bp, Homo sapiens
acgtcatcgccgcgcgccggcttgccaggagctgsagggggargtaggcggggcggcgcgtgrcctaaggcctctctgccgcgcgcgcagagccaaggcactgatgtttgamckggaaacttsrmaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgtyatagtttctccctgagttgtaagaggcatggaaatatacatgaaactgaagaac

SEQ ID NO: 11248 - DNA, 418 bp, Homo sapiens
agtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgargtccgtaaaagtcagtcaactgaagaacaccatcaaatctttgaaacaacagaa

SEQ ID NO: 11249 - DNA, 169 bp, Homo sapiens
  misc_feature 169: n=a, g, c or t
aatcagttcccaagttctaggcggaagaggcccaagagacaccactttctcgctttcagacgtgtctacataagaccacaaaagaaaccgaggcaaaaacaaaaaaaaaaaaaaaaaaaaaaaaaaaaaaaaaaaaaaaaaaaaaaaaaaaaaaaaaaaaaaaaaaaan

SEQ ID NO: 11250 - DNA, 467 bp, Homo sapiens
tattttttacattttgctttagaggcagggtcttggtctgttgcccacactagaatgcagtggtgccatcacagctcactgcagccttgaacttctggactcaagcgatcctcctgcctcagctagctgactagctgggaccacaggtgcttagcaccgtgcctggctgatttttcctggtctcattgttgctggggctggccttgaactccaaacctcaggcaatcctcctgccttggccacattttatgttgggattacaggcctgacccaccatacccagcctaatactatttttaaaaacaaaaagtaggaaatcaattttccttttaaatgaacactaaattataagaattaacttgggtaatctatgcaacattctcactttttttttttttttgagatggagtcttcctctgtcttccargctggagtgcartggtgtgatctgggctcactgacacggs

SEQ ID NO: 11251 - DNA, 288 bp, Homo sapiens
gacwwgasscatcctactgaaagggagcagaggaagaggacagagacattttctttcttttctttttgtggacgcaacggcatgtgcctgtartcccagctacttgggaggccaaagcaggaggatcattckwagtcagaagtttgaggctgcagtactttatgatcacacctgtgagtagtcactgcactccagcamaggscaacacagccaaagaccctgttcctttaaaaaaaaaaacamcmcaccaaaaaaaaaaacccaaccaaccaaaaaaaaaaaaaaatk

SEQ ID NO: 11252 - DNA, 250 bp, Homo sapiens
gacggcttctggcgggtggcggtgttgawggcgaragcttgcttggcccgtgtcgcttctgtcccaataayckgacggwgagtgagggcackagggtcsctgtcgggggctgtcgtmttccacgtacacgtcgtcgtgaggagcgcagtccggactcttcccgcaacccctccggctccctttccgcacgcctcgaggcggcggcggccaccgagacagcagcgcaccttcccccatcccttccccttat

SEQ ID NO: 11253 - DNA, 219 bp, Homo sapiens; identical to SEQ ID NO: 9948

SEQ ID NO: 11254 - DNA, 74 bp, Homo sapiens
cagacactgtgctaggagaatggaaaacaattttgaacaaaactgtctacctacatgattttttttttttttga

SEQ ID NO: 11255 - DNA, 219 bp, Homo sapiens
atgaagtaggaagatgaagccaagtcttatcgccacatctctagtatattaagattatatatggccaggcacagtgattcatgccwataatcccagcactttgggaagctgaggtgggaggatcacttgaggccaggagttcaaggttgtagtgaaccttgatcacagcactgtaatccagcctgggtgacagaggagtgtcccaaaaaaaaaaaaaaa

SEQ ID NO: 11256 - DNA, 56 bp, Homo sapiens; identical to SEQ ID NO: 9962

SEQ ID NO: 11257 - DNA, 72 bp, Homo sapiens
cagacactgtgctaggagaatggaaaacaattttgaacaaaactgtctacctacatgatttttttttttttt

SEQ ID NO: 11258 - DNA, 447 bp, Homo sapiens
aaggagctggagggggaggtaggcggrgcggcgcgtgacctaaggcctctctgccgcgcgcgcargtacggggcagaagtcgcagagccaaggcactgatgtttgaactggaaacttcaaaacgtttaataagagtcttcaggatgggtttgaactagacaagctagaaatttcttwagaacaccagctctagcatgcatctcccacttttggctttcctggagaggagcttgaagaggtggttctgcagacagccacagtgatactcaggaaaccagaggaatggatttracttttctgctaggattctttgttatagtttctccctgagttgtaagaggcatggaaatatacatgaaactgaagaacctgcaagaagggaagtggaactttccatgctgagtgaaaactaaccacgtggcagttgtgactgaaaacacttraacc

SEQ ID NO: 11259 - DNA, 219 bp, Homo sapiens
atgaagtaggaggatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaaaaaaaaaaaaaa

SEQ ID NO: 11260 - DNA, 219 bp, Homo sapiens; identical to SEQ ID NO: 9948

SEQ ID NO: 11261 - DNA, 219 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaaaaaaaaaaaaaa

SEQ ID NO: 11262 - DNA, 282 bp, Homo sapiens
gacaagaggsatcctaggaaaagggagcagaggaagaggacagagacattttctttcttttctttttgtggacgcaacggcatgtgcctgtagtcccagctacttgggaggccaaagcaggaggatcattcgaagtcagaagtttgaggctgcagtactttatgatcacacctgtgagtagtcactgcactccagcacaggcaacacagcaagaccctgttctttaaaaaaaaaaacaaaaaacaaaaaaaaaaamcccamccamccaaaaaaaaaaaaaad

SEQ ID NO: 11263 - DNA, 219 bp, Homo sapiens; identical to SEQ ID NO: 11261

SEQ ID NO: 11264 - DNA, 219 bp, Homo sapiens; identical to SEQ ID NO: 9948

SEQ ID NO: 11265 - DNA, 73 bp, Homo sapiens
cagacactgtgctaggagaatggaaaacaattttgaacaaaactgtctacctacatgattttttttttttttg

SEQ ID NO: 11266 - DNA, 224 bp, Homo sapiens
gwcwagaggcatcctaggamagggagcagaggwagaggacagmgacrttttctttctkttctttttgtggacgcaacggcatgtgcctgtagtcccagctacttgggaggccamagcaggaggmtcattcgaagtcagaagtttgaggctgcagtactttatgatcacacctgtgagtagtcactgcactccagcacaggcaacacagcaagaccctgttcttt

SEQ ID NO: 11267 - DNA, 399 bp, Homo sapiens
  misc_feature 280: n=a, g, c or t
tattttttacattttgctttagaggcagggtcttggtctgttgcccacactagaatgcagtggtgccatcacagctcactgcagccttgaacttctggactcaagcgatcctcctgcctcagctagctgactagctgggaccacaggtgcttagcacgtgcctggctgatttttcctggtctcattgttgctggggctggccttgaactccaaacctcaggcaatcctcctgccttggccacattttatgttgggattacaggcctgacccaccataccnagcctaatactatttttaaaaacaaaaagtaggaaatcaattttccttttaaatgaacactaaattataagaattaacttgggtaatctatgcaacattctcacttttttttttttttk

SEQ ID NO: 11268 - DNA, 168 bp, Homo sapiens
tatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctctctcttaaaaaaaar

SEQ ID NO: 11269 - DNA, 219 bp, Homo sapiens; identical to SEQ ID NO: 9948

SEQ ID NO: 11270 - DNA, 219 bp, Homo sapiens
atgaagtaggaagatgaagccaagtcttatcgccacatctctagtatattaagattatatatggccaggcacagtgattcatgccwataatcccagcactttgggaagctgaggtgggaggatcacttgaggccaggagttcaaggttgtagtgaaccttgatcacagcactgtaatccagcctgggtgacagaggagtgtcccaaaaaaaaaaaaaam

SEQ ID NO: 11271 - DNA, 228 bp, Homo sapiens
gwcaagakgcatcctaggwwaggkagcagaggaagakgacagakacattttctttcttttctttttgtggacgcaacggcatgtgcctgtagtcccagctacttgggaggccaaagcaggaggatcattcgaagtcagaagtttgaggctgcagtactttatgatcacacctgtgagtagtcactgcactccagcacaggcaacacagcaagaccctgttcttaaaaa

SEQ ID NO: 11272 - DNA, 219 bp, Homo sapiens; identical to SEQ ID NO: 9948

SEQ ID NO: 11273 - DNA, 219 bp, Homo sapiens; identical to SEQ ID NO: 9948

SEQ ID NO: 11274 - DNA, 219 bp, Homo sapiens; identical to SEQ ID NO: 9948

SEQ ID NO: 11275 - DNA, 189 bp, Homo sapiens
tatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctctctcttaaaaaaaaaaaaaaaaattaaaaagcaaas

SEQ ID NO: 11276 - DNA, 219 bp, Homo sapiens; identical to SEQ ID NO: 11261

SEQ ID NO: 11277 - DNA, 219 bp, Homo sapiens; identical to SEQ ID NO: 9948

SEQ ID NO: 11278 - DNA, 118 bp, Homo sapiens
aacacgggaacacccacctttagagatgagacacaagcaggagaagagggattaaacctgctagttttggaaaaaaaaaaaaggaaagaaaagaaaagaaagaaagaaaaacaaaaaa

SEQ ID NO: 11279 - DNA, 469 bp, Homo sapiens
ttgattttatccatttatatgtatgtgaaatctttgattatactgtcacatgtcccctgaggctctgttcattttttatttcctttctgttcttcagattggttaatttctgttgttccgtcttcaaatatactgattctctgcccctccattctgccattgagcctatccattgaatgttttttgattttttaaaaaaattctatttggtactactttgcatcttcagtttttggctgagacattctaatttgtaactcacttttaaaaatttgtctctatcgtgttcttaattgctcattgaaattgtttgggccaggtgcagtggcttacgcctgtaagcactttgggagaccaaggcaggcagattgcttgagctcaggagttcgagaccagcccggccaacgtgggaaaactccatctctattaaaaatacaaaaactaggccgggtgctgtggctcacgcctt

SEQ ID NO: 11280 - DNA, 207 bp, Homo sapiens
atgaagtaggaagatgaagccaagtcttatcgccacatctctagtatatyaagattatayatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaam

SEQ ID NO: 11281 - DNA, 219 bp, Homo sapiens; identical to SEQ ID NO: 9948

SEQ ID NO: 11282 - DNA, 136 bp, Homo sapiens
aacacgggaacacccacctttagagatgagacacaagcaggagaagagggattaaacctgctagttttggaaaaaaaaaaaaggaaagaaaagaaaagaaagaaagaaaaacaaaaaacaacaacaaacagaaaaa

SEQ ID NO: 11283 - DNA, 206 bp, Homo sapiens
atgaagtassragatgmrgccaagtcttatcgccacatctctagtayaytmagattayayatggccaggcacagtgattcatgccwatmrtcccagcactttgggaagctgaggtgggaggatcacttgaggccaggagttcaaggttgtagtgaaccttgatcacagcactgtaatccagcctgggtgacagaggagtgtcccam

SEQ ID NO: 11284 - DNA, 219 bp, Homo sapiens; identical to SEQ ID NO: 11270

SEQ ID NO: 11285 - DNA, 206 bp, Homo sapiens
atgaagtaggaagatgmagccaagtcttatcgccacatctctagtatattaagattatatatggccaggcacagtgattcatgccwatratcccagcactttgggaagctgaggtgggaggatcacttgaggccaggagttcaaggttgtagtgaaccttgatcacagcactgtaatccagcctgggtgacagaggagtgtcccar

SEQ ID NO: 11286 - DNA, 219 bp, Homo sapiens; identical to SEQ ID NO: 11270

SEQ ID NO: 11287 - DNA, 111 bp, Homo sapiens
aacacgggaacacccacctttagagatgagacacaagcaggagaagagggattaaacctgctagttttggaaaaaaaaaaaaggaaagaaaagaaaagaaagaaagaaaam

SEQ ID NO: 11288 - DNA, 219 bp, Homo sapiens; identical to SEQ ID NO: 11270

SEQ ID NO: 11289 - DNA, 219 bp, Homo sapiens
atgaagtaggaagatgaagccaagtcttatcgccacatctctagtatattaagattakatatggccaggcacagtgattcatgccaataatcccagcactttgggaagctgaggtgggaggrtcacttgaggccaggagttcaaggttgtagtgaaccttgatcacagcactgtaatccagcctgggtgacagaggagtgtcccaaaaaaaaaaaaaam

SEQ ID NO: 11290 - DNA, 74 bp, Homo sapiens
cagasactgtgctaggagaatggaaaacaattttgaacaaaactgtctacctacatgattttttttttttttga

SEQ ID NO: 11291 - DNA, 136 bp, Homo sapiens
aacacgggcacacccacctttagagatgagacacaagcaggagaagagggattaaacctgctagttttggaaaaaaaaaaaaggaaagaaaagaaaagaaaraaagaaaaacaaaaaacaacaacaaacagaaaaa

SEQ ID NO: 11292 - DNA, 219 bp, Homo sapiens; identical to SEQ ID NO: 11270

SEQ ID NO: 11293 - DNA, 219 bp, Homo sapiens; identical to SEQ ID NO: 11270

SEQ ID NO: 11294 - DNA, 206 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaa

SEQ ID NO: 11295 - DNA, 136 bp, Homo sapiens
aacacgggaacacccacctttagagatgagacacaagcaggagaagagggattaaacctgctagttttggaaaaaaaaaaarggaaagaaaagaaaagaaagaaagaaaaacaaaaaacaacamcaaacagaaaaa

SEQ ID NO: 11296 - DNA, 219 bp, Homo sapiens
atgaagtaggaagatgaagccaagtcttatcgccacatctctagtatattaagattatatatggccaggcacagtgattcatgcctatrrtcccagcactttgggaagctgaggtgggaggatcacttgaggccaggagttcaaggttgtagtgaaccttgatcacagcactgtaatccagcctgggtgacagaggagtgtcccaraaaaaaaaaaaam

SEQ ID NO: 11297 - DNA, 219 bp, Homo sapiens
  misc_feature 12: n=a, g, c or t
atgaagtaggangatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaaaaaaaaaaaaam

SEQ ID NO: 11298 - DNA, 399 bp, Homo sapiens
tattttttacattttgctttagaggcagggtcttggtctgttgcccacactagaatgcagtggtgccatcacagctcactgcagccttgaacttctggactcaagcgatcctcctgcctcagctagctgactagctgggaccacaggtgcttagcacgtgcctggctgatttttcctggtctcattgttgctggggctggccttgaactccaaacctcaggcaatcctcctgccttggccacattttatgttgggattacaggcctgacccaccatacbbagcctaatactatttttaaaaacaaaaagtaggaaatcaattttccttttaaatgaacactaaattataagaattaacttgggtaatctatgcaacattctcacttttttttttttttk

SEQ ID NO: 11299 - DNA, 206 bp, Homo sapiens
mtgaagtaggaagwtkmmgccmwstcttatcgccacatctctagtatattaagattatatatggccakgcacagtgattcatgcctataatcccagcactttgggaagctgaggtgggaggatcacttgaggccaggagttcaaggttgtagtgaaccttgatcacagcactgtaatccagcctgggtgacagaggagtgtcccar

SEQ ID NO: 11300 - DNA, 193 bp, Homo sapiens
atgaagtaggaagatgmagccaagtcttatcgccacatctctagtatattaagattatatatggccaggcacagtgattcatgcctatratcccagcactttgggaagctgaggtgggaggmycacttgaggccaggagttcamsgttgtagtgaaccttgatcacagcactgtaatccagcctgggtgacas

SEQ ID NO: 11301 - DNA, 129 bp, Homo sapiens
aacacagggwacacccacctttagagatgagacacaagcaggagaagagggattaaacctgctagttttggaaaaaaaammaaggaaagammagaaaagaaagaaagaaaaacaaaaaacaacaacaaa

SEQ ID NO: 11302 - DNA, 128 bp, Homo sapiens
aacacgggaacacccacctttagagatgagacacaagcaggagaagagggattaaacctgctagttttggaaaaaaaaaaaaggaaaraaaagaaaagaaagaaagaaaaacaaaaaacaacaacaaa

SEQ ID NO: 11303 - DNA, 72 bp, Homo sapiens; identical to SEQ ID NO: 11257

SEQ ID NO: 11304 - DNA, 219 bp, Homo sapiens; identical to SEQ ID NO: 11261

SEQ ID NO: 11305 - DNA, 144 bp, Homo sapiens
aacacgggaacacccacctttagagatgagacacaagcaggagaagagggattaaacctgctagttttggaaaaaaaaaaaaggaaagaaaagaaaagaaagaaagaaaamcaaaaaacaacaacaamcagaaaawtgcaaaac

SEQ ID NO: 11306 - DNA, 101 bp, Homo sapiens
aacacgggaacacccacctttagagatgagacacaagcaggagaagagggattaaacctgctagttttggaaaaaaaaaaaaggaaagaaaagaaaagaad

SEQ ID NO: 11307 - DNA, 136 bp, Homo sapiens
aacacgggaacacccacctttagagatgagacacaagcaggagaagagggattaaacctgctagttttggaaaaaaaaaaaaggaaagaaaagaaaagaaagaaagaaaaacaaaaaacaacaacaaacrgaaaaw

SEQ ID NO: 11308 - DNA, 219 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggrgttcaaggttgtagtgaaccttgrtcacagcactgtaatccagcctgggtgacagaggagtgtcccaraaaaaaaaaaaam

SEQ ID NO: 11309 - DNA, 136 bp, Homo sapiens
aacacgggaacacccacctttagagatgagacacaagcaggagaagagggattaaacctgctagttttggaaaaaaaaaaaaggaaagaaaagaaaagaaagaaagaaaaacaaaaaacaacaacaaacagaaaaw

SEQ ID NO: 11310 - DNA, 489 bp, Homo sapiens
attttcttgccgtgatggccgccgccgaggcagggagttgagggtttctgcctttcggagggtttggggggctgtcggtcccgttagaaggccaccaacagccccccaggttgccaagggcctgttagttgtgttcctggaaggtgggcaagcagcctgatgggttaacattgggatttgccgtcgttatagcggtcaaggggcctgtagcggctgcagggtcggtgagggttcccagccggccggaccttggtcgtctggcattctgcctttgaaatatctgggtggccggcgcctaggcatatggggttgtgctttctgtgttgtggtttgtagcttgcatcctccactgttcttagcgcatttggctctgtccatatggctgttggtactcatggccctatttggggttggactgggctctttttcttgggtctggtgggatttaagcaagaactggaattttgtaagatgtacagcagtgtcctg

SEQ ID NO: 11311 - DNA, 219 bp, Homo sapiens; identical to SEQ ID NO: 9948

SEQ ID NO: 11312 - DNA, 61 bp, Homo sapiens
cwgatttcattagttatacagatactcatttgtgtgtgtgtgtttgtgtatagctgtatgc

SEQ ID NO: 11313 - DNA, 419 bp, Homo sapiens
  misc_feature 283..286: n=a, g, c or t
tcctgaggagtgctttasttccaactatgtgatsaattttggaataagtgctatgtggtgctgcgaagaatgtatattctgttgatttggggtggagagttctgtagatgtgtattaggtctgcttggtgcagagctgagttcaattcctggatatccttgttaactttctgtctcgatctgtctaatgttgacagtggggtgttaaagtctcccattattattgtgtgggagtctaagtctctttgtaggtctctaaggacttgctttatgaatmwrrgwvnnnnhtgtattggatgcatacatatttagtatagttatctcttcttgttgaattgatcccttgaccattatgtaatggccttctttgtctcttttgatcttcgttggtttaaagtctgttttatcagagactaggat

SEQ ID NO: 11314 - DNA, 207 bp, Homo sapiens
atgaagtaggaagatgaagccaagtcttatcgccacatctctagtatattaagattatatatggccaggcacagtgattcatgcctataatcccagsactttgggaagctgaggtgggaggatcacttgaggccaggagttcaaggttgtagtgaaccttgtatcacagcactgtaatccagcctgggtgacagaggagtgtcccad

SEQ ID NO: 11315 - DNA, 207 bp, Homo sapiens
atgaagtaggaagatgaagccaagtcttrtcgccacatctctagtatattaagattatatatggccaggcacagtgattcatgcctatratcccagcactttgggaagctgaggtgggaggatcacttgaggccaggagttcaaggttgtagtgamccttgatcrcagcactgtaatccagcctgggtgacagaggagtgtcccaaw

SEQ ID NO: 11316 - DNA, 111 bp, Homo sapiens
aacacgggaacacccacctttagagatgagacacaagcaggagaagagggattaaacctgctagttttggaaaaaaaaaaaaggaaagaaaagaaaagaaagaaagaaaaa

SEQ ID NO: 11317 - DNA, 206 bp, Homo sapiens; identical to SEQ ID NO: 11294

SEQ ID NO: 11318 - DNA, 144 bp, Homo sapiens
aacacgggaacacccacctttagagatgagacacaagcaggagaagagggattaaacctgctagttttggaaaaaaaaaaaaggaaaraaaagaaaagaaagaaagaaaaacaaaaaacaacaacaaacagaaaawtgcaaaac

SEQ ID NO: 11319 - DNA, 110 bp, Homo sapiens
aacacgggaacacccacctttagagatgagacacwwkcasgagaagagggattaaacctgctagttttggaaaaaaaaaaaaggaaagaaaagaaaagaaaraargaaaa

SEQ ID NO: 11320 - DNA, 219 bp, Homo sapiens; identical to SEQ ID NO: 9948

SEQ ID NO: 11321 - DNA, 450 bp, Homo sapiens
aataacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatacygaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgktttggaaaacaccattagaaccagaccagctttgttttgggttagagagagta

SEQ ID NO: 11322 - DNA, 219 bp, Homo sapiens; identical to SEQ ID NO: 9948

SEQ ID NO: 11323 - DNA, 60 bp, Homo sapiens
cagacactgtgctaggataatggwwwacaattttgaacaamactgtctacctacatgatt

SEQ ID NO: 11324 - DNA, 219 bp, Homo sapiens; identical to SEQ ID NO: 9948

SEQ ID NO: 11325 - DNA, 72 bp, Homo sapiens; identical to SEQ ID NO: 11257

SEQ ID NO: 11326 - DNA, 171 bp, Homo sapiens
tatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctctctcttaaaaaaaaaaar

SEQ ID NO: 11327 - DNA, 225 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaaaaaaaaaaaaaactggaa

SEQ ID NO: 11328 - DNA, 221 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccavaaaaaaaaaaaaack

SEQ ID NO: 11329 - DNA, 219 bp, Homo sapiens; identical to SEQ ID NO: 9948

SEQ ID NO: 11330 - DNA, 237 bp, Homo sapiens
gacaagaggcatcctaggmaagggarcagaggaagaggacagagacattttctttcttttcttttygtggacgcaacggcatgtgcctgtagtcccagctrcttgggaggccaaagcaggaggatcattcgaagtcagaagtttgaggctgcagtactttatgatcacacctgtgagtagtcactgcactccagcacaggcaacacagcaagaccctgttctttaaaaaaaaaaacw

SEQ ID NO: 11331 - DNA, 153 bp, Homo sapiens
tatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctc

SEQ ID NO: 11332 - DNA, 219 bp, Homo sapiens; identical to SEQ ID NO: 9948

SEQ ID NO: 11333 - DNA, 219 bp, Homo sapiens; identical to SEQ ID NO: 11261

SEQ ID NO: 11334 - DNA, 207 bp, Homo sapiens
atgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtcccaaa

SEQ ID NO: 11335 - DNA, 121 bp, Homo sapiens
aacacgggaacacccacctttagagatgagacacaagcaggagaagagggattaaacctgctagttttggaaaaaaaaaaaaggawagaaaaraaaagaaagaaagaaaaacaaaaaacam

SEQ ID NO: 11336 - DNA, 187 bp, Homo sapiens
aacacgggaacacccacctttagagatgagacacaagcaggagaagagggattaaacctgctagttttggaaaaaaaaaaaaggaaaraaaagaaaagaaagaaagaaaaacaaaaaacaacaacaaacagaaaaatgcaaaactgcagaacacgcrgtgraggttggattcagaggacatggggat

SEQ ID NO: 11337 - DNA, 220 bp, Homo sapiens
  misc_feature 220: n=a, g, c or t
atgaagtaggaagatgaagccaagtcttatcgccacatctctagtatattaagattatatatggccaggcacagtgattcatgcctataatcccagcactttggggaagctgaggtgggaggatcacttgaggccaggagttcaaggttgtagtgaaccttgatcacagcactgtaatccagcctgggtgacagaggagtgtcccaraaaaaaaaaaaan

SEQ ID NO: 11338 - DNA, 219 bp, Homo sapiens; identical to SEQ ID NO: 11261

SEQ ID NO: 11339 - DNA, 219 bp, Homo sapiens; identical to SEQ ID NO: 9948

SEQ ID NO: 11340 - DNA, 185 bp, Homo sapiens
ctatactaaaaatacaaaaattagctgggcatggtggcgggcacctgtagtcccagctactcaggaggctgaggcaggagaatgacgtgaacccgggagatggagcttgcagtgagctgagatcacgccactgcactccagcctgggtgacagagcgagactccatcccaaaaaaaaaaaaaaaa

SEQ ID NO: 11341 - DNA, 162 bp, Homo sapiens
tggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgc

SEQ ID NO: 11342 - DNA, 198 bp, Homo sapiens
tatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaaaaaaaaaaaaa

SEQ ID NO: 11343 - DNA, 498 bp, Homo sapiens
tgacagtaaggaaggagcagcacacacacagaggaaggagtcaggtacgcagccctgtgctgcttcccagaagcacaccagccagcagaactgagcccctagcacagttttggggagcaaagtctctgcagcttaacccctccacccccgcataatggagcttgtgtttttccacgctggagatgttggcttcaagcacgcagaaggagctgcagcatcataatggcatcccagagcagcgagccgaactcaaaatcctctccccaaaagcaaatcctcagacaccccagtaactacctttttattccatccaagctgtgaactttcaatgcattcggctctgagaagggagtaaaatatctttgtgctcacgaacgcaaacgggcagaaagtgaggactttgtagatgggcacgaggctgcattttaatgtcactgkgccttctacgcaaagctgbttattgccctgttgaaaacagacccmaaaaaaaaaaaaaaa

SEQ ID NO: 11344 - DNA, 388 bp, Homo sapiens
cccttccgtgctgagccgcctgcaggacgcggccgtggtgcggcctggcttcctgagcacggcagaggaggagacgctgagccgagaactggagcccgagctgcgccgccgccgctacgaatacgatcactgggacgcggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggstggtgcacacccaggagccg

SEQ ID NO: 11345 - DNA, 426 bp, Homo sapiens
atacgggaatcgcggagcttagctgtcgccacctcgcgccgggtccgcgcggcccacgggaccccccactgacgcccccggccagcggtccacatggacgtgcggggccctgaagcccccggcgggcgcgcgctgcgggacgcggcagaaaatctatttcaggaacttcaggaacattttcaagctctgacggcaacattaaacctcagaaatatccttttctacctttaacaaatgctgtgattctttcggactggtagattatcatggagtatctttttgttgtctggtagtagtaggtaatagtttacttaggatttcccagtatttacttctgtgcttttatgtggcttcctgatgtgttaattacccctcacctatagcaaaagctgtacctycggccgggtgcagtggctcacgcctgta

SEQ ID NO: 11346 - DNA, 430 bp, Homo sapiens
attcacctcgcggccacaggagctcagcgccggcgccgcgccgcccagccccgccgagaggggcgcactcgccgccgcggggcccgccgccgctcaccgcagccccctcctggcgacccgcaagtgatgctgtgattgttgcctgcggactgggaagcacgatggctccaaaaggccagcggggccgagaagcagggacagagaccagcatttaagggatctctggtgggggcctccctggagttctccacatgtaaatatagcgaaaaaagaaaacactacgttactagaataaacacgtcctaaaatttctgtgcaaaaacacctttttgaacagcaaagatttcacccaccaaaacaaggaagcaagaagcttccacagtgtgcaggatccgaaacaggaccggcccsgcgttgggtgagagtgggg

SEQ ID NO: 11347 - DNA, 440 bp, Homo sapiens
accgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtc

SEQ ID NO: 11348 - DNA, 382 bp, Homo sapiens
agggaagcttggttaaaaacagttatggcagtgggagtcgaagcgagggtctgaagttcacgactactagaaggggaggggagtggaaaggctctcastgaaaaaggtattagaattatttctgaattatcagtctctcatttgtgctttggagaagcasaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtc

SEQ ID NO: 11349 - DNA, 483 bp, Homo sapiens
taaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggargggggaacatggg

SEQ ID NO: 11350 - DNA, 410 bp, Homo sapiens
aaaagcactcttggacacacagccaatctctggttgtgatatttccccattgattccttccttgttaacaaggtcattttaatggttcagaagttggagcagcagaagctgggaaccagagcttcattcttggaacatkggcacgtgctgtgtgtttcctgagacccaaataacctcagataaggaaactaatactaagtgagagaagatgtttgctgacagatgttcttgccctaagtcagtggcttctgaaacttggctgcattaaagtcacctgtggcactttttaaaaatacctgtggagcaacaggaacgctcattcattgctgcaattgtactttttgatatttacccagaaagactgaaacttctgtccacacaaagatgtttatagcagctttattcataat

SEQ ID NO: 11351 - DNA, 427 bp, Homo sapiens
  misc_feature 84,93: n=a, g, c or t
aagtgcccgcgcascggtttccggtgcaggtggggaaaatggcggtgtctacagtgttctcgacttcgtcgctgaagctaaacnagccccagnaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataamcctctcctaggacatacatgtaaatgcacaatgtgactcattctcatacttttttgttcagctctgagcctcaaaagtgat

SEQ ID NO: 11352 - DNA, 342 bp, Homo sapiens
atttccttctcacattgcaacaattattccttctcagcagtcccctagtcttaactcactccagcattaactcagaagtccacagaacaaagtctcatctgagacaaagcaagtcccttccgttgatgagcctgtaaaatcaacaacaggttagttacttccaagatgcagtgggggtacagggatgggtaaatgttcctgttccaaatgggagaaattggccaaaacgaagaggctacaggccccatgcaagtccaaaactcagcaggacagtcattactacccacgctttgttacattgaggacccaggttagattcttgcttgtcttgcttttagtggr

SEQ ID NO: 11353 - DNA, 330 bp, Homo sapiens
actgtaggggaggcggggctggagggagatggcgccgcgctcccggatgaacagagaaagagacaggataagggcctcgctctgttacccaggctggagtgctgtggtgtgtttgtgactcaccgtagccttgaactcctgggctcaagcaatcctcccacctaagcctctggagtagctgggactacagttctccttcaccttcctccatgagtagaggcagcctgaggccctcaccagatgcagatgcccaaccttgaactttccaaccattcagagtcattagccaaataaaccttttatctttataaatcaaaaaaaaaaaaaaaa

SEQ ID NO: 11354 - DNA, 409 bp, Homo sapiens
  misc_feature 59,106,339: n=a, g, c or t
atagccacggtagtcgtggcgaccaagcaacccggcaacgcgagtcaacaacaacaacngcccggccgacccccacccccrscccccaggcccggcccggggaccncaggacgtcccgtccccttcccaacatcgactccgagacctccgaaaagcgtttccgcagacagaagtggggagaagcggagagacggggtttcgccatgttggccagactggtctcgaactcctgacctcagctgatccacctgcctaggcctcacaaagtgctggaattataggtgtgagccaccgtgcccggcctgatctcattggatctttgcagcaatttgatgaawngggtgttctcgttatccccaggtgacaggcaactgaggcccagaagaaggaattaaaaaaaaaaaaaaaa

SEQ ID NO: 11355 - DNA, 471 bp, Homo sapiens
aaatttgttaatagagtagatctcatggtgtattcctatcacaataaaataaatattaaaattaaataaaacagaccagtacatagcatgtgtggtcactgcaggagataaagcctgaagcagagaggggaaagacaaaataacaggcttctcccctcttcctaccttccaaatctcaacccagtggctccattgactccacctacctggaagctggttagccatggaggtggtgaaacatgtgttgcaggaatcagcaccccaagaaacaagcagaacaggggaaaaccagggaggacaaagagaaaagtgactgacagagtggaagaaaccaaatctatcaatgcatagaaccattatattttgggagagatacttctcatactcaatcaaaagtaagacttgttggctgggcatggtggctcatgcctgtaatcccaacactttgggaggccgaggtgggcggatcac

SEQ ID NO: 11356 - DNA, 307 bp, Homo sapiens
aaggaargggaaggggaagaggaggaakggaaggaagggaaggaaaggaagaaggaagtttgcctcttgaatttttctagtctgaacctttctactaaatatctattgtgttgttcgacagttatttgtaaacatgaggtcagattctgggcaactttaggcatctcaaaagtttgttgtatgtgcaatcaagagtaaagatccggctgggtgcgatggctcatgcctgtaatcctagcattttgggaggccaatgtgagcagatcacctgaagtcgggagttcgagaccagcctgactaacatggr

SEQ ID NO: 11357 - DNA, 107 bp, Homo sapiens
  misc_feature 107: n=a, g, c or t
ctggaaatatttgtagatgtaagttatgatcagcatttagcttgcctatccattgttctggttcaaagagttttgcatgttagccgatctcaaaactaaacatcttn

SEQ ID NO: 11358 - DNA, 330 bp, Homo sapiens
  misc_feature 152,292,316: n=a, g, c or t
ttaaatttttaattttttgtgggtttttgttttgttttgttttgtttttgagacggakyttgctctgtggmccaggctggagtgcagtgacacgatctcggctcactgcaagctctgcctcctgggttcacgccattctcctgtctctactnaaaatacaaaaattggcctggcattggcacacgcatgtagtcctaactactcggggggctgacgtgggagaatcgcttgagcctgggaggcggaagttgcagtgagctgagattgtgtcactgcgctccagcctgggtkncagagtgagaccctgtctcagcanaaaaaaaaaaaaaa

SEQ ID NO: 11359 - DNA, 192 bp, Homo sapiens
acaatatttaagttctctgcttctgcatttggttggtttcctgaagcgcagccctgtgaataacaggtggsttttcatggatgtctctagtcagagaaaaatgataaaggcttaaattgaggattaacagaagcagattaacctcagaaatcctgtctggctggcagatttcaagtaaaaaaaaaaaaaagg

SEQ ID NO: 11360 - DNA, 464 bp, Homo sapiens
attatgatctagtatgatttcttctgcattatcaggtaaccacaggtaattcataaatattatccgtggaatttacttacttaatatctgtatgagtctttatattggcatgtgaggtttttcatagttcagtaaaagcttgactcagtcagagggatcacagaattacatgtttctttttcacccaccaacattttgttgaaaatcttgttaaagtgcattctttcttttttttgatgtactatatggaatgtaagaccattttttaaggtaataattggtagtgttaatatagtaacatagataaaatacaagggaatttgatttaatctggattgatgccttggaagacttaaaatctttatagaaacctttcctcaaggctgggcttggtggctcccasctgtaatcccagcactttgggaggccaaggtgggtggatcacgagatcaggagattgagac

SEQ ID NO: 11361 - DNA, 74 bp, Homo sapiens
caattgtgttcgcagccgccgccgcgccgccgtcgctctccaacgccagcgccgcctctcgctcgccgagctcs

SEQ ID NO: 11362 - DNA, 523 bp, Homo sapiens
acacacttcscmcagagaagcctccgagcgcggccgccattccgggcctcaagcccataaagaaaaaataccggagaggttctggcaccatttcggggtgccaaagcagccatggaagagcctgcagctccctcagaagcccacgaggcagccggggcccaggcaggtgctgaggcagcaagggagggtgtgtctgggcmrggaccttcccgtctgtgagccctccgggaatctgctgctccagattcagccctgccacatgcggcaaggggctgggcccccttccctgtagctccagtccctgcccacctccgcagaggaggcctgaggctgccccagcctcaggadkaggagcctggcccagtccgtttgccaagccgaagcagcggcatttggacaaagcagatcatctgcaggtgaacggcatgggattctgagaaccagggaaggagagccaagtcataaaaggatcggtgccgagtgagtcctttgaatggktcatggaacagaacttctcagtctt

SEQ ID NO: 11363 - DNA, 415 bp, Homo sapiens
  misc_feature 172: n=a, g, c or t
agaggacgagacagcgagaggaacagcgtccggggcgacccccagtccaccgcgggggcctggcgcgcttggggcaaaggccctaggagaccccttctggccacaaaatcgagtatgacagaaaagggccagcgggggcgctttccttccagggccacttgccggaatgtmngagggacggagagacgtccggaaaaggctgccacgctcggagcgctgcgccaggccaggcacctaggccaggggagcggagacctcgtgggagcgggcagggggacctttcccctctcccgggcttccacccaggcgcctccccgctgtgaacgccgccgcccaggtgaaggggaaaccggccacgtttccggacctcggcggggcacacggtctccggttttcaccggctctgtcttggagc

SEQ ID NO: 11364 - DNA, 447 bp, Homo sapiens
cttcttgtttttcagactgtcagcatcaataaggccattaatacgcaggaagtggctgtaaaggaaaaacacgccagaaatatccttttggatgttgcttggaagaccgaccctgagggaggtcagctcatggggactgaggtcagggccaggctgccttgctcagctccaggaaggggcaaccctgcacaggccaggtccctgcagcttctgatgacggcagcttctcagagagggctggctgcagagaccacagaccttcagggtggcagacaccaaaaaggctgtggagcccaggcctttcaacttgccaaagatcctgctcctttccttaggacttaagcactcctttttttctttttccaaaaggggtcttgccgtgttgcccaggctggagtgcaatggcgtgatcatagctcactgcagcctcaaactcctgggttcacg

SEQ ID NO: 11365 - DNA, 281 bp, Homo sapiens
ctaaacttgatagttttctttaaaatggactataatattcaaattatattaatgagggtttccttattaattaatgaattaaatgttttgcattttatatctgtgtaacagtatatccttttaaaatattaatcttgtggccgggtgtggtggttcatgcctataatcccaacactttggggggccaaggcaggcagatcgctcgagctcaggagttcgagaccagcctgggcaacatggtgaaaccctgtctctaccaaaaagtaaaaaaaaaaaaaaaa

SEQ ID NO: 11366 - DNA, 505 bp, Homo sapiens
atttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttkgggacgccttcctggtcccgaagaaacactcccaggacaggacagctggaacggggtccccagcagggccggactg

SEQ ID NO: 11367 - DNA, 306 bp, Homo sapiens
ttaacattaaggccgggcgcagtggctcacacctgtattcccagcactttgggaggccgaggtgggcagatcatgaggtcaggagattgagaccatcctggctaacacgatgaaaccccgtctctactaaaaatacaaaaaattagccgggcgtggtggcaggtgcctgtggtcccggctactcgggaggctgagacaggagaatggtgtgaacccaggaggcggasttgcagtgagctgagatcacgccactgcactccagcctggatgacagagcaagactctgtctcaaaaaaaaaaaaaaaa

SEQ ID NO: 11368 - DNA, 440 bp, Homo sapiens
  misc_feature 369: n=a, g, c or t
ttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgacamccgcacccggcagagttttataatgaaaaattaactaatattctagtatgaagtgaggaggatactgaacaggatgtggctaaagcnaacctgggacagccatggggtggcttggtttcttcactccagtgttgtccctaccatttcgcagcattgat

SEQ ID NO: 11369 - DNA, 498 bp, Homo sapiens
taaaatcttgttgaattttaaacttgtttggaaggtgtgtcctgattttttttcttgcatctttcttgagcttggatacttctttccatgttttatcctaaaaacgtggtattgtatacacgtcttttaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccwwttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccaacaa

SEQ ID NO: 11370 - DNA, 439 bp, Homo sapiens
tttttatggatgcatagtattccatggtgtatatgtgcgacattttcttaatccagtctgtcattgatggacatttggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaaaaa

SEQ ID NO: 11371 - DNA, 341 bp, Homo sapiens
taataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaagbactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattca

SEQ ID NO: 11372 - DNA, 278 bp, Homo sapiens
agaagcgggastgaggggagagagaggccggtcctggtctggccgctgcggctgctagcccgaggtctccaagccgggctgcggctccatcctcggctcctgggcaccgtctgcgaggctccgcgaccagagtgagaaagccgcgggcgcaaccgcgattycatgtcagccaaggacgagcgggccagggagatcctgaggggcttcaaactacagtaaaccggaaactggagaattgagagatttcagaagcaacgttttcatctgattggaaatac

SEQ ID NO: 11373 - DNA, 325 bp, Homo sapiens
aatttggggagcagggattggagccgggaggtggggaaagccagcccctccgttcccamtctccggggtcgctgcgagcacagtgtctcagccargggcaaggccsgggramtcctgsgrraaaccmcgggscggagagcagcagccgcgcgggcccagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcttcctgttaaaattctcaaaagca

SEQ ID NO: 11374 - DNA, 644 bp, Homo sapiens
cgtttgttaattggttgaatttaaacattggacagtgtatatatgtcaaaacatcgtgttgcacatggtaatgtacactattatctgtcactttttaaaaagttaaaaaaaattaatgttatagatcctgtaagtaacagaatttcaacttagatcagtattaagttagtacaagattagcaagggtagggtttattatgtagctattaataattgatgattttcttttggtctcatgctaaaatagaatgtccctgagtaggtgatatatatcttggaagtacagatgatctccaacttatgatggtttgacttaaaatttttgttgtataagccatattcattcagtagaaacaccttcagtagacactgtatgttgtattttgaattttggtctttcccaggctcctgatacatggtatgatgctctcttgtgatgttgggcagtggcagtgagccatagttcccattcagtatactgtgttgccaagtggttttccccgactgtaggctaatctaactgatctgagcatgtttaaggtaggctaggtaagctatgatgtcagtaggttaggtgcaagyaatgttcgtttgagactaggtcttgctctgtcacctasactggagtgcagtggtacatcatg

SEQ ID NO: 11375 - DNA, 610 bp, Homo sapiens
ttactttgtctcctgtgctgaagtgcagtggtacgatcttggctcggtgcaacctctgcctcctgggttcaagcaactctcacgtctcagttacctgagcagcggggattacagccatgtgccaccatgcccagctaacttttgtatttttagtagagacggggtttcaccatgttgggcaggctggtctcgaactcttgacctcaagtgatccacccacctcagcttcccaaattgctgggattacaggtgtgagccactgcgcctggcctcaagagaaatctaataaagtattgtggagctccagggaggtgtatgagtacacatcttgttagagacattagaaaagtctttttaaaatgggtgtggaggccaggcacagtggctcatgcctgtaatcccagcactttgggaggcagaggcaggcggatcccctgaggtcagttcaagaccagcctggccaacatggtgaaacccgtctctactaaaaatacaaaarttagccaggtgtggtgtcaggtgcctgtaatcccagctactcaggaggctgaggcaggagaatcacttgaacccgggagcagaaattgcagtgagcctagatcacactacg

SEQ ID NO: 11376 - DNA, 489 bp, Homo sapiens
  misc_feature 2..3,30: n=a, g, c or t
dnnttaadatttttgaggtctgttttacwnagawggacgttgagtttccggagacctgagtcccacgtccaaagtctagtcactgaggggtggagcagggaggacagttacagacagcagagctcagcttctgtggggctggggctcatcctcaagactccagcctgctccatcctcccagcccccaagggctttaggctgatggaggacgcagaacactgttcattaaaatagaggtctatgatttagcacagcaagagtgacaaaagagtgtttgttattagttccaaacagggagaaaccacggtgggctgactggcagggaagagttgattgawwgactgcagagcccgactgtgtgggaggaggtgggcagccaggggagggacacatacctgggcatcatgtcctggtggttggagactcctgaacacatgggagcctcgtgggagccctcagggaggtgcaagctggagaggatcgggtcac

SEQ ID NO: 11377 - DNA, 482 bp, Homo sapiens
caaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgata

SEQ ID NO: 11378 - DNA, 295 bp, Homo sapiens
actttagctgccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgtgaagttccctgaaggagcgagacagggagggacagggcagaggaggagtgacctgcagagcaagtttgaattggtaaatagaaaacaagaataaaatagtttgctgtttacattccaaaaaaaaaaa

SEQ ID NO: 11379 - DNA, 63 bp, Homo sapiens
aaagcccaatacttagagtcccaattttgtctcatttgccaaaaaaaaaaaaaaaaaaaaaar

SEQ ID NO: 11380 - DNA, 334 bp, Homo sapiens
agattaaatctattaatttttctctagcccatgtaagaatcccatttatggctgggcgcggtagtcacgcctgtaatcccagcactttgggaggccgaggtgggcggatcaggaggtcaggggatggagaccatcctggctaacacgatgaaaccccgtctctactaaaaaatacaaaaaattagctggccgtggtggtgggtgcctgtagtcccagctactcgggaggctgaggcaggagaatggcgtgaacctgggaggcggasttgcagtgagccgagatcccgccactgcactccagcctgggcaacagagcgagactctgtcccaaaaa

SEQ ID NO: 11381 - DNA, 437 bp, Homo sapiens
caaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtasctgggdtgacaggvacccgccaccacacccagctaatttttgtacttttagtagagacgaggtttcgccatgttggccaggctggtctcgaactcctgacctcaggtgatccacccgcctcggccttccaaagtgctgggattactggcgtgacamccgtgcctggccagaataggttttttctttcaacttgatcagtagaaaatggacatcaagtttgaacagataaatcatggacagccttattgtgattgaaatgcttgtaggty

SEQ ID NO: 11382 - DNA, 105 bp, Homo sapiens
acagttgctgctaactgccctggtgtgtgtgagggagagagagggagggagggagagagagcgcgctaskgamavsagcgagtgagcaagcgagcagaaaagagg

SEQ ID NO: 11383 - DNA, 401 bp, Homo sapiens
  misc_feature 375: n=a, g, c or t
ataatttgaaaaatgtcatattttacaagagtgtattctgtcatcttccaaaaatattgaaggtggagtttttttttcctttattacattttattttttaatttttttttctttttttcttttgttttctgtagagatgaggtctcactatgttgcccaggctggtctcaagcgatcctcccaccttggcctcccaaagagctgagattacaaaggcctcccaaagagccactgcacccggcctattacattttaaatgaggactaatagaggccaggtgccatggctcatgctgtaatcctagcacttggggaggccgagatgggaggattgtttgatgccaggagttcgagaccagcctggtgaacatagcangaccccatcttaaaaaaaaaaaaaar

SEQ ID NO: 11384 - DNA, 326 bp, Homo sapiens
atgggacatagtcttaaaaatgtctgaaacaggctgggcatggtggctcacacctgtattcccagcagtttgggaggctgaggtgggtggatcacgaggtcaggagaccgagaccatcctgaccaacacggtgaaacctcgtctctactaaaaatgcaaaaattggctgggcatggtggtgtgcacctgtagtctcagctacttgggaggctgaggcaggagagtcatttgaacccgggaggcggaggttgcagtgagccgagataggccactgcactccagcctggcagcagagtggagactccatctcaaaaaaaaaaaaaaaa

SEQ ID NO: 11385 - DNA, 233 bp, Homo sapiens
  misc_feature 201: n=a, g, c or t
ggtgtccgcgtttggagctgggcgtgcgggtctcagtggcggcctcggcattcggggcggcgggaggcgcmggtrcatccccgggacggccaggagcaaagacggagaggagaggggggttagasmaaggaggymttgtgtctgtgtgccttaggggaggaggggactgcaggaatcgaataaacgcakcgagctgcgcgnggctgctggaagcccaggcgggggaagggggc

SEQ ID NO: 11386 - DNA, 292 bp, Homo sapiens
  misc_feature 292: n=a, g, c or t
tatatgtttggctgggtgtggtggttcacgcctgtaatcccagcactttgggaggccgaggcaggcggatcacaaggtcaggagatcgagaccatcctggctaacacggtgaaaccccatctctactaaaaatacaaaaaattagccgggcatggtggtgggcgcctgtagtcccagctactcgggaggctgaggcagaagaatggtgtgaacctgggaggcggasttgcagtgagccgagatcgagccagtgcactccagcctgggagacagagcgagactctgtctcaan

SEQ ID NO: 11387 - DNA, 493 bp, Homo sapiens
cctttagctgccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcataggaggagaggaaggcgatgcgacggacaggcgcacccgctcaggctgactctcgggggcgaggtcgagccaggggcggctgcctgggggcgaggcgacgctgtctcaacctccacctcgcggcggaacccgaggacaagagcctcagatgaaagaaacaatcatgaaccaggaaaaactcgccaaactgcaagcacaagtgcgcattggtgggaaaggaactgctcgcagaaagaagaaggtggttcatagaacagccacagcagatgacaaaaaacttcagtt

SEQ ID NO: 11388 - DNA, 525 bp, Homo sapiens
  misc_feature 463..465: n=a, g, c or t
ctctgtgcgccgcgagagggaggccgcctgcagcccggctgctcggccgccgcgggccctgctccgggggttcagttttaatgaagaatccctgctcccttctcgcgcccctcccgctttctgcccacctccctggggtctggaaggagagggtcgcccctccccgctttggctgctaaactctctggctctccccccggccgctgcctgggttctggtggcttccttcctcctccttgtctgtcggagctcaagggacaagccctttccctggcgcgtgcctggtgaaaccctcgcacccttccccacccccacaagcctttggcatggcctgggagactccgggcatcttcaacccagccagggacaagggtccgcggagggtctggagcccctcgtgggcctggtgccacggawkcccacccctgccctccaggagcccctgggaaggcagcactctggnnnvggaggaagccagacccagctacaagggagggavcctcggctgatgcaaagaggccggag

SEQ ID NO: 11389 - DNA, 543 bp, Homo sapiens
cmaaaagttgttaatgctcactacctatatctatttgtygagaattaamaattcttatattctattaycyyhcyytttattcattggaatagttgtgtaacaacatgtcctctcatctactattttgttacccagttcacctaggaaaggcaggataaatgtytgaytttytttccccttcattgaccagttttcaagataattaatcagttcccatcatgagagatgatgtttgasctaagacctgaatgaagagccagctattcaaatatctggaggaagaggccaggggtggtggctcgtgcctgtaatcctagcactttgggaggtgggcagatcgcttgagctcaggagtttgagaccagcctgggcaatgtggcgaaactctgtctctacaaaaaatacaaaaayyagctgggcatggtggtgcatgcctatagtctcagctgcttggagagctgaggcgggcggatcgcttgaacctggcagtttgagactgcagtgagctttgatcacaccacagcactccagccggggcaacay

SEQ ID NO: 11390 - DNA, 372 bp, Homo sapiens
actccccagctgcattcccggaggcgccctttcgacctggaggccgggtctgctggccacagggctgccgcactggctgggactgccagctgggcctggagacgctggtggctgtggactccccagcttggagcagtccctctttgtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaacaaaaaaaaaaaaaaaa

SEQ ID NO: 11391 - DNA, 302 bp, Homo sapiens
aaaattgtggcagtttctggccgggcgcagtggctcacgcctgtaatcccagagctttgggaggccgaggcgggcggattacctgaggtgaggagttcgagatcagcctgggcaacacggtgaagccccgtctctactaaaaatacaaaattagccgggcgtggtcgcacatgcctgtaatcccggctgctcgggagcctgaggcaggagaatcgcttggacctgggaggcggaggatgcggtgagccgggatcgcgccattgcactccagcctgggcaacgagtaaatctccgtctcaccr

SEQ ID NO: 11392 - DNA, 521 bp, Homo sapiens
tccctccttacggggcaaggttggcagtccaggaatggtggggaggcgggtgtgatataacaggaatcagattctagcctcagatatttctgtttctttcccccagactctgggatgtgaagaggcattcttgtttctcaagtcctggttcttccacatactacttctgtgacttaagacagtttattctttctcagcccccatttgatcatctgtagtatgggaaggagtgtaataataaatactacccatttgagagggttgggaggaaagagatcatgtgtgtaaaatgcttagtactgataaaatcttagtgtttgctgagatgatgatgatgatgagtgattatgatggcaaaggtgatgataaaagtttgcaggggctgggcgcagtggctcacgcctgtaatcccagcactttgggaggctgacgcaggaggatcacgaggtcaggagatcaagaccatcctggctaacacggtgaaaccccgtctytactaaaaatacaaaaaaaaaaaaaaa

SEQ ID NO: 11393 - DNA, 353 bp, Homo sapiens
agtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctggagatgctcagtcccagtatactttaaggaagagaaatataaaggaaatttagtatgcctccttttctttaaatgaagaatttagtttcctttacttcttaaaaggagaatacctgttcttgtataacgtkactgcamcagacattctgaaaaatcagcaagaagcaaaagctggaaatags

SEQ ID NO: 11394 - DNA, 377 bp, Homo sapiens
atgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcm

SEQ ID NO: 11395 - DNA, 212 bp, Homo sapiens
agcctgaccaacatgttgaaaccccgtctctactaaaaatacaaaaattagccgggcatggtgtcacgtgcctgtaatcccagttactcaggaggctgaggcaggagaatcgcttgaatccaggaggcagaggttgcagtgagctgagattgcgccactgcactccggcctgggtgacagagcgagactccatcccaaaaaaaaaaaaaaaa

SEQ ID NO: 11396 - DNA, 458 bp, Homo sapiens
catgtaaattaagttctagagaagctctccgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttc

SEQ ID NO: 11397 - DNA, 148 bp, Homo sapiens
gcgccctcgcagtcaccgccacccaccagttcctatatcgggccccccattcatccactcacactcccagccaccatgttacactggactctaagccacttcttactccagtagtaaatttattcaataaacaatcattgacccatgc

SEQ ID NO: 11398 - DNA, 147 bp, Homo sapiens
tacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaa

SEQ ID NO: 11399 - DNA, 375 bp, Homo sapiens
cacaagattaaatgaaggagatagatattaattacataatttcataaataattgattgattaaaactatggtaagtgctggctgggcacggtggctcacgcccataatcccagcactttgggaggctgaggcgggcggatcacggggtcaggattttcagaccagcctgaccaacatggtgaaatcccatctctactaaaaatacaaaaattagctgggtgtggtggcatgcgcctgtaatcccagctactcaggaggctgaggcaggagaatcacttgaacctggggggcagaggttgcagtgagccaagattgtgccactgtcctccagcctgggtgacagtgcgagactccatcccaaaaaaaaaaaaaaaa

SEQ ID NO: 11400 - DNA, 234 bp, Homo sapiens
attcagatttgagacctggagtgataaagagttacacatggccaagcactacacttcagggctcacagccccctgagatgaagtctcactctgtcatctaagctgaagtacagtggtgcaatcatagctcactgctatcttgaactcctgggacttcaatgatcctcctgcctcagcctcccaagtagctgggattacagggaagacaaaaaactatgaaaaaaaaaaaaaaaa

SEQ ID NO: 11401 - DNA, 77 bp, Homo sapiens
catgcttgattaaaaattgcaggccaggcacggtggctcgtgcctgtartcccagcattttgggaggccagggcags

SEQ ID NO: 11402 - DNA, 394 bp, Homo sapiens
caattcattatggtgttgtgctttttaaatacactttttttgttgttgttgttgagaaagggtgtggctctgtcgcccagcctggagtgcagtggtgcagtcatggctcactgcagccttgacctcccggggtttagtgatcctccgccctcagcctcctgagtggctgggaccccaggtgagtgccaccacacctggctaattttttcattttttgtggagatgaagtcttgctatgtttcccaggctggtctcagactcctgggctcaagtgatcvwcctgcctctgcctcctgaagtgctgggattacaggcatgagccaccatgcccagtctgaaatatactttcatagtaaaccagttataacaaaaagactcaaccacttcatctaaa

SEQ ID NO: 11403 - DNA, 406 bp, Homo sapiens
aacaattagagatactttatttatttatttatttatttgagatggagtcttgctatgtcacccaggctggagtgcagtggcacagtctcagctcactgcagcctctgactccggggttcaggcgattctcctgcctcagcctcccgagtagctgggattacaggcgcccgtcaccacgcccggctgatttttttgtattttttggtagagatggagtttcaccatgttggccgggctggtctcgaactcctgaccttaagtgatctgcccgcctcggcctctgaaagtactgggattacagcataagccactgcacccagccagacaattagagatattttagaggagagtacaagggaaaactttcagagtggaaggaatggttgtcccaaagaaaaaaaaaaaa

SEQ ID NO: 11404 - DNA, 350 bp, Homo sapiens
aaaaaacctaaacgtctcttctggatctccagaaaaaaagtgctgctctaggccgggcgcagtggctcacgcctgtaatcctagcactttggcaggccgaggcgggcggatcatctgaggtgaggacttcgagaccagcctagccaaaatggtcaaagcccgcctctactaaaaatacaaaaattagccgagcgtggtggcacgtgcctgtagtcccagctgcatgggaggctgaggccggagaatcacttgaaccctggaggcagaggttgcagcgagccaagaccgtgccactgcacttcagcccaggtgacagagggagacgccctctcacaaaaaaaaaaaaaaaa

SEQ ID NO: 11405 - DNA, 64 bp, Homo sapiens
cagttagcccagatcatgccagcctgggtgacagaacaagactgcttcttaaaaaaaaaaaaaa

SEQ ID NO: 11406 - DNA, 193 bp, Homo sapiens
ccccatctctcctaaaaatacaaaaaattagccgggcatggtggtgggcgcctgtagtcccagctactcgggaggctgaggaaggagaatggtgtgaacctgggaggtggagattgcagtgagcagagatcgcgccactgcactccagcctgggcgacagagcaagattctatctcaaaaaaaaaaaaaaaar

SEQ ID NO: 11407 - DNA, 294 bp, Homo sapiens
cattttagaaggatctatttggaaggatccatttggaaggattgcttgagcccaggagttcgagactagcctgggcgatgtgatgagacactgtatttacaaaaatacaaaaaaattaaccaggtgtggtgacatgtgcctgtagtcccagctattcgagagcctgaggtaggaggatcacttaagcctagggaggccaaggctgcagtgagccgagattgcaccattgctctgcagccagcctgggtgacagagtgagaccgtgtaacaaaaaacaacaaaaaaaaaaaaaaa

SEQ ID NO: 11408 - DNA, 460 bp, Homo sapiens
ttactactagacctaagaaatgagatagatggcaactcaataatagtggggaactttaatactctactgacagtactagacaggtaatcaagacagaaggtcaacaaagaaacaacagacttaaactatactctagaaccaatggacttaacagatatttacagaatattctacccagcaactgcagaatatacattctgtttataagcacatggaacattctccaagatagaccatatgataggccacaagaaaagtctcaataaatttaaggaaattgaaattatatgaagtactttctcagaccacagtggaataaaattgaaaatcaactctgaaaggaacctgcaaaaccatgcaaatatatggaaattaaataatttgctcctgaatgatcattgggtcaacaatgaaatcaagatggaaattaagaagtttctttgaattaaacgataatagh

SEQ ID NO: 11409 - DNA, 401 bp, Homo sapiens
cacctgtgtattctcttcagtgaatcatctggatgtcttttgcccactttctttttttttcatttttattattttcattaatttttttctttggccactggaataaagactcaccattttctaactgagtgatgttttttaaatatatattttttagagacagggtctcactctgtggcacagagtsawttgtagctttgaactcctcagctcaagctgtcctcccgcctcagcctcatgagtagctagtactacaggcacatgccactacacctggctaatttttttatttgtttgtggagacagggtcttactatgttgctgaggctggtgtttaactcctggactgcagtgaccctctcatctcagcctcccaaagtgttgggattacaggcatgcgc

SEQ ID NO: 11410 - DNA, 428 bp, Homo sapiens
cagggttgttgaagatcatatatttgtagctgtgtggccttattactgggttctctgttttgttccattggtctaagtgtctgttttgtaccagtaccatgctgttttggttactgtagcctgtatcatagtttgaagttgggtagcttgatgcctccagctttgttctttttgcttacaattgcctttgatattcaggcgttcttttttttccttgttccatttgaattttaaaatagcattttctggttctgtgaagaatgtcagtggtagattaataggaatagcattgaatcagtaaattgctttgggcactatggctattttaatgatattaattattcctatctatgagcatggaatgttttcccatttgtttgtgtcatctgtgatttcttcgagaagtgttttgtagttctctttgtaga

SEQ ID NO: 11411 - DNA, 203 bp, Homo sapiens
tccattatgggaggctcattaaaagttggaagaakgccgkgcgcggtggctcacgcctgtggtcccagctactcgggaggctgaggcgggagaatggcgtgaacccgggaagcggacttgcagtgagccgagattgcgccactgcagtccgcagtccggcctgggcgacagagcgagactccgtcccaaaaaaaaaaaaaaaa

SEQ ID NO: 11412 - DNA, 326 bp, Homo sapiens
atgggacatagtcttaaaaatgtctgaaacaggctgggcatggtggctcacacctgtattcccagcagtttgggaggctgaggtgggtggatcacgaggtcaggagaccgagaccatcctgrccagcacggtgrracctcgtctctactraaaatgcaaaarttggctgggcatggtggtgtgcacctgtagtctcagctacttgggaggctgaggcaggagagtcatttgaacccgggaggcggaggttgcagtgagccgagataggccactgcactccagcctggcagcagagtggagactccatctcaaaaaaaaaaaaaaaa

SEQ ID NO: 11413 - DNA, 99 bp, Homo sapiens
caaaatattawaaataaaaggttgggacaaaagaatagcatgagaacacatggaagtaaaaagcagggatcacaatattgcttttctgttaaaaaaaaa

SEQ ID NO: 11414 - DNA, 57 bp, Homo sapiens
tagccaaaaggcagagaagtgatgaccctgtctttaaaaaaaaaaaaaaaaaaaaaa

SEQ ID NO: 11415 - DNA, 428 bp, Homo sapiens
  misc_feature 232,255: n=a, g, c or t
caatgatagattggataaagaaaatgtggcacatatacaccatggaatgctatacagccataaaaaggataagttcatgtcctttgcagggacatggatgaagttggaaaccatcattctcagcaaactaacacaggaacagaaaaccaaacaccgcatgttctcactcataagtgggagttgaacaatgaaaacacatggacacagggaggggaacatcacactccagggnctgtcagaggatggggagctaangggagggatagcattaggagaaatacctaatgtagatgacgggttgatgggtgcagcaaaccaccatggcatgggtatacctatgtaacaaacctgcacgttctgcacatgtatcccagaacttaaaagtataataataataataacagctgaaattaaaaaaaaaaaaaaaa

SEQ ID NO: 11416 - DNA, 307 bp, Homo sapiens
ttctggatgagtgtagtggctcacgcttgtaattccagcagtttgggaggccaaggtgggagaattgcttgagcctaggagtttgagatcagcctgggcaacataactagatgctgtgtctacaaataataaaaaaattagctgagtgtcgtggcctgtgtatctggtcccacctactcgggaggctgggatgggaggattgcttgagcctaggaggtcaaggcagtagtgtgttgtgataatactaccgtactccagcctgggcaacagagtgagaccccatccctccacaaaaaaaaaaaaaaaa

SEQ ID NO: 11417 - DNA, 466 bp, Homo sapiens
cctttatttgtttctcttgtctgactgctctatttttgtactcattattagtgccatgttgaataacagtggtgaaaagtaggcatccttgtcatgttccagatcttggaggaaaggctttcagtttttcctagagacaccaaggaatgcagcaagagcaaactttcatctctgtgatcccttgccaagtaattagaaaaatcagtattctaacttttttttttttaaagagataatttagggccgggtgtggtggcycatgcctgwagtcccagcacttttgggaggccgaggcgggcggatcacagggtcgggagattgagaccatcctggctaamacggtggggccctgtctctactaaaaatacaaaaaaaagaaaattasccgggcacggtggcgggcacctgtggtcccggytactcgggaggctraggtgggaaaatggcgtgaacccaggaggcggac

SEQ ID NO: 11418 - DNA, 316 bp, Homo sapiens
cagaaaatcttaaaatatgtatcatcgagggctgggcgcggtggctcacgcctataatcccagcactttgggaggccgagacgggcagatcaggaggtcaggagatcgagaccatcctggctaacacggtgaaacccagtctctactaaaaatacaaaaaaaaattagccaggcgtggtggtgggtgcctgtagtcccagctactcaggaggctgaagcaggagaatggcgtgaacccgggaggcggasttgcagtgagccaggatcacaccactgcactacagcctgggcgacagagcgagactctgtctcaaag

SEQ ID NO: 11419 - DNA, 306 bp, Homo sapiens
tgtcttaaaaatagggaaatgtggctgggcgcagtgcctctgcccgtaatttgggaggccaaggcgggcggatcgcctgaggtcgggagcttgagaccagcctgaccagcatggggaaaccccgtctctactaaaaatacaaaattaactgggcgtggtggtgcgtgcctgtggtcccagctacttgggaggctgaggcaggagaatcacttgaacccaggaggcagaggttgcggtgagccaatatcacgccattgcactccagcctgggcagcaaaagtgaaacactcaaaaaaaaaaaaaaaa

SEQ ID NO: 11420 - DNA, 136 bp, Homo sapiens
agaacagcctaggtaactttgcaagactccatctctgctaactttttttttttttaaactgggctgggtgtggkggctcamacctgtaatcccagmactttgggaggctgaggcaggcggatcatgaggtaaggag

SEQ ID NO: 11421 - DNA, 249 bp, Homo sapiens
atccatgccagtacagcctttgagaccagtctggccaacatggtaaaaccctgtctctactaacaatagaaaaattagccaggtgtggtggcatgtgcctgtaatcccaactactctggatgctgaggcaccagagttgcttgaatctgggaagtggaggttgcagtgagctgagactgcgccactgcactccagcctgggtgacagagaaagacactgtctcaaaaaaaaaaaaaaaaaaaaaaaaaa

SEQ ID NO: 11422 - DNA, 608 bp, Homo sapiens
  misc_feature 537: n=a, g, c or t
cacttttatagctgaataatatttcattgttcatatcacattttgtttgtccattcgtccactgatgggctttgaattgtttccaccttttccctatttgaatactgctgctgtgaacattttgtttgaacatctgttttcagttctttttggtatatactaaggattggaattactgggtcatatggtattttaggtttaaccttttgaggaaccaaaaaaagtttcaaacattaattggtttgccttttaaattgagaaatttaaacattgtatttatttatcgtgtacaatctgatgttttgaaatacatatatgtatgttgtggccgggcacgtggctcacgcctgtagtcccagcactttgggaggtcgaggcgggtggattacctgaggtcagaagtttgagaccagcctggccaatgtggtgaaacctgtctctactaaaaatacaaaaaattagccgggcttggtggtaggcgcctgtagtcccagctacttgggaggctgaggcaggaaaatcatttgaacccgggangcagaggttgcagtgagccgagattgtgccactgcactccagcctggtgacagagtgaaactccatatcaa

SEQ ID NO: 11423 - DNA, 430 bp, Homo sapiens
cagtggctcatgtgtgtaatcccagcactctgggaggctgagacaggtagatcatttgaggtcaggagttcaaaaccaacctggtctacatggtgaaaccccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaaccctgtctctattaaaaatacaaaaattagctgggcgtggtggcgcatgctgtagtcccaactactagggaggctgaggcaggagaatcacttgaacccaggaggtggaggttgcagtgagccgagatcacgccactgcactccagcctggcgacagagcgagactccctcccaaaaaaaaaaaaaaaa

SEQ ID NO: 11424 - DNA, 480 bp, Homo sapiens
taaggaaaaactaaggaaattgcactaaacagtggacctagattaataataatgtatccatactgattcatcagttgtgacaatgtatcagactaatgtaagatggtaagaaggcaaactgagtgtgaggtatgagggaactccctgtactatctttgtaatattttttataagtctaaaactattctaaaattaaaagtttacttttgtaaaaaaaaaaatgacatctcaaacattaatatttcatttcaagttctaaatcagtgatatggtttggatatgtttccccatcaaatcccacatcagattgtaatccccactgttggaggtggtgcctggtgggaggtgaccaggtcatgggggcggtttctcagtaatggtctaacaccatccccttaatgctgtcctcaagacagtgagttctctggggccgggcgcggtggcsacsctgtaatcccagcgctttgggaggccgaggtg

SEQ ID NO: 11425 - DNA, 457 bp, Homo sapiens
acactctcccatttgtaatgaactgtaagtatattctcacaaatggatgcattttggagtaaaatatggtaactgacagttccttcttaattttcattgtagtatcattggaatctgaccaacatcctggaatttttattgctaacttttaaggaaaaaaatgaaggccgggcacggtggcttatgcctgtaataccagcactttgggaggccaaggcgggcggatcacgaggtcaaaagatcaagaccatcctggccaacatggtgaaaccccgtctctactaaatacaaaaattagctgggcatggtggtgcgtgcctgtagtcccagctactcgggaggctgaggcaggaaaatcacttgaacccaggaggtggaggttgcagtgagccaagatcgcgccaccgsactccagtgtggcaacagagccagactcatcacaaaaaaaaaaaaaaaa

SEQ ID NO: 11426 - DNA, 309 bp, Homo sapiens
  misc_feature 144: n=a, g, c or t
tagctgttatggtggccgggagcagtcatcacgtctgttctcccggcattttgggggactgaagcgggcggatcacctgaggtaggaagttcgagagcagtctggccagcatggggaaaccccgtctctactaaaaatacaaanattagcagggcatgctggcacaagcctgtaatcccagctactccggaggctgaggcaggagaatctgttgaacccgggaggcaggggttgcagtgagccaagatcacgccgctgcactccggcctgggtgacggagcgagactccatctcaaaaaaaaaaaaaaa

SEQ ID NO: 11427 - DNA, 309 bp, Homo sapiens
tagctgttatggtggccgggagcagtcatcacgtctgttctcccggcattttgggggactgaagcgggcggatcacctgaggtaggaagttcgagagcagtctggccagcatggggaaaccccgtctctactaaaaatacaaaaattagcagggcatgctggcacaagcctgtaatcccagctactccggaggctgaggcaggagaatctgttgaacccgggaggcaggggttgcagtgagccaagatcacgccgctgcactccggcctgggtgacggagcgagactccatctcaaaaaaaaaaaaaaa

SEQ ID NO: 11428 - DNA, 198 bp, Homo sapiens
aaatacaaaaaattagctgggcgtggtggcgggtgcctgtagtcccagctactcgacgctcagtagctattcagtagctactgaggcrggagaatggcctggacccgggaggtggagtttgcagtgagccgagatcctgccactgcactccggcctgggtgacagagcaagactctatctctaaaaaaaaaaaaaaaa

SEQ ID NO: 11429 - DNA, 198 bp, Homo sapiens; identical to SEQ ID NO: 11428

SEQ ID NO: 11430 - DNA, 230 bp, Homo sapiens
caaaacaaaacaaaaccaaaccatccatggaaatgttcctacctggacttaggatgggagacggagagttctccctgacagggtaaaagaagccttgacttggccgggcgcggtggctcatgcctagaatctcagcactttgggaggccgactcgggtgattcacctgaggtcaggagttcgagtccagcctggccaacawggtgaagccccatctctactaaaaataca

SEQ ID NO: 11431 - DNA, 180 bp, Homo sapiens
aaaaatacaaaaaattagccgggcatggtggcgggtgcctgtagtcccagctacttgggargctgaggcaggagaatggcgtgaacctaggaggcggasttgcagtgagctgagattgcgccactgcactctagcctaggtgacacagcgagactccgtcaaaacaaaaaaaaaaaaaaa

SEQ ID NO: 11432 - DNA, 393 bp, Homo sapiens
ctttctccccgccgcattcccggtgtcgacttactagctgcaascctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggasccsgggggccgcgccttctctcgcttcggactgcgcaacgctgcgctctgggctgacaggcggataaaacggtcccatcaagactgagaaaaagcacaccagctattggcacagcgtgggcagtggggcytacaggatgactgacttagtctacagagatcccggcgtactt

SEQ ID NO: 11433 - DNA, 378 bp, Homo sapiens
ttgcattatctaaagtctctgaaacgatgcttaaatgaagtgaggtcagaaatcaccaccataagatgccaacacaactttgatgttgaaaactcggccaggagcggtasycatgcctataatctcagcactttgagaggccaaggcgggtggatcacttgaggccaggagttcgagaccagcctggccaaaatgatgaaacccccatctctactaaaaatacaaaaattagccagatgtggtggttcacacccgtagtcccagctacttagtaggctgaggcatgagaatcacttgaacctggaaggcagaggttgcagtgagccaagatcgcgtcactgcactctatcctgggtgacagagcaagactctgtcaak

SEQ ID NO: 11434 - DNA, 291 bp, Homo sapiens
tatatgtttggctgggtgtggtggttcacgcctgtaatcccagcactttgggaggccgaggcaggcggatcacaaggtcaggagatcgagaccatcctggctaacacggtgaaaccccatctctactaaaaatacaaaaaattagccgggcatggtggtgggcgcctgtagtcccagctactcgggaggctgaggcagaagaatggtgtgaacctgggaggcggasttgcagtgagccgagatcgagccagtgcactccagcctgggagacagagcgagactctgtctcaa

SEQ ID NO: 11435 - DNA, 472 bp, Homo sapiens
ttactcttttgtactcgtgtataagtaggcacataggaaattactacctaggtcatattgttatcaacwgaataagataggaaaaagtgtggtcctacttctgcctcaacaccatcctcaccgttgacatttattgcgtttctctggactgacttcatagtttaaacgtcaagagaaggccgggctcagtggctcacgcctgtcatcccagcactttgggaggccgaggcgggcgggtcacgaggtcaagagatcgagaccatccgggccgacacggtgaaaccccgtctctattaaaagtataaagattagctgggcgtggtggcgggcacctgtagtcccagctactcgggaggctgaggcaggagaatcgcttgaacccagggaggtggcggttgcagtgagccgagatcacaccatcgcactccagcctgggcgacagagcgagacgccgtctcaagagaaataaatt

SEQ ID NO: 11436 - DNA, 102 bp, Homo sapiens
gtttgtcctcaaaaggaataaaacttttctgctgataagataaaaaaaaaaaaaaaaaaaaaaaaaaaaaaaaaaaaaaaaaaaaaaaaaaaaaaaaaaaam

SEQ ID NO: 11437 - DNA, 436 bp, Homo sapiens
  misc_feature 197: n=a, g, c or t
gggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggwwatcacgtttangaattactacasagcttttttgagcatccgtgtccgtcagtacacctcagcwyacacacctgccaagtgggtgacctgcctgcgggactactgcctaatgcctgacccacacagtgwkgagggagcccaggagtatgtatcgctgttcaagsatcagatgctgtgtgacatggctagaatatcggagctacgctgattctgcggsagcatcaccactgtggctgtctttcacagtggag

SEQ ID NO: 11438 - DNA, 261 bp, Homo sapiens
tgaaggdtctctctctctcatttgtkttggattatttggatcaragcattgtctgmtttctttttkratttcattctatgtagaraagtactcttcatagaakagcaaggmgtmaagttgtttggggycagacttggcaagtagatgtgaamattcttgatgttttaaaagtagcatataggctgggagtggtggctcatgcttgtaatcccaggacttcgakaggctgaggccgatatcacttgaggtcaggtgtttgag

SEQ ID NO: 11439 - DNA, 504 bp, Homo sapiens
actcttgaccattttgcaggggccagcaaactacagcctgtgggccaaatcattccacagtctgattttggtctttttttgagatacagtctcgctgtattacccaggctggagtggaatgcacgatctcgactcactacaaccttcacctcctgggctcaagcaatcctctcacctctgcctcccgagtagctgggactacaggtgtgtgctaccatgcccagctaattttagtatttttttgtagagacggggttttgctgtgttgcccaggctggtcttgaactcctgagctcaagcgatctaccaccttaggcttccaaagtgccacagtctgttttttgtatcctttgagctaaataattgctatcttttaaagggtgtgggggaaaaaaacccaatatgcagaggctgtatgtggcctacaaaaccaaaaatattttactatctagcctttttcagaaaatttgctaatccctaggctaggacagtgtactgcaaata

SEQ ID NO: 11440 - DNA, 506 bp, Homo sapiens
catatagtacaaaattaacactgaatccatcttaaagaaagtattttatcataaataatatacaagctggcctgcttaagaaaagaactcatttaaagttataagggcaagtgaatgagactatctgaaatgagcacataaaatactctttgattagatatttagtgaaatgtcataaaaggattttgtttcctggaataagaggagcatctgccgttatatagaatagctatagaattgtcatctttcacattttctcagtagccaaaggtcagaaatatatatagtaataccttagtatattaagaggctttcatatgtttgtttacttttttcagtaccttttctctttaaccactgtgaagaagttattttcttattcatggctagttttcttcaatgtaccttttcagttcttaataattatgaaggaatgagcttcctacatccattgtttatgcaacctttgctttatattaatgttaagaaacagtccagtcataggc

SEQ ID NO: 11441 - DNA, 452 bp, Homo sapiens
cgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcarctcggcagcagctctgagggcagctcaatgaaaaagtgaatgcacacgcccttgttggcgtggcctggcatgggcctggtgctatcggcarccgmtctccactccccgamtgatactcaattacgtgaagscaaga

SEQ ID NO: 11442 - DNA, 255 bp, Homo sapiens
gatgttgaatttggaaattggaggggacgctggtggacggattgggtgcaaggagttggtgttgatggaggagcakgacgccagagtcccasmcctggaaccgttcagagtggagcasgcwccacctgtmatctactatgtccctgacttyatctccaaagaasaggaggaktattttgcttcgacaggtttttaatgccccaaagccaaagtggacccabctctctggragaaagttacakaactggggtgggc

SEQ ID NO: 11443 - DNA, 244 bp, Homo sapiens
cacacaggtcaagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccarcgcctgccgcagcctcttcgggccggtggaccacgaggagc

SEQ ID NO: 11444 - DNA, 396 bp, Homo sapiens
crktaattcagttttagacacatggatagttagttttatgggcctggagctcagaaaagagaggtctggttaaagaggtaaatttgagaggcatatgcatttatatggaaaacagagacgtaggagtagatgagatcaccaaggagagagtcatgattgaggaacccaacttgaaaattttagaaaagaggaaaggactcagccagaaatatgtagaagcagttaagagagattaaagaaggaatagaggttgttgttgttcacagaagctaagtggagtagaagagtggtgtttttggaaaaattgacaagsctgattgtaaacttaatagggaaatgcaaagtgcttgtaaagatcaatgaagrttggaagattttgctatacttactattcaa

SEQ ID NO: 11445 - DNA, 261 bp, Homo sapiens
agtcagagcgagaacattccagaggtcgcccagctccggcgctgacgggtgtggaccgmrgacgtcgctgggacagcccctccccgctgctcggcggcggcacctggccmrgccgctcctcgctgcgcttcgmmtcmrcctcctcggactcggactcgggtttatatcgcgcctsacttcatyccagkcccgggcgagcagcgttgggtttatgtctttatttgacgaaaacragctgttgcscagccattggtacctgta

SEQ ID NO: 11446 - DNA, 137 bp, Homo sapiens
gagggtgcgggcggcgccttggaggttcctgctgttcctgcttttcggggcgggggccttccgggtcactgtcccgccagctgttggatctgcaccagtaacttctccaggaaaatcccccggagaggaggatctgc

SEQ ID NO: 11447 - DNA, 367 bp, Homo sapiens
acatatggtaagtgctcaaaaacttagctaattttataattgkaattgcttttacctacttttagagcacagagtctttgtcatatcattaaaagagcaaatgattgatttaaaaatcaatgaatcttctgtggacaggttatgaaaaatatgttgattaaaaaagtcttgaatgatatttatcttcttggatatcacctaattgcaagtctttctcttttctcaattaaaaaaaaaacataacataaaaatttcaggagaattgcttgactccaggaggcagaggttgcagtgagctgagatcaagcccctgcatactgcatcctgggcaacaaagcaagactctgtcccaaaaaaaaaaaaaaaa

SEQ ID NO: 11448 - DNA, 346 bp, Homo sapiens
tggaatgaattacagaaacaaaaaataaagacagaaaacaagagatggaaagcctaacgtgttcgttggagttccagaaagaaaatgggagggaggccaaggcaggcagatcacaaggtcaggagttcaagaccagcctggctaacatggtgaaaccccatctctgctaaaaatacaaaacttagctgggcatggtggcgcgtgcctgtaaccccagctacttgggaggctgaggcaggagaatcgcttgaacccaggaggtggaggttgcagtgagccaagatcgtgccactgcactccagcctagcaacagagcgaggactccggcccaaaaaaaaaaaaaaaa

SEQ ID NO: 11449 - DNA, 486 bp, Homo sapiens
ttatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatgttccattgtggtatctcctatttcatttaaaagcacttccattctttccatatattctgctgagatttgtttatggctataaatgagatatggatgggtggtcactgagataattaatatggtttagaactactgattaataaatctaacaggagaccaggakaggcatgacaagaaaatcttaaaaacaggaaaaacccaaaggagagaactaaattaccagtttctaatcatagatactatcttccatttcattgtatagcagtagtatcataagatatgccattttctcagctatctgaaaattttaaaccaatttt

SEQ ID NO: 11450 - DNA, 318 bp, Homo sapiens
rbkrraggaaagtccaatgcctgcagcccacctcagtttccttcagtccccaatttctaggttaatgctccaagatcacagccagacttcaggcccaggcctcaccatagcactagatgttgcttctagaatcaagcactgagtggcttctagaactgaggcactacatcaaaccttcagaaaggccaacgcccgtggttctcaaagtgtggtcaggccagggacccctgggagtccccakaccctttyagggtccccmymmsgycaaatgattttttataatcatactaaratgtcatctaccctttyycacccttw

SEQ ID NO: 11451 - DNA, 352 bp, Homo sapiens
kggvrktctttgacccctccatgtgactaaaatttaagtttcattttaaaacatgaagataatgatatgtctgtttctgaaccactggattgaaaatttacacatggatgagttccataatttcacatgtttaattggtcattaaggctaccttagcaactgctacatcaaatgatagcttttgactgggcatggtggctcacacctcccaaagtagtcccagcattttgggaggccgaggcakgtggatcacttgaggtcmggagtttcgagaccagccctggccaacatgggaaaaccccgtctctactaagaatacaaaaattagccaggcatggttggtgcgtacctt

SEQ ID NO: 11452 - DNA, 241 bp, Homo sapiens
cggatttggaagtcataaacgtagttttgaaagcatgagaacagaggatattacccaaaggatacatgagggataaaatgaaaagaagggcaaggatggaacctgggggaatattgacgtttaatggaagggaaatggaagagcatctcatagatggatgagaaaggagcactctgagagttaggagaatcgggatgcctgggagtcacaaaggcccaggaaagtgagaacaccaaggaak

SEQ ID NO: 11453 - DNA, 499 bp, Homo sapiens
aatagcaactcgaactgacactgccgggtcgcttcggcaccttcaaatccacttcactggacaaacctaagtacatcagaagtgccgccgtaaaaaaggcagcagccaacccttccgcgtagggatcaaagatgacctgcacgcataactgcaaatgaaagcctcgggaagagtgagaatgacggaagcgaaatggagcagtgtaatacaatgaaataagttggcaaactgaaatttactcagtaattgagatgactgacttacaggaaaccaccagctatagggaacccaggtaactaaaacaccaagacccggattcagctggtctcattacctgcctctacccacttccccattccgtgcttccctcagcggatcgcctatatgcaccgggttcttaccgtatgtgggggatgccaaccccaccttgaagaatcttatagagcttgctctcgtacagcaactggggatgcctggccttctgagattctagcttcac

SEQ ID NO: 11454 - DNA, 495 bp, Homo sapiens
  misc_feature 489: n=a, g, c or t
taaaaataactgggttaggctgggtgcagtggctcacgcctgtaatcccagcactttgggaggccgaggcgggcggatcacgaggtcaggagtttgagatcaacctggccaatatagtgaaaccgtgtctctactaaaaatacaaaaaattagctgggcatgttgatgggcatctgtaatcccagctactagggaggctgaggcaggagaattgcttgaacccgggaggcggaggttgtggtgaactgagatcacatcattgcactccagcgcgggcaacagtgcaagactccgttttaaaacaaaacaaaacaaaacaaaacaaaacaaaacaaaacaaaactgagttagagtggggctgtattcttagctacccagaaggctgaggcaggattatcccttgagcccaggaagtggaggctgtagtaacctattatcatgccacttgtactccagcctgggtgacacagtgagaccctgtctcaaaanaaggaa

SEQ ID NO: 11455 - DNA, 117 bp, Homo sapiens
aaaacacatggcgtttacgactgtctgggaagcctgacgccgtgacctcccgacgccgcgagactcaaggaatgaacataataatttcctactattctgccaccgcgatgccgaagy

SEQ ID NO: 11456 - DNA, 286 bp, Homo sapiens
gtttttttgaggtgggtttttttgttttgttttttttttttaagttatgattgaatcactttgcctttaaggtggtgtggaagtaatttaattatattcagaactcgggcaggaaacatttgcaagtctaatatttgttggattcctaaagaaacagaatgctccagatcagtttcctgtatttttgtctatcatctaatctaagagtcacaggtactgtttcctgcatttaacagtgtcagacatgtagtgccaaacccaggaatcttgctggcgttaggttttt

SEQ ID NO: 11457 - DNA, 374 bp, Homo sapiens
acagatccaggctgtctcttgcggtgcgcatgcacttaccgtatcgttatcaacgtctccgaggcagattgcgtgcgggaagaggctcccgctgaactccagcgccacgcgttcaamcgtagctaactgacctcatggcacctccaagagcagagggagcggagaggcccagtaaatattccctgaacccccgtcgcgacascgccagagcgraaggccacctaaggcagcaatttacgtcactgcctgaacctccaatctctgcctcttcctcctttaaccttacagaggaggcgggtcttccgggcttggaggcgggcttcccaactctgatgatgcagactggaagaaacctcaggaatgctttcgatttt

SEQ ID NO: 11458 - DNA, 366 bp, Homo sapiens
ataagtaagaaactggctgggcgctgcctgtaatcccagcactgtgggaagttgaggtgggcagatcacatgagtttgggtgttcgagaccagcctggccaacatggtaaaacctcctatctacgaaaaataaraaaattagccaggcatggtggtgcatgcctgtagtcccagctatttaggaggctgagggagaagagttgcttgaacctgggaggcggaggttgcagtgagctaagattgtgtcactgcgctccagcttggggaacagggagagactctgtctcccctcccccccaaaaaaaaggccaggtacagtggctcacacctctaatcccagaactttaggaggccgaggcaggcaga

SEQ ID NO: 11459 - DNA, 365 bp, Homo sapiens
tatatggaaatgcctggatatccaggctgaaatttgctaggggtcggggtcaggggcctctcatggagaacctctgctagggcagtgcagaagggaaatgtgtggtaggatcccccacagagagtccctgctggggcactgcctagtggagctgtgagaagagggccaccatcctccagcccccagaatagtagatccaccaacagcttgcactgggcacctacaaaagctgcagacactcaacaccagcccatgaaagcagctgggagggargctgcaccctgcagagccacaggggcagagctgcccaagaccatggggacctacctcttgsgtcasatgacccaatgcgagacatggggtca

SEQ ID NO: 11460 - DNA, 388 bp, Homo sapiens
tgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacg

SEQ ID NO: 11461 - DNA, 350 bp, Homo sapiens
gttcgagaccatgctgctgttctgccccggctgcgggaacgggctgrksgtggaggagggacaacgctgccaccgcttcgcctgcaacacgtgcccctacgwgcacaacatcacccgcaaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcc

SEQ ID NO: 11462 - DNA, 373 bp, Homo sapiens
  misc_feature 205: n=a, g, c or t
ccatgtcagaatgggggcatctgccaacgcccaaatgcttgttcctgkscagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatngtggaaaatgtgtaagaccaaaccgatgtcactgtctttcttcttggatgggacataactgttccaggaaaaggaggactgggttttaaccactgcatgaccatctggctctcccaaaagcaggatcatctctcctcggtagtgcctgggcatcctggaacttatgca

SEQ ID NO: 11463 - DNA, 384 bp, Homo sapiens
actttcagccctggaagctggccaagagcgtatctttgaagcacagcaaaggatgagacttctgtgagcagcgaggattttgatatgagcgactccacatggatgtcagctgacccgcacctggcctccagcctgagccccagccaggacgagaggatgcggasccgcagaacctccacagtcaagaggacgggccccaccgcttgagccacctgtcccaaggcctgaacatcatctgcagcttggacacctctctacgggccaggaaccccagggtctctgcagagagaaatgatttcagttttaggggaagatctaggtgtgtgacgtctaattcattagccaaggacggctactgagccttggaaaaggctagtgcagaca

SEQ ID NO: 11464 - DNA, 372 bp, Homo sapiens
ccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcacca

SEQ ID NO: 11465 - DNA, 349 bp, Homo sapiens
acagatccaggctgtctcttgcggtgcgcatgcaywwaccgtatcgttatcaacgtctccgaggcagattgcgtgcgggaagaggctcccgctgaactccagcgccacgcgtcaacgtagctaactgacctcatggcacctccaagagcagagggagcgkagagscccaktaaatattccctgaacccccgtcgcgacascgccagagcggaaggccacctaaggcagcaatttacgtcactgcctgacctccaatctctgcctcttcctcctttaaccttacagaggaggcgggtcttccggggcttggaggcgggcttcccaactctgatgtgagtgacaggcccac

SEQ ID NO: 11466 - DNA, 375 bp, Homo sapiens
  misc_feature 138..139: n=a, g, c or t
atgtgggtgtgggtgcatgtgggtgtttacacacatgcctrcaggtatgcgtgattgtgtgtgtgtgcatgggtgtacagccacatgtctacctatgtgtctttctgggaatgtgtaccatctgtgtgcctgcagcgnntgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctg

SEQ ID NO: 11467 - DNA, 386 bp, Homo sapiens
gacggagcgcgggccccctcacagcgacagkgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggc

SEQ ID NO: 11468 - DNA, 398 bp, Homo sapiens
acataaaaaattttaagatgtagctaaaactgtgtattgggggaaatttattatcttaagggctagaatcgatagctttaaacaaaaattacctaggtatttatctcaataagttagaaacaaaatgcaattaaacttgaagaaagcataagaaaagttaagagaaaaaagtaatgaagaaaatgtacagtaggctaggcatggtggctcatgcctgtaattctagctctttggaaggctgagatgggtggatcacttgagcctaggtgtttgagaccagcctgggcaaccaaatgagaccccccatctctagaaaaaatttaaatattagttgggtttcattgtgcatacctccggtcccagctacacagaggctgaggtagggggatcgcttgagc

SEQ ID NO: 11469 - DNA, 453 bp, Homo sapiens
cacccagctgcgggctgttccacagtctgagggggctgtcaggccttgaagggctgaaagggagcccaccaaccccatttctgctcagcccctgccctagcactttctaagtactagtttggcctcctgtcatgggctctgagatttcagggtgccattaaaaagcctggctcgggcgcagtggctcatacctgtaatcccaacaatttgggaggccaaggcgggcgaatcatttgaggttacaagttggagaccagcctggctagcatcacaaaaccctgtctctactaaagatacaaaaattagccgggtgtggtggtgcgtgtgcttgtagttccggctactcgggaggctgaggcacaagaatcacttgaatccggtagccggaggttgcagtgagctgagattctgccactgcactccagcctgggcaaacagagggagactgtctaa

SEQ ID NO: 11470 - DNA, 283 bp, Homo sapiens
tccggtgagttcagggcggttgcctttagggtgtgtccctaattgacggggtcggggacggagagaagggtaacaccaggctgggtcggagacggcggaggcgaggaaatcctaagagcgtgaccgttgatgatgcagggaaccgtcgggtgtgaccattgagagggaaaaggtgcacattaaagatccaaagtcatgactgactccaagtatttcacaaccaataaaaaaggagaaatatttgaactaaaagctgaactcaacaataaaaaaaaaaaaaaaa

SEQ ID NO: 11471 - DNA, 446 bp, Homo sapiens
acatttataatatatttcaaaaggttgctatgaggattaaatatgttaataaattaaaatagaagtgtctgatagcatttactaaatgtttcatttactgaattgtttcatttattccttaaaacaactcagctctattctcggagccgttacttgcagctcagcattgttataaggaataaatgaaacaaaaagtacttaacatagtgcctccacataagatatcacaagctgctaactactatttttgttatgcattgtctgaagataagtcacaaagttggttcttagctttcaggtaactaatagtgaagggagaaaagcaaccacttaaagaatttacaggccgggcgaggtggctcacgcctgtaatcctagttctbvgggaggcagaggctggtggattgcttgagctcaggagttcgagaccaacctggtcaacatgg

SEQ ID NO: 11472 - DNA, 425 bp, Homo sapiens
aaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataa

SEQ ID NO: 11473 - DNA, 311 bp, Homo sapiens
caaatggtgagatgctaaaagcactttgagctttagggagttcaaagtggccaggcaaattaaagttatgtgacctatctgagaatatagcatagttctttgtgagaaaagaaagtgagatatttgtgctttgttggaaataaaaaagattttaaaaactcaaggctgggcacagtggttcacacctgtaatctcagcactttgggaggctgaggcgcagatcgcttgagctcaggagttcaagaccaacctgggcaacatggcaaaaccccatctctaccaaaaaaaaaaamcccaaaaaaaaaaaaaaa

SEQ ID NO: 11474 - DNA, 441 bp, Homo sapiens
atataatgaattagagaacattatgctaagtgaaataaaccagacacagaaagacaaatactacatgttctcagttatatgtggaatctaagacaattgatttcatagaggtggaatgtagaatggtagttaacaaaggctagggatttgggagattggggagaagatgatcaaagggtgaaaaatcttaggagaagtatgtttttttaaaaagtctattgcataatgtggtaaatatagttaatagaatattctatattacaaaattgcaaagagaaatttcaaatattttcactacaaaaatgttgagtatttgaggtgatggatatgttaactagcttgatttaattattctacattgtattcataaaccatcactttgtaccccataaatgtacccaataataagttgtcactttacaatttaaaaattgtatattc

SEQ ID NO: 11475 - DNA, 367 bp, Homo sapiens
cagtagctcaggacggaactgtatttggagacagagccttcaaagacacaaatgagttaaaatgaagccatagtggcccgaatccaacgtgactgttgccgttataataagagattaggacacagacatgtagagagaagacggtcacctatgagccaaggagacaggcctccaagacactaacctgaaccccccacttcctctttgctgccccttcactttcttgctgcccctttcccagtctctcttcacacccactcctggtctgtcctgatcccctcttctgtatcaggtttattggttgtacatataaattatactttcctttcaaaaaaaaaaaaaaaaaaaaaaaaaaaaaaaaaaaaaa

SEQ ID NO: 11476 - DNA, 348 bp, Homo sapiens
  misc_feature 275: n=a, g, c or t
aagaaaatcacagagaagcaatatatgatggacaatcaatgagaattttcaaaaactaggctgggcgttttggctcatgcctataaacccagcactttgggaggctgaagcaagtggatcaactgaggtcaggagttccagaccagcctggccaatatggtgaaacctcgtctctactaaaaatacgaaaattagcctggcgtggtggcgtgcacctgtggtcccacctactcaggaggctaaggcaggagaatcgcttgagcccggggggcagnaggttgcagtgagccgatattgtgccactgcactccagactggatgacagagcgagactccatctcaaaaaar

SEQ ID NO: 11477 - DNA, 178 bp, Homo sapiens
aacttctcctcctgcagccgggagcggcctgcctgcctccctgcgcacccgcagcctcgcccgctgcctccctagggctcccctccggccgccagcgcccatttttcattccctagatagagatactttgcgcgcacacacatacrtacgcgcgcaaaaaggaaaaaaaaaaaaaaaa

SEQ ID NO: 11478 - DNA, 149 bp, Homo sapiens
  misc_feature 95: n=a, g, c or t
acagccttgcagcdtctccggaartsgaggcgggacggcacggcagccactgcttggggtagcgggagggcagactctgggcgccactcccgggncggtcatgaacgggccggcggacggcgaagtgvactacaaaaaaaaaaaaaaaa

SEQ ID NO: 11479 - DNA, 418 bp, Homo sapiens
  misc_feature 41: n=a, g, c or t
agacgcgccaggtctgtagcaggaggccgcgcsaggggggntccccagaagcctacagtttgggaagctgaaagtctgaaatgaagatgccagcatggttggattttgtgaggaccctcttcctcgtgtacgaacagctgtcttgttttatcctcacgtggcagagtgggagctctctgatccctttatctccttacagacttgaatctcattcatgagagctccacccccatgacctaattacctcctaaaggcccccatttccaaatactgtaatattgggaatttaggggtcaacatatgaatttcagagggatacaaacattcagtccatagcacgttgattaaaaaattgcttaaagggcagcacaaagaagatgtacagccagaacagaagacttattcaaactctaaatcc

SEQ ID NO: 11480 - DNA, 415 bp, Homo sapiens
tacaaaaaattagccaggcatggtggtatgcgcttgtggtcccagctgcttgggaggctggggtgggaggatcacttgggcttggaaggtcaaggcgaggctgcagtgagccattatcagaccactgcatgccagcctgggtgacagagcaagacactgtctcaaaaatttttttaaataarrrataaataaactcttggtggggcacagtggctcacacctgtagtcctagcactttgggaggttgaggcagtattgcctgagcccaggagttcaagaccagcttgggcaaaatagtgagacccctgctttaaaaaaaaatgaaaaaaattggctgagcatgatggcgcacacctatagtcctagctactcaggaggctgaggcaggaggatcacttaatcccaggagttcagg

SEQ ID NO: 11481 - DNA, 393 bp, Homo sapiens
aaaagggaggggaggggagaatcgaggacggacggcctagccaggccaagaatgcaattgccccggtggtgggagctgggagacccctgtgcttggacgggacagggtcgggggactggatctcagcctctgatcagtttcacaaagtttgttccctaaggaaatcaaatcccattgtcacctaactctgaagatctaaatagcccttggatcagtacgggaaccccaaatcccacagggccagatgtggagtctgtgtctgcccccgtmttctctccatcctcaaagcccccacttctctccaggctgtttctttttttatgactgtaaacatagatagtgctttattttgttaataataagataatgatgagtaacttaaaaaaaaaaaaa

SEQ ID NO: 11482 - DNA, 442 bp, Homo sapiens
attgctaaggaattaggaaaacaaaggggaagaacaaatgggttttagagacagatctgggttcatttcccagactcagtcccttcctgactggctttgggcaagctacccaagatctttgagcatgagttactatggctataaggggacatctcctacatcgtagggtagtataaaacatagaacgattagaaatataaacaaacaatttgaattattgtagacactctatataagtagtacaggttgaagatccctaactcaaaaatccaaaatcagtcaggtgcggtgactcggcactttgggaggccaaggcaggtggatcacttgagctcagtctgagactagcctgggcaatatggagaaattctgtctcaaatactaaaattagctggatgcctgtagtcccagctactcaggaggctgagatgggargatagct

SEQ ID NO: 11483 - DNA, 385 bp, Homo sapiens
taagtttatttccaaagcatatagtccttgatgttgagtttatgttaaaagagcagtataagttacattgagcagtatttgttttaaagattcacaatactcacctttgggcatgaggaagggtatattattttgatatcataactgaactctgtagcatagtaatcataaaaatagtgtccttatatgttgtcatggttcagttatctttatcacctccatgtatacctgatgcactttattatatactttctccattgcattgtgattatttgcatgcctctctaccacactggggcatgagatcctctaggcaataaaacatctcattcatattttctgcaacaccttgcttagtatctggcacacaatcattgttcaataa

SEQ ID NO: 11484 - DNA, 476 bp, Homo sapiens
atccttcagtgttaccatgccaaccagcatccatcccaagagttgcctctgaataagccacagttggaggggcctcgttcgagaatctaagtggagtcaaagttctgcttcaccaaggcccacaaaatgggtgagcagcatgcatgggtatgaagaggcaagtaaactgcattgtgtcatccaagtaaaacacagcacggcctcctgccactgacagaccctgtttccataatttctggatgagaaagccaagtcatgtcagtagttaatcagctctggaggaaagtgaacacctataaacacggcagaatgcaatacttccagaaaggcttttaacacctacagaatctaaacattttgtaagaggtggggttaacaagcttgtgtgctatttgggggtggggctgagcatcagaggcaaagtttttcgtaagcctctttctctcgatggattaggcaggaatgactttcctcca

SEQ ID NO: 11485 - DNA, 426 bp, Homo sapiens
casatataattttgtatctccctcsscatccccctgaatacactgactggggtcggactgcctggattcaaatcccagctcttctaagcagaatgtgttcattatgtgcctcagtttcccagtctgtgaaacgagaataagggtagctatgaggaccaattgtaaagctccctggagtaytcagtcctgtgcccagcgtcggcatagacattcctgcctgacagtctcctgccttctcagcgactactctttcacatgccctccctctgctgtgaagtggggatgaaaaccctggtttcctgtaatcccagcacttcgggaggctgaagtgggtggatcacctgaggtcaggagttacaaatagactatagatttcttcctacatttttgtgttttaaaasgatcaagtggccgggcgcagtgggc

SEQ ID NO: 11486 - DNA, 118 bp, Homo sapiens
cttttccgcgggccccgcccaggcggctgcccgtbacctgcctgggcgcggggwactgaaagccggawggggcaagacgggttcagttcgtcatggggctgtttggaaagacccagga

SEQ ID NO: 11487 - DNA, 351 bp, Homo sapiens
agtgcctagcgcaaggttaggtgcatgcaggcggccagcttcggccgggsaaggaatggcctggacaactggggcatcgcggcgctcctcggcctcctgcagctgcgtttcaaagcagagccgacccttggtgggtagtccggggaccctgcggaccctccttgtgttgttgaaacctagtgttttaattgggactacacccagcagtgccgggagacttggcggggacgttccactgcgcaggaagtggcttcaaataacttacacgcgtcactgtgtcgattagctgctccgtgacaggcactatggtaggagctgaggctacaaagatagaacggatgggttgcaaaa

SEQ ID NO: 11488 - DNA, 443 bp, Homo sapiens
gtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaagtaagtaagtggtccagttgctttgtgatgtggtgggctgggaactcaatgtcttgtgatctccctttggatttctctatgcttgctgttggaatataaccaattatacctcagctgtataaattttgttttaatgtggggtactggtgtttgtggtaatcttctgacattgatctatgggagtgactggtgtgacattgaaatctgggtcatggtagattatattaaaacatcagtg

SEQ ID NO: 11489 - DNA, 140 bp, Homo sapiens
ctgtatggsycccggggcgctgggattggggagcgtgatggarttatgcatragattgrcatcatctctggaactcttggcaaggcctttggctgtgtgggcggctacattgccagcacccgtgacttggtggacatggt

SEQ ID NO: 11490 - DNA, 370 bp, Homo sapiens
  misc_feature 212: n=a, g, c or t
ctaattttaaaattgtttttggagatggggtctcaccatgttgcccaggctggtctcaaactcctcggctcaagcaatcctcctgtcttgaccttccaaagtgttgggattataggcttgagccaccattcctggccttaattaatktcttacttaagarcaaaaggggccgggcgcggtggctcatgcctgtagtcccagcactttgggangccggggcgggtggatcatgaggtcaggagatcgggaccatcctggctaacaaggtgaaaccccgtctctactaaaaatacaaaaaattagccgggcgtggtggcgggcgctgtggtcccagctactcgggaggctgaggcaggagaatggcgtgaac

SEQ ID NO: 11491 - DNA, 406 bp, Homo sapiens
aaacactgttctgtgtaaaattttgcataaaacaaaaaattgtacattaaaagaactccattattttacatcaaaaactaaaagtagccaggagtaattaatgttttaaataatttatatatgaaatatattgacggacttcagataaggaaattaaaatgattcctttaagaaccagacattggccgggcgcasggctcatgcccatctcggcctcccaaggtgctggaattataggtgtgagctacccagcccggcttatgtagatgtttttttaatgctgtacaggatatatgcatataaatgacaaaaaggtaatgagaataacttatattttaattatcattcacagctgataaaatactgggaagcattcttacctgaagccaaagccattgcctagcaa

SEQ ID NO: 11492 - DNA, 422 bp, Homo sapiens
cagcttcatctgtatccctgcaaagcacatgaactaatccttttttattgcccaaaccactatggcacatgtatccctgcaaaggacatgaactaatccttttttatggctgcatagtattccatggtgtatatgtgccacgtttttcattatccagtctattgttgatgggcatttgggttggttccaagtctttgctattgtgaatagtgcttcaataaacgtatgtgtgcatgtgtctttatagtagaatgatttataatcctttgggtatatacacccagtaatgggathgctgggtcagatggtatttctggttctagatccttgaggaattgccacactgtcttccataacagttgaactaatttacactcccaccaacagtgtgaaagtgttcctgtttctccacattctctcca

SEQ ID NO: 11493 - DNA, 132 bp, Homo sapiens
cagcttcatctgtatccctgcaaagcacatgaactaatccttttttattgcccaaaccactatggcacatgtatccctgcaaaggacatgarstaatccttkttkatggctgcatagtattccatggtgtak

SEQ ID NO: 11494 - DNA, 106 bp, Homo sapiens
tatcgaaagttaattttgtgttggtataagagagcctgaagtttgttttgtttttctcatggggtatccatttaaccatcatttattgaaaagacccttcttggcc

SEQ ID NO: 11495 - DNA, 392 bp, Homo sapiens
ttttaatgatcaccattctaactggcgtgagatggtatgtcattgtggttttgtctctgtgacagtcttgctctgttgcccagggctggaaggcagtggtgcggtggagctgctcactgcagcctccgccttctgggctcaakcgattctcccaccttagcttcccaggtggctgcgamtgcgggcacatgacaccacgccttggcttatttwtgtttttgtagatatggggttttgctattttgcctgggctggtctcgtactcctgggctcacgcctgtaatctcagcactttgggaggctgaggcgggaggatcacttgrgcctaggagttcvagaccggcctggacaacatggtgaaacccgttgctacaaaaaatacaagaattagc

SEQ ID NO: 11496 - DNA, 366 bp, Homo sapiens
aacggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggaatttgaaaaggtccccctatttatgacgagagcgccatcagaaattgatcccagggagaatcctgacttggcttgtctccagtcaattatttttgatgaggagcgttctccagaaggccaagacctataaagatgagggcaatgattactttaaagmawaagrctacwwgaaagctgtaatttcatacactgaaggcttaaagaagaaatgtg

SEQ ID NO: 11497 - DNA, 79 bp, Homo sapiens
tgwwtatgtcatatagrgtcaaccagttragcagcatatatcaaaacataatggtttttgagatsatttagcattgtaa

SEQ ID NO: 11498 - DNA, 553 bp, Homo sapiens
atttctgtggtatccgcacttgcgtggtgatctggggtataccgttttagtcttgggggtagagtgactgcttgcgaaccagttcagcagtgcctcaggtaagaggacttagttctcccgctgcagcgaagtaaaagaggaaggaggtctgtaccgcgagccgctcccagctcctggtgcggtgcgctgcgtgccgtagaaatttagtaaacgtggttagatgtagagaaggccgagctgctgccggggccacgggagtctttgtgcggtcagcagagggacttgaaagacaggtgaaaggacattggagacaagcccctcaggtctatgttgcttaggaaccttggaccgcctcatcgcactccgctctatcaaaccgttccaaattaagattgctggtgtctcccgaccagataaaagcagtgatctctcagtctcgacgagtccttaaatgcgtttgcaagaggtgttttacataactggagcccagttaattgtaaaacaaacaaacaaacaaaaaacactagatcaatggctagtgagtatctactaa

SEQ ID NO: 11499 - DNA, 504 bp, Homo sapiens
gctggctctctatacctctcgtgtggaaggtgcttagcatgtttaggccccattgcagtgactatcaatgtgagtccaaattccctccacactttctgtcactccttttggacataccatatactgtctcccatcatttatcactgactggccacatggcaccgcttaggagccagatgctgggctaaacattgaagtgacaaccatctggtttactgcccctcccctgcaagaacctaagggctccatggatggaggatgaaggtacaaaacacagggcatgagcagggaatcatgagtgttttggtgctgttgaaacagaaagctcaggacgtaaagtggtggaagaagaggctggtgagagaggcaaggcattaggacgtggagggccttatctgccacgctcagaagcataagccctatgacataggagaagagaaactatcaaaggattataaacgagggtgtgatgtcatcatgaccatacgaaagataggtttgaga

SEQ ID NO: 11500 - DNA, 577 bp, Homo sapiens
aaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagaaaggtatatatatgttttttctaatgtgtgcctttagctctcccgtttgaaaagatataaggggaggctaggcatggtggctcacacctgtaatcccagcactttgggaggccgaggcgggtggattgactgaggtcgggagttcgaggccagcttggctaacgtggtgaaactctgtctctactaaaaatacaaaaattagccgggcatggtggtgcacgcctgtagttccaggtacttgggaggctgaggcaggagaatcacttgaacctgggaggtggaggttgcagtgagccaagatcatgccaatgcactccagcctgggtggcagagcaagactccatctctcaa

SEQ ID NO: 11501 - DNA, 161 bp, Homo sapiens
agaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggtttttttttttttk

SEQ ID NO: 11502 - DNA, 515 bp, Homo sapiens
cctgtccccccagagaataaattatttttaaaaacaaacagtgggaccaaacaacctagatttgaatgccaaattctacttcatactgactgtataactttggtaatttcctaacctctctgaacttctatctcatcatctctcacagtgggttaaatgaaattgcgtatgataaaatacttagcactatgcagttcaccttctaggtagctgctcactaagccctagttcccttctctgaaagccaggcaggcggagatttagctggcctggcctgggcctgtggcagctgttgtgcttgaggtctttattaataggtcactcattactgttgctgcagcagcactctgaacttgggttctgattgattcctgaattactgagaactgttccaaaaaaaatcactttgccctttggcaatgtaaacttaatgacacttgctggtgcagcctaggcagattatttcaggaataccagacattttttattctgttgtagctcagactcaacagctt

SEQ ID NO: 11503 - DNA, 154 bp, Homo sapiens
rtcacgccgcgtggcggacggacggacttacggacgcgcagccttacccgaaaggccatggcggagcacgcccctcgccgctgctgcctgggctgggacttcagcacgcagcaggtacagtcgcctggccgcakggccacggggccgcctcctm

SEQ ID NO: 11504 - DNA, 176 bp, Homo sapiens
ctctrvgtcgtcgcctcagcgccggctcccggmmgggccgcggccgccgaccgttgagccgccggctgagccgcctgctgaagyccctccctcaggaacccctccgccaccctccacctccgaaccgstctcgcggcggcgacccatgtgggggttcaggctcctgcggtcgcccc

SEQ ID NO: 11505 - DNA, 238 bp, Homo sapiens
aaaaaggcgccacggcgggagacaggygytgcggscccgcagcgcccgcgcgctcctctccccgactcggagcccctcggcggcgcccggcccaggacccgcctaggagcgcaggagccccagcgcagagaccccarcgccgagacccccgccccggccccgccgcgcttcctcccgacgcagagcmmaccgcccasvgtagaagatggattgccggcacgctgcagacgatcctggs

SEQ ID NO: 11506 - DNA, 237 bp, Homo sapiens
ttcccttccagccccttttccaggaaccttgccacacccacacctgcagcctcccctccccggccctcccaccactgctgcggcgcggscggccccggccgtgtgctgcgcttgccttaccagctctctcctcgcttttctctcccgttttctctctgctttctctccaactgccagccgatcgggtcaggcaagtccatcccgtcctgagagccccaggccccccttcgacctcta

SEQ ID NO: 11507 - DNA, 177 bp, Homo sapiens
gacttccaggccgcctttcctgctgagaagcacacaggctgtgaccggggcccttcccggaagggacattcggtttttgtggcagggacttccagcctgaggccgaaggaggagggtccaacttcacctttgcccgcccttcccccgcttttttgggtctcctttaactgggacggg

SEQ ID NO: 11508 - DNA, 178 bp, Homo sapiens
  misc_feature 152: n=a, g, c or t
cattagcgagctgctccctccattttgtccccagtctcctttaggcgaactgcgcggttctatgttaaagccacttagctgtgtgccgagcttggaagaaagtgtgacccgttcgacggaacaaaggacatgacagcccggccccgtgcggncactgcggagcgttaggaacattccc

SEQ ID NO: 11509 - DNA, 212 bp, Homo sapiens
  misc_feature 24: n=a, g, c or t
cacataactaactttcgaggcacnggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttttt

SEQ ID NO: 11510 - DNA, 191 bp, Homo sapiens
aaaaaaaggcgcagccactgcctccggagccggggcgaaccaattcctccgttgcggcccccacctgcagtatggagtcgtctcgggggcggsccgggcccgagacggaccttctggctgtagcggaacatcaggccctagtctttggcggcgggccgggccgaacgtcctctgagccgcccgcaggccty

SEQ ID NO: 11511 - DNA, 318 bp, Homo sapiens
  misc_feature 31: n=a, g, c or t
aaaaagtccctgggaagcggccgggcgcggntggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaa

SEQ ID NO: 11512 - DNA, 345 bp, Homo sapiens
tgtcaattttgtttatcttttcaagaaactaacttcttggccaggcacagtggctcacgcctgtagtcccagcactttgggaggctgaggtgggtggatcacttgagggcgggagtttgagaccagcctggccaacacagtggaaccctgtctctactaaaactacaaaaattagccaggtgtggtggcacatgcctatagtcctggctactcctagctactcaggagactgaggcacaagaattgcttgaacctgggaggcggaggttgcagtgagccgggatcgcaccactgcactccagcctgggcgacagagcaagactccagcttaaaaaaaaaaaaaav

SEQ ID NO: 11513 - DNA, 317 bp, Homo sapiens
  misc_feature 30: n=a, g, c or t
aaaaagtccctgggaagcggccgggcgcgntggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaa

SEQ ID NO: 11514 - DNA, 355 bp, Homo sapiens
caattgtttttcattttatagcatcacacagtaaaagtagataaaataattttaatgaaaatacttctgtgggccaggtgcggtggcttacgcctgtagtcccagcactttgggaggccgaggcggcggatcacctgaggtcaggagttctggaccagcctgaccaacatggagaaaccccatctctactaaaagtacaaaattagctgggtgtggtggcgcactcctgttatcccagctgctcgggaggctgaggcaggagaattgcttggactcgggaggcggaggttggggtgaaccgagatcacgccattgtactccagcctgggcaacaagagtgaaactgtctcaaaar

SEQ ID NO: 11515 - DNA, 479 bp, Homo sapiens
gaagaaggctcttacagcatggccgccggtactgcagctgccttagcgtttttgagtcaggagagccgaacgcgggccgggggtgtcgggggcctacgggtcccggccccggtcactatggacagttttttcttcggtattagtgaagggagaggctgagggtggtactggggcggtaagaggtagggatgtgaggcgggaatgcccagggtttcaaggcgtgggtgtgggcggaggactgcttcgctgttcccgcagagaggkggcctcgcacgcacagccaaagggggtggcgagatccctgccccagatgtgttgggcggggccacggcagagcgtcccaggtgttctgagagaagagacggaggtggacgtgtaaatgacccgtccgcccaaggttacacgtgacggcgggttggtgacatcccccgstgcccagccccgtacacacgstcaggcatactcactgttatttctac

SEQ ID NO: 11516 - DNA, 316 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaamccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaa

SEQ ID NO: 11517 - DNA, 314 bp, Homo sapiens
taaaaaagaaggtgggctgggcgcggtggctcacacytgtaatcccagcactttgggaggccgagacgggcggatcatgaggtcaggagatcgagaccatcctggctaacacagtgaaaccctgtctctactgaaaatacaaaaaaattagccaggcatggtggcggggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaaaaaaaa

SEQ ID NO: 11518 - DNA, 299 bp, Homo sapiens
tatacatatataatattatatrkgghkkgkctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttscttcttcttccctcagatttagctgatccttcctcccaccctggccttcctttcctctttsctcctcactctccccgtcatgctccctctgccccgcccccaaaaa

SEQ ID NO: 11519 - DNA, 224 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaaaaaaaaaa

SEQ ID NO: 11520 - DNA, 221 bp, Homo sapiens
tkatktcttagtgaaatcccgtctgtagtaacttacagtatttkrgagcaggcgtccccaacccctgggctgcagaccagtattatctggggcctgttaggaactgggtggcacagcaggaggtgagcattactgcctgagctctgccttctgtcagaacagcagcagcgttggattcgcataggagcacaaactctgttgtaaactgcgcttgtgaggga

SEQ ID NO: 11521 - DNA, 388 bp, Homo sapiens
attttttcattccttatatagtactagcataggactggacacatggtaggcacatttatccagtctcctaagggttctactgtgtgccaggtattgttttaggggatctcaaatatggattaaaatacttcccctgtttgcaagctgttcgcaatctcatgacagagacagataaagagkatgtaaagatactaatagatagctagatcatactttatattaggattaatgctgtagtagaaataaatacactgtgacatgggagcaagaaggaaagaggaacacacagagtggctgaaatgtgcttctcatgtatcttatttgattctcaggctaatcctgtgaagtgtggggrtccttagtcacattactacagatgaggaaacta

SEQ ID NO: 11522 - DNA, 140 bp, Homo sapiens
gttaaatattgtctaatcaggccgggcgcggtggctcacgtctgtggtcccggcactttgggagcctgaggsaggcggatcatgaggtcaggagatcaagaccatcgtggcttacacggtgaaacccacgtctctactaa

SEQ ID NO: 11523 - DNA, 172 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttctcaaaaaaaaaaaaaaaa

SEQ ID NO: 11524 - DNA, 413 bp, Homo sapiens
cccgggagggtgaacttaggcggcgaggagaccgagttctcaggaagggcgaaccctggcggcggggaagctggatccctcagacgggcgaacttaggctacggggaggccgagccttcaggaagggcgaggccgggckcggtggctcacgcctgtaatcccagcactttgggaggccgacgcgggtggatcacctgaggtcgggagttcgagaccagtctggccaacatggtgaaaccccgtctgtaccaaaaatacaaaattagccggacgaggtggcgcgcacctgtaatcccagctgctgaggaggctgaggcaggagaatcgcttgaacccgggaggcggaggttgcagtgagccgagatcacatcactgcactccagcctgggcaaccagagcgggggaaaaaaaam

SEQ ID NO: 11525 - DNA, 147 bp, Homo sapiens
ctgagttgttctacacccacctcatattccatgggagggctgtacagggcttttttaacgaggcctctaagcacaggcatttgtatcctttccagcctttcactattacaatgttgtagtgaataactttacacactgtcatttatt

SEQ ID NO: 11526 - DNA, 298 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctcaaar

SEQ ID NO: 11527 - DNA, 597 bp, Homo sapiens
cttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgyaatagtctgtttcaatcttaaaaagaatcaataaaaacaa

SEQ ID NO: 11528 - DNA, 300 bp, Homo sapiens
  misc_feature 300: n=a, g, c or t
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcan

SEQ ID NO: 11529 - DNA, 303 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagactccatctcaaaaaaaaaaaaaaaa

SEQ ID NO: 11530 - DNA, 317 bp, Homo sapiens
  misc_feature 253: n=a, g, c or t
aaaaagtcmmtgggaagcggccgggcgcggtggctcacccctgtrrkcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccganrtctcgccaccgcactccagcctgggcgacagagcgggactccaccccaaaaaaaaaaaaaaaa

SEQ ID NO: 11531 - DNA, 457 bp, Homo sapiens
taaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgrtattgctaaggavctgaaatcggaggagccagaggcccttttcagtccaggccaacattgtacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctg

SEQ ID NO: 11532 - DNA, 402 bp, Homo sapiens
ttggagttttgctcttgttgcccaggctggagtgcagtggtgtgatcttggctctctgcagcctccgcctcctgggttcaggcgattctccwgcctcagcctcccaagtggctgggattacaggtatgcgccaccatgcctggctaatttttgtgttttwagtggragatggggtttctccatgttggtcgggagtttgagaccaccctggccatgatggtgaaccccgtctctactgaaaatacaaaaattggctgggtgtggtggtgcacacctgtaatcccagctacgtgggaggctgaggcatgagaatggcttgaggtcagcagatggaggttgcagtgggccgagattgtgccactgcaatccagcctagatgacagagcaagactgtctcaggam

SEQ ID NO: 11533 - DNA, 387 bp, Homo sapiens
attaatcatcaagaagacgtaacaggccaggcgtggtggttcacacctgtattcccagcattttgggaggctgaggcaggagaatcgcttgaactcaggaggcagaggttgcagtgagccaaagttgcaccattgcactccatcctgggcaakgagraktgaaactccgtctcaaaaaaaagagaagacataacaatcaaatatgtgtcaacataataaaagaaattcagggccgggcgcggtcgttcacgcctgtaatcccagcactttgggaggccgaggcggacagatcacgaggtcaggagttcaagaccagcctgactaacatggtaaaaccccatctctactaaaaatacaaaaattagctgggcgtggtggcacacgcct

SEQ ID NO: 11534 - DNA, 175 bp, Homo sapiens
tattttaktataratcasgacctttcgtggaactgtattgaaattaattatcctgggcctggcgcggtggctcatgcctgtaatcccagcgctttgggargccaaggtgggcggatcatgasgtcaasagatcgaraccatcctggctmscacggtgaaaccccgtctctactaw

SEQ ID NO: 11535 - DNA, 312 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaaaaaaaa

SEQ ID NO: 11536 - DNA, 61 bp, Homo sapiens
aattgwgttcgcagccgccgccgcgccgccgtcgctctccaacgccagcgccgcctctcgc

SEQ ID NO: 11537 - DNA, 371 bp, Homo sapiens
ctcctgtcttgtctcagcggctgccaacagatcatgagccatcagctcctctggggccagctataggacaacagaactctcaccaaaggaccagacacagtgagcaccatgggacagtatcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgat

SEQ ID NO: 11538 - DNA, 306 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagactccatctcaaaaaaaaaaaaaaaaaas

SEQ ID NO: 11539 - DNA, 313 bp, Homo sapiens
  misc_feature 132: n=a, g, c or t
gattacgcgtcgcarcrcccarrgcccagcgcccagcctccagtgcccgcccctctcggccgcccgacgctctctgctcgcgcttgggctcgcgatggggaagaagtcccgggcggtacccggccgtascantcctgcaactctctccgcmgggtcctcggggcagcacgccgggccgggacccggagccggaacccgacactgagccggactcaaccgcggcggtccccagcmagcmcgcmccgtcggcggcgacgaccaccgcggtgactgcmgcmgcggcctcggacgamtcgccttcagaaggcaaggr

SEQ ID NO: 11540 - DNA, 77 bp, Homo sapiens
argmrcccgggagcgcgaccctcccccggcccggcctggcccggcctggccagtccccgcggtctctgcccgggctg

SEQ ID NO: 11541 - DNA, 463 bp, Homo sapiens
acagacatcgccaggagagcatcgccaggtctgagctgagttctcctctgcacagacttcggagatacagcgaaggcgasagtgttctcctcagcacagacccaggcgggccgggggcaccgcgagggcgtastgcgttctgctcagcacagaccccggggacaccgcgaaggcagagtagcgttctcctcacaacagaccttgggggcagtgctcgctttgggacaactcggggccgcatagacgggatcatggcacaagttgcagtttccaccctgcccattgaagatgaggagtccatgggaagatgaggagtcattgaagatgattctgcggagagcaggatggtggtgacattgctcatatcagctctcgagtccacagatcatggcacaagttgcagtttccaccctgcccattgaagatgaggattctgttgaagatgatgagtccttggagagca

SEQ ID NO: 11542 - DNA, 316 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaaaaaaaaaagc

SEQ ID NO: 11543 - DNA, 297 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctcca

SEQ ID NO: 11544 - DNA, 383 bp, Homo sapiens
tatattgtttcccaagaagttctacttggtttcatttcaaacctgcctggtttttttgtttgtttgtttttatttttgttttgagacgaaktgggggtttcactcttgttgcccgggctggagtgcaatggcgtgatctcagctcactgcaacctccaccacctgggttcaagcaattctcctgcctcagcctcctgaggtcaggagtttaagaccagcctgacgaacatggagaatctccgtctctaataaatatacaaaattagccagacatggtgatgcatgcctgtaatcccagctactcaggaggctgaggcaggagaatcacttgaacccgggagttgaaggatgcagtgagctgagatcatgtcattgcactccag

SEQ ID NO: 11545 - DNA, 456 bp, Homo sapiens
  misc_feature 362,415: n=a, g, c or t
gcgggcagatcatgaggtaaggagatcgagaccatcctggctaagacggtgaamcctgtctctactaaaaacacaaaawattagctgggtgtggtggcagtcgcctgtggtcccagctactsgggaggctgaggcaggagaatggcgggaacctgggaggtggagcttgcagtgagccaaaatcacgccactgcactccagcctgggtgacagagtgagactctgtcccagaaaaaaaaaattgtggaamactttctgctgctcagtatgatgtgaaatctcaacaagcaaaaagattggctaggctgggagcagtggctcaggcctgtaatcccagcactttgggaggccaaggtgggtanattgcttcagctcaggagctctagaacagcctgggcaacatggcaaaacccantctctaaaaaaatacaaaaattagttgggcgtggtggcaca

SEQ ID NO: 11546 - DNA, 296 bp, Homo sapiens
  misc_feature 146: n=a, g, c or t
aaagagcagttcagttcgctcactcctcgccggccgcctctccttcgggctctcctcgcgtcactggagccatggcgttcgcgagacctacccggcggcatcctccctgcccaacggcgattgcggccgccccagggcgcggccgnaggaaaccgggtgacggtggtgctcggtacgcatggggcgacgaaggcaaagggaaggtggtggacctgctggcgcagacgcgacatcgtgtgccgctgccagggaggaaataatgctggccatacagttgttgtggattctgtggaagc

SEQ ID NO: 11547 - DNA, 209 bp, Homo sapiens
  misc_feature 167,174,189,204: n=a, g, c or t
acatgaaaaacagcagttagggccaggcatggtggctcacgcctgtaatctcagcactttgggaggctgaggcaggcagatcatttgaggtcaggagtttgagtccaccctggccaacatggtgagacctcgtctctactaaaaatacaaaaattagctgggcatantggtgcntgcctgtagtcccanctacttgggaggctnaggca

SEQ ID NO: 11548 - DNA, 163 bp, Homo sapiens
gagcaatacttatatagaactcatggtatgctagattctattataagtgctttatacttactgacttatgacattaataactccgcaagtacgactattactgtcattatttcccaggttaaaaaactaaggcacagagaggttaagtatcttgctcattgac

SEQ ID NO: 11549 - DNA, 268 bp, Homo sapiens
ctagaaagtacagttggccaggcatggtggctcaatgcctgtaatccccacacttgaggaggccgggatgggtggattaccttgagctcaggagtttcagaccagcctgggcaacatggtgaaacccatctctacaaaaaaaattacaaaaattagccagacatgatggcccacacctgtgtcccagctgctttggggaagggcttaaaggtgagaggatcacttgagcccaggagattgaggctgcagtgagctgagatcgcgccac

SEQ ID NO: 11550 - DNA, 409 bp, Homo sapiens
gcgggcagatcatgaggtaaggagatcgagaccatcctggctaagacggtgaaacctgtctctactaaaaacacaaaaaattagctgggtgtggtggcagtcgcctgtggtcccagctactcgggaggctgaggcaggagaatggcgggaacctgggaggtggagcttgcagtgagccaaaatcacgccactgcactccagcctgggtgacagagtgagactctgtcccagaaaaaaaaaattgtggaacactttctgctgctcagtatgatgtgaaatctcaacaagcaaaaagattggctaggctgggagcagtggctcaggcctgtaatcccagcactttgggaggccaaggtgggtagattgcttcagctcaggagctctagaacagcctgggcaacatggcaaa

SEQ ID NO: 11551 - DNA, 493 bp, Homo sapiens
  misc_feature 62: n=a, g, c or t
ctagaaagtacagttggccaggcatggtggctcatgctgtaatccccacacttgaggaggtngggatgggtggattacttgagctcaggagtttcagaccagcctgggcaacatggtgaaacccatctctacaaaaaatacagaaattagccagacatgatggcccacacctgtgtcccagctgcttgggaggctaaggtgagaggatcacttgagcccaggagattgaggctgcagtgagctgagatcgcgccactgcaatccagcctgggcgacagagcaagaccctgtctcgacaacaacaacaaaaaaagtacacgctgggcatggtggctcatgctgtatcccagcactttgggaggccgaggtgggtgcatcacgaggtcaggagatcgagaccatcctggctaacatggtgaaacccatctctactaaaaatacaaaaaattagccaggcgtggtggcacgtgcctgtagtcccagctagtcagta

SEQ ID NO: 11552 - DNA, 369 bp, Homo sapiens
tgccacatattatttcaatggactttctcccaacagcagtaatagtctttactgacaggtgttatttacttaggatttgaaagtcccctcaaatatgtttgaagaatatactatctcaaggtctgagatggacagattaagctctttacagagtggccaatggttttttttgctatgtgtgcttgtgatttctcgcacaactgtagcctgtgaaatgttatttgaaatgtacagggagatagaggaggacctgggatacctggatttaagggagaacctggactttctattcgaggaccaaaggtatgctttattcatgttctttttgtttttctgtatctgaaataaatgaaggtagatttaatacaa

SEQ ID NO: 11553 - DNA, 220 bp, Homo sapiens
tcttcagaaggagcagcagccaccgaagaggcacagccctcatgcactccagagaccatgggcagctgcctccatggccgtgtcctgccctgtctcccctcccagccctgggctggctctggcccccgaggagtagacagtaggtccctgtcactgtggctttccttgctttctgtccctgggtcttgccccttgtgccgagctgctggctgcccccctc

SEQ ID NO: 11554 - DNA, 495 bp, Homo sapiens
tccagcccattggtcgccgacctgctaactacaaaaccagcatgcgctgtctgtcctcccccgtggtgcgcascctggagggagggacagggcggtgtggacctcgtcctttcctaagcgatgccacatgctgattctgtgccaccccctcgccaagggagtccgcagaaggacttgaggggcaggtctaggctgggcgatgaggacggtgtgaccctgcgaagtgcacctcccttgctcaaatcggaggggtctggtcctcactgaacagcccgctgaacatctcggtgtcctctcacacacacccggcggggaggtttccagagcatcgsacctcttccagcccagggagccgcctgctctgctaaactctatggggaactgagacatccacctgctgsgtgacccaccgtgsgcaacttcagagctttcagggggtgatgcgggctgtgggctccttsgtgaaaatgtcaccgtctgcagcgcctttcttgt

SEQ ID NO: 11555 - DNA, 376 bp, Homo sapiens
tttctcctaggatgtctgtatctttgaagcaccaccccatgggacatcattttgagtagagttactggtaatctgctactcctcatcagggttccaggggcttggcttagtgctgtactgatagcccttagttagtggtctgggagccttaaacttacagtgtgttacaacgtagacaggtgaagcattagagctcctaggccattaactgaagagttaaaaactgttcatcttcataaggagtttgagtatcttttaaggtgtgagtaaaaacaagaataaaagagttatgaggaagatctgtaggttggatgcaagagaatgaatggggaaatcacagtgaattgttggctttgagggatgtataaaggggatg

SEQ ID NO: 11556 - DNA, 120 bp, Homo sapiens
gctgaggcaggagaatcacttgaacacgggaggcagaggttgcagtgagctgagatcacgcaactgcattccagccttgtgacagggcaagactctgtctcaaaaacaaacaaacaaaca

SEQ ID NO: 11557 - DNA, 320 bp, Homo sapiens
  misc_feature 310: n=a, g, c or t
tmatmaasgggtacaaacgagtcctggccttgtctgtggagacggattacaccttcccacttgctgaaaaggtcaaggccttcttggctgatccatctgcctttgtggctgctgccctgtggctgctgcacacagctgctcctgctgctgctgcascccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaaaaaaaaaaanggaaaaaaaa

SEQ ID NO: 11558 - DNA, 530 bp, Homo sapiens
cacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctggcctaggtccccccttt

SEQ ID NO: 11559 - DNA, 460 bp, Homo sapiens
aatgaagttaggccacaaattctttctagtaggttcaagtatttaagcacctggagaggtgactggttaccctcctagtggcttcaggaagttttctcactgaatgaatatttattgagtgccaactctgctcagcacaattcaggggtgctgggaatgcagcagtgaataacacaagcagtgttccttccctcatggggcttatgatctctggaagcactgctttgcacagggaagtagcaccaggagggggtaaagaaagagggactttggagccccaagattggcaaaaactatagctaatgagagaggtgaactatagtctagataatggggaaggagaggtgccagagcaagaagggattctcacagggccctacgggtcagtcctgaattggctttactagaactcaagcccagcacaatggctcacatctgtaatccaagcgctttgggaggc

SEQ ID NO: 11560 - DNA, 114 bp, Homo sapiens
argccaggaacgcacgctgcctggccgtatcgccgcccccaccgccgccgccgccgggactagaagtgagccgcccgggtcccaaacgccagccagccagtcagtgggtcccgc

SEQ ID NO: 11561 - DNA, 396 bp, Homo sapiens
catggttcatgggtacaatggtgcaggtgatgccccctgcatggttcacgggtacaatggtgcaggtgatgccccctgcatggtttgtgggtgcaatggtgcaggtgatgccctgcatggttcatgggtacaatggtgcaggtgatgccccctgcatggctcatgggtacagtggtgcaggtgatgtcccctgcatggttcatgggtgcaatggtgcaggtgatgccccctgcatggttcacaggtgcaattgtgcaggtgatgccccacaggcctgctattttgattgttcctcccagcttctacttttggagatccacccttcacagactcttcatttgtggtcacttctggctgcaggtggacctgttgggagggaccctttcaagacagctc

SEQ ID NO: 11562 - DNA, 147 bp, Homo sapiens
ctttaggtgtattavgatataaggcsaggctgggcatggtggctcatgcctgtaatcccagcastttgagtggctgaggtgggaggatcacttgagcccaggatttcaaggcgagsctgggacacatggtgaaacctgtmtctgcaa

SEQ ID NO: 11563 - DNA, 324 bp, Homo sapiens
cttgttctatcacccaggctggtgtgcactggtatgttctcgctcactgcaaccactatctstcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctsagccttccaaagtgctgagattacagtcctgagccactgctttcggscttacagaattgttttgttttggggcattcagaagtctgacataaaaattaact

SEQ ID NO: 11564 - DNA, 280 bp, Homo sapiens
gactgacaactcacacggctgggtactcttctgagacaaaacttccagaggagcgatcaggcagcaacatttgctgttcaccaatatccattgttctgcagcctctgctstgatacccaggcaaacagggtctggagtggacctccaaactccaasccacctgcagctgagggtcctgactgttagaaggaaaactaacaaacagaaaggacatccacaccaaaaccccatctgtacatcaccatcatcaaagaccaaaggtagataaaaccacaaacat

SEQ ID NO: 11565 - DNA, 387 bp, Homo sapiens
aaaaatacctctaggtgttccggacactatgtgcctatagctggctacaggatcacagcagccaaaagccctccaggaagaagtatggaagcagctttattgaggttgccagcaaggattacggcttctttgacgcatgaacgttttggaatttatgaggattttaatgaggattttctgaaaaaaataaaaatgtagcctctttggatcttcatttaatcatccgttgggggaaaaaaaaaggaaaagaaggatttgtctagagaaatgcctgtasaccctttaaacagtgcttatcacataatacagtgttatgatctgggcattcatctatcctctcatcagcttttgatctaccacatcttgggatatgaataatgtttctgt

SEQ ID NO: 11566 - DNA, 148 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgcaaaa

SEQ ID NO: 11567 - DNA, 318 bp, Homo sapiens
tattttattataaatcaggacctttcgtggaactgtattgaaattaattatcctgggcctggcgcggtggctcatgcctgtaatcccagcgctttgggaggccaaggtgggcggatcatgaggtcaagagatcgagaccatcctggctagcacggtgaaacccgtctctactaaaaaatacaaaaaaaattagctgggcatggtggtggtgcctgtggtcccggctactcgggaggctgaggcaggagaatggcgtgaacgtgagaggtggagcttgcagtgagctgagatcgcgctactgcattccagcctgggcaa

SEQ ID NO: 11568 - DNA, 305 bp, Homo sapiens
aatggtagagacaggstttcaccatgttggccaagctggtctcaaactcctgacctcatgcctgtaatcccagcattttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggt

SEQ ID NO: 11569 - DNA, 200 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaaa

SEQ ID NO: 11570 - DNA, 200 bp, Homo sapiens; identical to SEQ ID NO: 11569

SEQ ID NO: 11571 - DNA, 111 bp, Homo sapiens
ttaggcccaagaattacctgaacctgggacgtggaggttgcggtgagccaagatcgcaccactgtaccctagcctgggcaacagagtgactcttaaaaaaaaaaaaaaaaa

SEQ ID NO: 11572 - DNA, 93 bp, Homo sapiens
ctttaggtgtattaagatataaggccaggctgggcatggtggctcatgcctgtaatcccagcactttgagtggctgaggtgggaggatcactt

SEQ ID NO: 11573 - DNA, 172 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaaag

SEQ ID NO: 11574 - DNA, 159 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgcaaaaaaaaaaaaaaa

SEQ ID NO: 11575 - DNA, 173 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttctcaaaaaaaaaaaaaaaaa

SEQ ID NO: 11576 - DNA, 408 bp, Homo sapiens
gactgacaactcacacggctgggtactcttctgagacaaaacttccagaggagcgatcaggcagcaacatttgctgttcaccaatatccattgttctgcagcctccgctstgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcstctcttcctccgaagaattgcacctcctcaccagcaatggaacaaagctggagggagaatgactttgacgagttgagag

SEQ ID NO: 11577 - DNA, 311 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttgttatcacaccactgcactcctgcctgggtgacagagcaagagcctgtcgccaaaaaaaaaaaaaaaaa

SEQ ID NO: 11578 - DNA, 125 bp, Homo sapiens
  misc_feature 111: n=a, g, c or t
ctttaggtgtattaagatataaggccaggctgggcatggtggctcatgcctgtaatcccagcactttgagtggctgaggtgggaggatcacttgagcccaggatttcaagncgagcctgggacac

SEQ ID NO: 11579 - DNA, 314 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaa

SEQ ID NO: 11580 - DNA, 162 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccctgtctctgcaaaaaaaaaaaaaaaa

SEQ ID NO: 11581 - DNA, 327 bp, Homo sapiens
aatggtagagacagggtttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctca

SEQ ID NO: 11582 - DNA, 309 bp, Homo sapiens
tttaaagatgttgccatttttggctgggcacagtggctcacacctgtaatcccagcactttgggaggccgaggtgggcagctcgcttgagtcaggagtttgagaccagcctggccaatatggtgaaaccctgtctctactaaaaaatacaaaaattagctgggcatggtggcatgtgcctgtaatcccagctactcgggaggctgaggcaggagaattgcttgaacccaggaagcagaggctgcagtgagccaagatcataccactgcactccagcctaggtgacagagcgagactccatctggcaaaa

SEQ ID NO: 11583 - DNA, 53 bp, Homo sapiens
  misc_feature 35: n=a, g, c or t
tataaakakaagtatgataatggtaaaattatggnatatataaatgttaaatc

SEQ ID NO: 11584 - DNA, 460 bp, Homo sapiens
tctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaacssaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccat

SEQ ID NO: 11585 - DNA, 281 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaagcggaggttgcagtgacccgagatctcgscaccgcactccagcctgggcga

SEQ ID NO: 11586 - DNA, 160 bp, Homo sapiens
ctttaggtgtattaagatataaggccaggctgggcatggtggctcatgctgtaatcccagcactttgagtggctgaggtgggaggatcacttgagcccaggatttcaaggcgagcctsggacacatggtgaaacctgtctctgcaaaaaaaaaaaaaaaa

SEQ ID NO: 11587 - DNA, 315 bp, Homo sapiens
  misc_feature 6,44,204: n=a, g, c or t
tttaansatgttgccatttttggctgggcacagtggctcacacntgtaatcccagcactttgggaggccgaggtgggcagctcgcttgagtcaggagtttgagakscagcctggccaatatggtgaaaccctgtctctactaaaaaatacaaaaattakctgggcatggtggcatgtgcctgtaatcccagctactcgggaggntgaggcaggagaattgcttgaacccaggaagcagaggctgcagtgagccaagatcataccactgcactccagcctaggtgacagagcgagactccatctggcaaaaaaaaa

SEQ ID NO: 11588 - DNA, 431 bp, Homo sapiens
actagtgaatggcagtgattccagttcattcctagctcagaaagcaacgttttgagccacaactgtcacaactccagacaagtatcttgctatgttggccagggtggtcttgaacatctgacctcaagcaatcctcctgcctcagcctcccagagtgctgggattacaggtgtgagccatcgtgcctggccagaatgtgcatttctaacaagttgccaggtgacactgatgctgcttgtctggggaccacactttgagaaccattaaacatcaggataaaaatacaataggttgaggatggcaaagcagaatgataaagcctgggtgttgatggccttgtccagaagctgaatcaatgtaaaccactcccttgcctctggatttcttgttcagtgataaaataaaccactctttaagctactgttaaaaaa

SEQ ID NO: 11589 - DNA, 320 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtcca

SEQ ID NO: 11590 - DNA, 200 bp, Homo sapiens; identical to SEQ ID NO: 11569

SEQ ID NO: 11591 - DNA, 200 bp, Homo sapiens; identical to SEQ ID NO: 11569

SEQ ID NO: 11592 - DNA, 171 bp, Homo sapiens
cataagaatttataaacttgaaatagaaatattctattgtaaaggttaasaaaagtatacttggttggccaccgaggctcactaccataatcccagtacttcgggaggcagggtggaaggattgctcgagcccagaaggtggaggctgcagtgagccatgatcatgccact

SEQ ID NO: 11593 - DNA, 162 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttctcaaaaaa

SEQ ID NO: 11594 - DNA, 118 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacgg

SEQ ID NO: 11595 - DNA, 245 bp, Homo sapiens
gtataattcctttgttagccacgtttactgggaaaaaaactggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaggagcaggcaaaagaatcctcgaagc

SEQ ID NO: 11596 - DNA, 86 bp, Homo sapiens
ctttaggtgtattaagatataaggccaggctgggcatggtggctcatgcctgtaatcccagcabtttgagtggctgaggtgggagg

SEQ ID NO: 11597 - DNA, 347 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcacgagtgcacgcctgtaatccctgctactcgggaggctgaaacaggagaatcacttgaacccaggagacggaggttgcggtgagttgagattatgccactgtactccagcctgggtgacagagcgaga

SEQ ID NO: 11598 - DNA, 200 bp, Homo sapiens; identical to SEQ ID NO: 11569

SEQ ID NO: 11599 - DNA, 299 bp, Homo sapiens
cttttttggctggacgtggtggctcgcgcctgtaatcccagcgctttgggaggccaaggtgggtggatcacctgagatcgggagttcgagaccagcctagccagcatggtgaaacctgtctctactaaaaatataaatattagctgggtgtggtggtatgcgcctgtggtcccagctgcttgggaggctgaggcgggagagttgcttgaacctgggaggtggaggttgcagtgagccgagatctcaccattgcactccagcctgggcgacaagagcaaaactccatctcaaaaacaaaa

SEQ ID NO: 11600 - DNA, 347 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagac

SEQ ID NO: 11601 - DNA, 114 bp, Homo sapiens
ctttaggtgtattaagatataaggccaggctgggcatggtggctcatgctgtaatcccagcactttgagtggctgaggtgggaggatcacttgagcccaggatttcaaggcgag

SEQ ID NO: 11602 - DNA, 168 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaa

SEQ ID NO: 11603 - DNA, 200 bp, Homo sapiens; identical to SEQ ID NO: 11569

SEQ ID NO: 11604 - DNA, 371 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaaggctgaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaa

SEQ ID NO: 11605 - DNA, 280 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtga

SEQ ID NO: 11606 - DNA, 250 bp, Homo sapiens
ttgagaccttccttaagagaggaaagcttatctttagtttatagaaataaaaacaaaactgtatttccaagcaaaactgactttatgtaggtgtctccagagatgcagcttcagckcctcgcagatgccgctgaggagctgctggaccgcctcgstcacacagcatgctgccctcagacgtgtccatcctgtaccacatgaaaacgctgctgctcctgcaagattacttgagagatttgaagcattgctc

SEQ ID NO: 11607 - DNA, 165 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctgtctctgcaaaaaaaaaaaaaaaaaagy

SEQ ID NO: 11608 - DNA, 353 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagt

SEQ ID NO: 11609 - DNA, 385 bp, Homo sapiens
  misc_feature 384..385: n=a, g, c or t
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgsagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaaaaaann

SEQ ID NO: 11610 - DNA, 383 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagsactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaaaaaag

SEQ ID NO: 11611 - DNA, 174 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtcacaaaaaaaaaaaaaaaaa

SEQ ID NO: 11612 - DNA, 295 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttgttatcacaccactgcactcctgcctgggtgacagagcaagagcctgtcgcca

SEQ ID NO: 11613 - DNA, 68 bp, Homo sapiens
ataaaaaaaaaaaaaaaaaaaaaaaaaaaaaaaaaaaaaaaaaaaaaaaaaaaaaaaaaaaaaaaaaa

SEQ ID NO: 11614 - DNA, 160 bp, Homo sapiens
tacaaaaaattagctgggcgtggtggcaggcgcctgtggtcccagctactcgggaggctgaggcaggagaatagtgtgaacccaggaggcggasttggcagtgagccaagatagtgccactgcacttcagcctgggtgacagagtgagactctgtcacaa

SEQ ID NO: 11615 - DNA, 281 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtgaa

SEQ ID NO: 11616 - DNA, 87 bp, Homo sapiens
aaacctaacttgcgcagaaaacaagatgagattggcatggstttatttgttttttttgttttgttttggtttttttttttttttggg

SEQ ID NO: 11617 - DNA, 225 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaaaaaaaaaaa

SEQ ID NO: 11618 - DNA, 87 bp, Homo sapiens
aaacctaacttgcgcagaaaacaagatgagattggcatggctttatttgttttttttgttttgttttggtttttttttttttttggg

SEQ ID NO: 11619 - DNA, 200 bp, Homo sapiens; identical to SEQ ID NO: 11569

SEQ ID NO: 11620 - DNA, 322 bp, Homo sapiens
tttaaagatgttgccatttttggctgggcacagtggctcacacctgtaatcccagcactttgggaggccgaggtgggcagctcgcttgagtcaggagtttgagaccagcctggccaatatggtgaaaccctgtctctactaaaaaatacaaaaattagctgggcatggtggcatgtgcctgtaatcccagctactcgggaggctgaggcaggagaattgcttgaacccaggaagcagaggctgcagtgagccaagatcataccactgcactccagcctaggtgacagagcgagactccatctggcaaaaaaaaaaaaaaaaa

SEQ ID NO: 11621 - DNA, 369 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaa

SEQ ID NO: 11622 - DNA, 166 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttctcaaaaaaaaaa

SEQ ID NO: 11623 - DNA, 170 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtcacaaaaaaaaaaaaa

SEQ ID NO: 11624 - DNA, 152 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaatatggtgaaacgtgatctctacgaaaaaaaaaaaa

SEQ ID NO: 11625 - DNA, 144 bp, Homo sapiens
caaaaactagccaggcagggctgggcgcggtggctcacgcctgtaatcccagcactttgggaggccgaggcgggcggatctcgaggtcaggagattgagaccatcccggctaacacggtgaaacccgtctctactaaaaataca

SEQ ID NO: 11626 - DNA, 225 bp, Homo sapiens
cataagaatttataaacttgaaatagaaatattctattgtaaaggttaagaaaagtatacttggttggccaccgaggctcactaccataatcccagtacttcgggaggcagggtggaakgattgctcgagcccagaaggtggaggctgcagtgagccatgatcatgccactgcactccaacctgggtaacagagggagaccttgtctgaaaaaaaaaaaaaaaaa

SEQ ID NO: 11627 - DNA, 226 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagcggagaccttgtctgaaaaaaaaaaaaaaaaa

SEQ ID NO: 11628 - DNA, 341 bp, Homo sapiens
  misc_feature 7,135,270..271,296: n=a, g, c or t
cttgttntatcacscaggstggtgtgcactggtatgttstcgctcastgcaascactatctctcaggttcaagcgattctcsttcctcagcctcctgagtagmtgggattasaggcacatgtcacsasgcctggntaatttttgtatttttaatagagavtgggtttcacsatgttggscatgmtggtcttgaasttctggsctsaagtgatstgcccacctcagccttccaaagtgctgagattacagtcctgagscactgmtttcggnnttasagaattgttttgttttggggnattcagaagtctgasataaaaattaacttgaaaawraaaaaaaag

SEQ ID NO: 11629 - DNA, 173 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaargy

SEQ ID NO: 11630 - DNA, 316 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactg

SEQ ID NO: 11631 - DNA, 78 bp, Homo sapiens
gaacacttccatggattgtccttggacttagggcgccctgccgccttttgcagaggagaaaaaacttttttttttttt

SEQ ID NO: 11632 - DNA, 195 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaa

SEQ ID NO: 11633 - DNA, 78 bp, Homo sapiens; identical to SEQ ID NO: 11631

SEQ ID NO: 11634 - DNA, 221 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaaaaaaa

SEQ ID NO: 11635 - DNA, 242 bp, Homo sapiens
ccgaggtgggtgtatcacctgaggtcaggagtttgagaccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcaaaaaa

SEQ ID NO: 11636 - DNA, 134 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaac

SEQ ID NO: 11637 - DNA, 87 bp, Homo sapiens; identical to SEQ ID NO: 11618

SEQ ID NO: 11638 - DNA, 173 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaaagc

SEQ ID NO: 11639 - DNA, 127 bp, Homo sapiens
  misc_feature 122: n=a, g, c or t
ctttaggtgtattaagatataaggccaggctgggcatggtggctcatgcctgtaatcccagcactttgagtggctgaggtgggaggatcacttgagcccaggatttcaaggcgagcctgggnacaca

SEQ ID NO: 11640 - DNA, 216 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaa

SEQ ID NO: 11641 - DNA, 303 bp, Homo sapiens
aaaaagtccctgggaagcggccgggcgcggttggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggtgacagagcgggactccacccca

SEQ ID NO: 11642 - DNA, 336 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccaaaaaaaaaaaaaaaaa

SEQ ID NO: 11643 - DNA, 112 bp, Homo sapiens
ctttaggtgtattaagatataaggccaggctgggcatggtggctcatgcctgtaatcccagcactttgagtggctgaggtgggaggatcacttgagcccaggatttcaaggc

SEQ ID NO: 11644 - DNA, 170 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaa

SEQ ID NO: 11645 - DNA, 109 bp, Homo sapiens
gtgtgttaagaaatgagctgtaggtcagtgcagtggctcatgcctgtaatcccagcactttgggaggctgaggtgggcggatcatgaggtaaggmgttcgagagcagcc

SEQ ID NO: 11646 - DNA, 122 bp, Homo sapiens
ctttaggtgtattaagatataaggccaggctgggcatggtggctcatgctgtaatcccagcactttgagtggctgaggtgggaggatcacttgagcccaggatttcaagggcgagcctggga

SEQ ID NO: 11647 - DNA, 294 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttc

SEQ ID NO: 11648 - DNA, 189 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaa

SEQ ID NO: 11649 - DNA, 301 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagastccatctcaaaaaaaaaaaaaa

SEQ ID NO: 11650 - DNA, 152 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtc

SEQ ID NO: 11651 - DNA, 55 bp, Homo sapiens
gtcagacaataaagtctttgtaaaaagagaaaaaaaaaaaaaaaaaaaaaaaaaa

SEQ ID NO: 11652 - DNA, 109 bp, Homo sapiens
ctttaggtgtattaagatataaggccaggctgggcatggtggctcatgcctgtaatcccagcastttgagtggctgaggtgggaggatcacttgagcccaggatttcaa

SEQ ID NO: 11653 - DNA, 201 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctcgggcaacagagcaagaccctgtctctacaaaaaaaaaaaaaaaaa

SEQ ID NO: 11654 - DNA, 110 bp, Homo sapiens
ttaggcccaagaattacctgaacctgggacgtggaggttgcggtgagccaagatcgcaccactgtaccctagcctgggcaacagagtgactcttaaaaaaaaaaaaaaaa

SEQ ID NO: 11655 - DNA, 333 bp, Homo sapiens
gtgagccgagatcttgccactgcactccagccagggtgatggagtgagactctcagaaaaaaattagtgccaggcacaggggctcacacctataatccccgcactttkgcaggscaggtgggcaaattgcttgagcccaggagttcgagaccagcctgggcaacatggcgaraccctgtctaacaaaaaaaatacaraagttagccaggagtggtggcacaagcctgtagtccctgctgstagggaractgtagtgggaggatsacttcagcstgggagaccaaggctgcagtgagtcatgmgtgtgcsattgsaccccagtgtgggccacag

SEQ ID NO: 11656 - DNA, 127 bp, Homo sapiens
ctttaggtgtattaagatataaggccaggctgggcatggtggctcatgcctgtaatcccagcactttgagtggctgaggtgggaggatcacttgagcccaggatttcaaggcgagcctcgggacaca

SEQ ID NO: 11657 - DNA, 62 bp, Homo sapiens
wggactatactttcagggatcatttctatagtgtgttactagagaagtttctctgaacgtgt

SEQ ID NO: 11658 - DNA, 63 bp, Homo sapiens
  misc_feature 30: n=a, g, c or t
gactgtcagtgscggscttcctcgtgtgangggatctgccggasscctgcaaattcaatttct

SEQ ID NO: 11659 - DNA, 361 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcmsagtgcacgcctgtaatccctgctactcgggaggctgaaacaggagaatcacttgaacccaggagacggaggttgcggtgagttgagattatgccactgtactccagcctgggtgacagagcgagactcagtctcaaaaaa

SEQ ID NO: 11660 - DNA, 149 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacggtgaaaccacgtctctactaaaaaaaaaaaaa

SEQ ID NO: 11661 - DNA, 162 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacggtgaamccacgtctctactaaaaaaaaaaaaattacaaaaawtca

SEQ ID NO: 11662 - DNA, 225 bp, Homo sapiens; identical to SEQ ID NO: 11617

SEQ ID NO: 11663 - DNA, 99 bp, Homo sapiens
ctttaggtgtattaagatataaggccaggctgggcatggtggctcatgctgtaatcccagcactttgagtggctgaggtgggaggatcacttgagccca

SEQ ID NO: 11664 - DNA, 81 bp, Homo sapiens
cttttccaccaatgagcgagtcatcaatgttaccttctgtcctactgaccatcttcccctccccaaaaaaaaaaaaaaaaa

SEQ ID NO: 11665 - DNA, 347 bp, Homo sapiens
  misc_feature 260,266: n=a, g, c or t
tttaaaaaataaataagtaaataaaattgagcctcattttttaacctaattgaaaatgggtgataaaaatgtatacattgcgaccaggtgcggtggctcacacttgtaatcccagcactttgggaggccaaggcaggtggatcacctgaggtcaggagttcaagaccagcctggccaacatggtgaaacttcgtctctattaaaaatacaagaatcagccaagtgtggtggcacatgcctgtagtcccagctacccgggnggctgnggcaggagaatcgcttgaacttgggatgctgcagttgcagtgagctgcgttcgcaccattgcactcctgcctgggtgacag

SEQ ID NO: 11666 - DNA, 173 bp, Homo sapiens; identical to SEQ ID NO: 11575

SEQ ID NO: 11667 - DNA, 200 bp, Homo sapiens; identical to SEQ ID NO: 11569

SEQ ID NO: 11668 - DNA, 163 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccctgtctctgcaaaaaaaaaaaaaaaaa

SEQ ID NO: 11669 - DNA, 132 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggcacacatggtg

SEQ ID NO: 11670 - DNA, 329 bp, Homo sapiens
aatggtagagacagggtttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtacctgtagtcccagctacttgggaggctgaggcaggagaatagcttggacccaggaggtggaggttgcagtgagcccagatcacgcaaatgtcactgtactccagcctgggtggcagggtgagaatccatctcaa

SEQ ID NO: 11671 - DNA, 174 bp, Homo sapiens
tatatacattagctgggcatggtggtgcatgcctgtagtcgcagctgctcgggaggctgaggcaggagaatcgcttgaatctgggaggcggaggttgcagtgagccgagatcacatgacagcactccagcctgggtgacagacagagaccccatctcaaaaaaaaaaaaaaaaa

SEQ ID NO: 11672 - DNA, 305 bp, Homo sapiens
atttttggattttctttaaaaatgcacattccaggctgggcgcagtggctcacgtgtgtaatcccagtactttgggaggctgagggcggatcacaaagccaggagttcaagaccaayctgggcaatatggtgaaacccatctctactaaaaatataaaaagttagccaggtatggtggcacaagcctgtagtcccagccacttgggaggctgaggcagaagaatcacttgaacccgggaggcggaggttgcagtgagccgagatcgtgscactgcactcaagcctaggcaacagagtaagactct

SEQ ID NO: 11673 - DNA, 337 bp, Homo sapiens
aatggtagagacaggstttcaccatgttggccaagctggtctcaaactcctgacctcatgcctgtaatcccagcattttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctcaaaaaacaaaa

SEQ ID NO: 11674 - DNA, 473 bp, Homo sapiens
ttagsaaatgttgcytttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttawactgtctggggatgtgtggttawagttctgtgggagaaataattttgycagkgttcaccagcttgtaaaaacttagtgcgagagctgaaacatctaaata

SEQ ID NO: 11675 - DNA, 261 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcactgtgaatctcagctactcgggaggctgaggcagggagaatcactttgaacccaggaggcagaggttgcagtgagccaagatcacaccactgcactccag

SEQ ID NO: 11676 - DNA, 107 bp, Homo sapiens
ctttaggtgtattaagatataaggccaggctgggcatggtggctcatgctgtaatcccagcactttgagtggctgaggtgggaggatcacttgagcccaggatttca

SEQ ID NO: 11677 - DNA, 114 bp, Homo sapiens
  misc_feature 110: n=a, g, c or t
ctttaggtgtattaagatataaggccaggctgggcatggtggctcatgcctgtaatcccagcactttgagtggctgaggtgggaggatcacttgagcccaggatttcaanggcg

SEQ ID NO: 11678 - DNA, 144 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgc

SEQ ID NO: 11679 - DNA, 189 bp, Homo sapiens
  misc_feature 45: n=a, g, c or t
tgaatataattagtctcatttgaaatttagtagctgaacatatantgtattaattaacaatactggtcaggcacgttggctcatgcctgtcatcccagcactttgggaggccggggcaggaggatcagtcaagaccgggagtttgagabtaacctgggyaacagagcaagaccctgtctctacaaaaaa

SEQ ID NO: 11680 - DNA, 174 bp, Homo sapiens; identical to SEQ ID NO: 11671

SEQ ID NO: 11681 - DNA, 200 bp, Homo sapiens; identical to SEQ ID NO: 11569

SEQ ID NO: 11682 - DNA, 104 bp, Homo sapiens
  misc_feature 84: n=a, g, c or t
tgaatataattagtctcatttgaaatttagtagctgawcatatactgtattaattaacaatactggtcaggcacgttggctcangcctgtcatcccagcacttt

SEQ ID NO: 11683 - DNA, 179 bp, Homo sapiens
tgaatataattagtctcatttgaaatttagtagctgaacatatactgtattaattaacaatactggtcaggcacgttggctcatgcctgtcatcccagcactttgggaggccggggcavgaggatcagtcaagaccgggagtttgagactaacctgggcaacagagcaagaccctgtct

SEQ ID NO: 11684 - DNA, 194 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaa

SEQ ID NO: 11685 - DNA, 167 bp, Homo sapiens
ttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtytaccaacttatt

SEQ ID NO: 11686 - DNA, 129 bp, Homo sapiens
ttaggcccadgaattacctgaacctgggacgtggaggttgcggtgagccaagatcgcaccactgtaccctagcctgggcaacagagtgactcttaaaaaaaaaaaaaaaaasaaaaaaaaaaaaaaaaa

SEQ ID NO: 11687 - DNA, 174 bp, Homo sapiens
tacaaaaaattagctgggcgtggtggcaggcgctgtggtcccagctactcgggaggctgaggcaggagaatagtgtgaacccaggaggcggasttgcagtgagccaagatagtgccactgcacttcagcctgggtgacagagtgagactctgtcacaaaaaaaaaaaaaaaaag

SEQ ID NO: 11688 - DNA, 158 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaa

SEQ ID NO: 11689 - DNA, 82 bp, Homo sapiens
gtcagacaataaagtctttgtaaaaagagaaaaaaaaaaaaaaaaaaaaaaaaaaaaaaaaaaaaaaaaaaaaaaaaaaaaa

SEQ ID NO: 11690 - DNA, 378 bp, Homo sapiens
  misc_feature 328: n=a, g, c or t
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggncacagagcgagaccttgtctccaaaaaaaaaaaaacccaaaarrraaraa

SEQ ID NO: 11691 - DNA, 317 bp, Homo sapiens
caaaaactagccaggcagggctgggcgcggtggctcacgcctgtaatcccagcactttgggaggccgaggcgggcggatctcgaggtcaggagattgagaccatcccggctaacacggtgaaacccgtctctactaaaaatacaaaaaaaattagctgggcgtggtggcaggtgcctgtggtcccagctactcgggaggctgaggcagaagaatggcgtgaacttgggaggtggagcttacagtgagccgagatcacaccactgcactccagcctgggggacagagcgagactccgtctcaaaaaaaaaaaaaaaaa

SEQ ID NO: 11692 - DNA, 118 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaac

SEQ ID NO: 11693 - DNA, 347 bp, Homo sapiens
tttaaatataaataaatgaaaataatacttctccctgatcataaagaaaatcacattcttagaggccgggcatggtggctcatgcctgtggtcccagcactttggaaggtcgaagtgggtggatcatgaggtcaggagttcgagaccaggctgtccattatagtgaaaccccgtctctgctaaagatacgaaaattagccgggcatggtggtgcatgcctgtggtcctagctactcgggaggctgaggcgggagaattgcttgagtccaggaggtggaggttgcggtgagctgagatcgcgccactgcaccccagcctgggtgacagaccgagactctgtctcaaaa

SEQ ID NO: 11694 - DNA, 278 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgctgtaatcccagctgctcgggaggctgaggcaagagaattgcttgaacggcagaggttgtggtgagccaagatcatgacactgcaccccagcgtgggcaacaagagtg

SEQ ID NO: 11695 - DNA, 361 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagactcagtctcaaaaaa

SEQ ID NO: 11696 - DNA, 430 bp, Homo sapiens
gtggtggccaggggccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagctcaggatgaggcagaaggaagggtaagggaaaggatggggaccacaaggaagagccaggtgctgctcagcagaggatatgggttggagcgaaagttgtaacaagtgggggtggggggtgcgggccgccaccactgctccttgactctgccgtttcctaataagacctggttccacatctcaaaaaaaaaaaaaaaaa

SEQ ID NO: 11697 - DNA, 187 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaa

SEQ ID NO: 11698 - DNA, 140 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtggaaaccctg

SEQ ID NO: 11699 - DNA, 130 bp, Homo sapiens
  misc_feature 118: n=a, g, c or t
atcgaaaaattagctgggcgtggtgtgtgcctgtggttccagccacatgggaggctggcgcatccccatgcttgagcccaggaggtttaggctgcagtgagctgtgttcatgccactngcactccagcct

SEQ ID NO: 11700 - DNA, 373 bp, Homo sapiens
acagagcaaaaatctgtctaaaaaaaaaaaagaagagastggcacatccatacaatggatgagccamctgttaaaaaaaaaagattgaggggstgggcgtggtggstcasacstktaatcccaggactttgggaggccgaggcgggcggatcatgaggtcaggagatcgagaccttcctggctaacacggtgaaacctgtctctactaaaaatacacacacacacaaaawttagctgggtgtggtggcaagcacctgtattcccagctactcgggaggctgaggcaggagaatggtgtraaccaggaggtggagcttgmagtgagctgagatcgcgcsastgcactccagcctgggtgacagagcgagactcc

SEQ ID NO: 11701 - DNA, 212 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaa

SEQ ID NO: 11702 - DNA, 155 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtc

SEQ ID NO: 11703 - DNA, 285 bp, Homo sapiens
cgatgagagctcattgcagctttgaactcctgggcttaagcaatcctctcacctcagccttctgagtagctggactacaggcacctgccaccatgttcggctaattaaaaaaataacaaactctgttcgtaaagatggggtcttgctgtgttgctcaggctgctcttgaactccttgcctcaagtgagcctcccacctggacctgccaaattgctgggattataagcatgagccactgcgcccagccttactcaccttttttgtatgacactatcagtctttcta

SEQ ID NO: 11704 - DNA, 365 bp, Homo sapiens
  misc_feature 170,250: n=a, g, c or t
ctatgatatatagtatgttaaagatatataatgaatataaagaacacttaataaaataaaatcatagctgagtgtagtgctgtgcmctgtagtcctagctactggagaggctgaggcgggagattagcttgagccccagagtttgaggctgcagtgagctatcatcacancactgcactccagcctgtgtgacagagcgagaccctcagtcagtcgattgatagatagatagatagaattttattaaatnaatacttaacaattgaaaagttgtcagatctggtgcccagagaagaaaaattgagtttgtagttattattgctgcttggtgttaggtgaagatgaataggagcgacctaatgaaa

SEQ ID NO: 11705 - DNA, 137 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccc

SEQ ID NO: 11706 - DNA, 377 bp, Homo sapiens
acagagcaaaaatctgtctaaaaaaaaaaaagaagagastggcacatccatacaatggatgagccaastkttaaaaaaaaaagattgrggggstgggcgtggtggctcacacctgtaatcccaggactttgggaggccgaggcgggcggatcatgaggtcaggagatcgagaccttcctggctaacacggtgaaacctgtctctactaaaaatacacacacacacaaaaattagctgggtgtggtggcaagcacctgtattcccagctactcgggaggctaaggcaggaraatggtgtgaaccaggaggtggagcttgcagtgagctgagatcgcgcaactgcactccagcctgggtgacagagcgagactccatct

SEQ ID NO: 11707 - DNA, 397 bp, Homo sapiens
cagaaacttctagctcccaggtgtttggactccctccccatccccagctccctcggccacctccgttactttggggttttttgggttttgtttggttggttggtggtggttttttttttcttttttgttttgttttgttttgagacggactcttgctctgtcacccaggctggagtgcagtggcgcaatctcggctcactgcaagctccgcctcccaggttcacgccatctcctgcctcagcctcccaagtagctgggactacaggcgcccaccaccacacctggctaattttttgwatttttagtagagacggggtttcactgtgttaaccaggatggtctcgatctcctgacctcgkgatccgcctgccttggccgcccaaaatgctgggatggg

SEQ ID NO: 11708 - DNA, 128 bp, Homo sapiens
  misc_feature 10,110: n=a, g, c or t
ttaggcccanaattacctgaacctgggacgtggaggttgcggtgagccaagatcgcaccactgtaccctagcctgggcaacagagtgactcttaaaaaaaaaaaaaaaancgaaaaaaaaaaaaaaaa

SEQ ID NO: 11709 - DNA, 114 bp, Homo sapiens
ctttaggtgtattaagatataaggccaggctgggcatggtggctcatgcctgtaatcccagcactttgagtggctgaggtgggaggatcacttgagcccaggatttcaaggcga

SEQ ID NO: 11710 - DNA, 84 bp, Homo sapiens
gtcagacaataaagtctttgtaaaaagagaaaaaaaaaaaaaaaaaaaaaaaaaaaaaaaaaaaaaamasaaaaaaaaaaaaaa

SEQ ID NO: 11711 - DNA, 237 bp, Homo sapiens
attaagatcagcctgggtaatacagtgagaccccatctctagaaaaaataaaaaattagtcaaatgtggtgttagtcccagctacgtgggggactagtagtcccagctacttgggagggggagatgggaggattgcttgagcctgggaagcgaaggttgcagtaagatgagatcgtgccgctgcactccagcctgggtgacagagtgagactctgtctcttaggaaaaaaaaaaaaa

SEQ ID NO: 11712 - DNA, 490 bp, Homo sapiens
gactgacaactcacacggctgggtactcttctgagacaaaacttccagaggagcgatcaggcagcaacatttgctgttcaccaatatccattgttctgcagcctctgctgctgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaagaagttaaaaaccttgaaaa

SEQ ID NO: 11713 - DNA, 173 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaaagy

SEQ ID NO: 11714 - DNA, 191 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaa

SEQ ID NO: 11715 - DNA, 123 bp, Homo sapiens
tatatacattagctgggcatggtggtgcatgcctgtagtcgcagctgctcgggaggctgaggcaggagaatcgcttgaatctgggaggcggaggttgcagtgagccgagatcacatgacagca

SEQ ID NO: 11716 - DNA, 200 bp, Homo sapiens; identical to SEQ ID NO: 11569

SEQ ID NO: 11717 - DNA, 439 bp, Homo sapiens
gacaaagagaagagaggagatatcctccatgttgaatgtacctggcttctgacatagctgccggcatttacctatgcaaacttctagcttgcttatctatgtttgcagcttgatttctcagggtgctttttgttagaaatgttttaggggctgctttttattaaagaaaaattccactgagaactcctttaacctcactaactgcctaaataatttcttactaactcctatatcactattactgtactgctcttaacctgaacagtggaactcagtctaggttaaagcaagtggagtacgagaagtgagttttgcatttaaattttatttttacttatttttggactttttacctttgtcttcaatgactgccccctttcctctatctgtaatgaatggaatgaaaaaagttgtagtttggatgtactgacctagtcaa

SEQ ID NO: 11718 - DNA, 199 bp, Homo sapiens
tgaatataattagtctcatttgaaatttagtagctgaacatatactgtattaattaacaatactggtcaggcacgttggctcatgcctgtcatcccagcacttgggaggccggggcaggaggatcagtcaagaccgggagtttgagactaacctgggcaacagagcaagaccctgtctctacaaaaaaaaaaaaaaaaa

SEQ ID NO: 11719 - DNA, 163 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgcaaaaaaaaaaaaaaaaaag

SEQ ID NO: 11720 - DNA, 195 bp, Homo sapiens
tgaatataattagtctcatttgaaatttagtagctgaacatatactttattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaa

SEQ ID NO: 11721 - DNA, 231 bp, Homo sapiens
  misc_feature 28: n=a, g, c or t
atgcagcgcgcggcgatggagttcaagnscagcctggccaacatggtgaaacctgtctctactaaaaatacaaaaattagctgggcgtggtggcgcacgctgtagtcccagctactcgggaggctgaagcagaagaattgcttgaacctgggaggcagaggttgcagtgagctgagatcatgccactgcactctagcctgggtgacagagtgagactgcgtctaagaaaaa

SEQ ID NO: 11722 - DNA, 172 bp, Homo sapiens
tcaagaaaaaaaatttttttttttttggaagaatttgaaagctgctgatcsagagtcattcctttaagaaaatgggccgggcatggtggstcacacctgtaatcctggmacttcgggaagccagggcagatggatsagttgagctcaggaatgtgagaccagcstgggcaat

SEQ ID NO: 11723 - DNA, 339 bp, Homo sapiens
tattttattataaatcaggacctttcgtggaactgtattgaaattaattatcctgggcctggcgcggtggctcatgcctgtaatcccagcgctttgggaggccaaggtgggcggatcatgaggtcaagagatcgagaccatcctggctagcacggtgaaaccccgtctctactaaaaaatacaaaaaaaattagctgggcatggtggtggtgcctgtggtcccggctactcgggaggctgaggcaggagaatggcgtgaacgtgagaggtggagcttgcagtgagctgagatcgcgctactgcattccagcctgggcaaacagcaagactctgtctcca

SEQ ID NO: 11724 - DNA, 171 bp, Homo sapiens
atcgaaaaattagctgggcgtggtgtgtgsstgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaaa

SEQ ID NO: 11725 - DNA, 343 bp, Homo sapiens
cttgttctatcacccaggctggtgtgcactggtatgttctcgctcactgcaaccactatctctcaggttcaagcgattctccttcctcagcctcctgagtagctgggattacaggsacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaraaaaaaaaaaa

SEQ ID NO: 11726 - DNA, 394 bp, Homo sapiens
gagacagagtcttgctctgtcgcccaggctgcagtgcggtggtgcaatctcggttcactgcaacctccgactcccaggctcaagcgattcttatgcctcagcctcccgagtggctgggattatgggcctgtgccaccattcatgggtagtttttctatttttagcagggacaggatttcgccatgtttgccaggctggtcttgaactcctgaccttaagtgatctgcctgcctgggcctcccaaagtgctgggattacaggcatgagccactgtgccaggcctattttattttatttatttatttttgagacaagatctcactctgttgctcaggctggagtgtagtggtgcgatcacagctcactgcagcctcaaatgcctgggcaacaagag

SEQ ID NO: 11727 - DNA, 358 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgstactcgggaggctgaaacaggagaatcacttgaacccaggagacggaggttgcggtgagttgagattatgccactgtactccagcctgggtgacagagcgagactcagtctcaaa

SEQ ID NO: 11728 - DNA, 200 bp, Homo sapiens; identical to SEQ ID NO: 11569

SEQ ID NO: 11729 - DNA, 278 bp, Homo sapiens
tgtctaggctgagcgtggtggctcacgcctgtactcctaccactttgggaggccaaggcaggcggatcatttgaggtcagaagttcgataccagcctgakscaacatgatgaaaccccgtstkvtactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaa

SEQ ID NO: 11730 - DNA, 303 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttatttgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaa

SEQ ID NO: 11731 - DNA, 126 bp, Homo sapiens
gatagattaaaaattttctgggctgggcgcggtggctcatgccggtaatcccagcactttgggaggccgaggcaggcggatcacaaggtcaggagatcgasaccatcctggctaacacggtgaaac

SEQ ID NO: 11732 - DNA, 142 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaaccctgtctc

SEQ ID NO: 11733 - DNA, 181 bp, Homo sapiens
gagacagagtcttgctctgtcgcccaggctgcagtgcggtggtgcaatctcggttcactgcaacctccgactcccaggctcaagcgattcttatgcctcagcctcccgagtggctgggattatgggcctgtgccaccattcatgggtagtttttctatttttagcaggggacaggatttcg

SEQ ID NO: 11734 - DNA, 311 bp, Homo sapiens
cgatgagagctcattgcagctttgaactcctgggcttaagcaatcctctcacctcagccttctgagtagctggactacaggsacctgccaccatgttcggctaattaaaaaaataacaaactctgttcgtaaagatggggtcttgctgtgttgctcaggctgctcttgaactccttgcctcaagtgagcctcccacctggacctgccaaattgctgggattataagcatgagccactgcgcccagccttactcacctttttgtatgasactatcagtctttctaaagtgcaaagmsaaagggttctgttat

SEQ ID NO: 11735 - DNA, 225 bp, Homo sapiens; identical to SEQ ID NO: 11617

SEQ ID NO: 11736 - DNA, 213 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaa

SEQ ID NO: 11737 - DNA, 525 bp, Homo sapiens
  misc_feature 355,357: n=a, g, c or t
actgctggatccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcgnmngctgctgctgctgctgtctccccagagtcccacccatgggctgcgaagctggccacccacactctgcatgccctcaccccacttctttgactacctagcagtgggtgatggacacagacatggggctgttagcgtctctctgtttattcgctcacaataatacacagc

SEQ ID NO: 11738 - DNA, 126 bp, Homo sapiens
ctttaggtgtattaagatataaggccargctgggsatrgtggctcatgcctgtaatcccagcactttgagtggctgaggtgggaggatcacttgagcccaggatttcaaggcgagcctgggacaca

SEQ ID NO: 11739 - DNA, 162 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaamcctgtctctgcaaaaaaaaaaaaaaaaa

SEQ ID NO: 11740 - DNA, 80 bp, Homo sapiens
atcgawaaattagctgggcgtggtgtgtgcctgtggttccagccacatkggaggctggcgcatccccatgcttgagccca

SEQ ID NO: 11741 - DNA, 109 bp, Homo sapiens
ctttaggtgtattaagatataaggccaggctgggcatggtggctcatgcctgtaatcccagcactttgagtggctgaggtgggaggatcacttgagcccaggatttcaa

SEQ ID NO: 11742 - DNA, 364 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaa

SEQ ID NO: 11743 - DNA, 110 bp, Homo sapiens
ttaggcccadaattacctgaacctgggacgtggaggttgcggtgagccaagatcgcaccactgtaccctagcctgggcaacagagtgactcttaaaaaaaaaaaaaaaaa

SEQ ID NO: 11744 - DNA, 98 bp, Homo sapiens
gtcagacaataaagtctttgtaaaaagagaaaaaaaaaaaaaaaaaaaaaaaaaaaaaaaaaaaaaaaaaaaaaaaaaaaaaaaaaaaaaaaaaaaaa

SEQ ID NO: 11745 - DNA, 171 bp, Homo sapiens
ctgtttcccaggctggagtgtagtgatacagtcacarctcactgtarcctcgaccttccaggctcaaaagatgstcccaccacagcctcccaggtagtgagtagctggtactacaggtgtgtgctgccacacccgactaatttttttgtagdbacggggtttcgctgttcc

SEQ ID NO: 11746 - DNA, 305 bp, Homo sapiens
gatagattaaaaattttctgggctgggcgcggtggctcatgccggtaatcccagcactttgggaggccgaggcaggskgatcacaaggtcaggagatcgagdbcatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaakatcgcaccactgcactccagcctgggcgacagagcgaggttccgtctcagaa

SEQ ID NO: 11747 - DNA, 565 bp, Homo sapiens
tctttttttttgattggggagggggagcaagaatactttgcaggtggtatgtggtatatactatcgtatggaggcacatgttagattgtgtcttcatgatgtgagcagtcattgatgatcattgcctagatccattaattcatttagagttgcaaataatgatattccaattctattcgtcccttcatttattagctgaggtacttctatgaaaggaaacttctcctattagttattagtaactttgaagtacagttcatctagtaaagccggataaatgtttgattcttggccaagcacagtggctcacacctgtaatcccagcactttgggaggccgaggcgggcggattgcctgaggtcaggagttcgagaccagcctggccaacatagtgaatccccgtctctattaaaaatacaaatttagtcgggtgtgatgatacacgcctgtagtcccatctacttgggaggctgaggcaggagaatcgcttgaacccgggaggtggaggttgcagtgagccaagatcgtaccactgcactccgcctgggtgagactacatctccaa

SEQ ID NO: 11748 - DNA, 187 bp, Homo sapiens; identical to SEQ ID NO: 11697

SEQ ID NO: 11749 - DNA, 253 bp, Homo sapiens
ccgaggtgggtgtatcacctgaggtcaggagtttgagaccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcaaaaaaaaaaaaaaaaa

SEQ ID NO: 11750 - DNA, 311 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcga

SEQ ID NO: 11751 - DNA, 293 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctg

SEQ ID NO: 11752 - DNA, 302 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagactccatctcaaaaaaaaaaaaaaa

SEQ ID NO: 11753 - DNA, 84 bp, Homo sapiens
aaacctaacttgcgcagaaaacaagatgagattggcatggctttatttgttttttttgttttgttttggttttttttttttttt

SEQ ID NO: 11754 - DNA, 200 bp, Homo sapiens
tgaatataattagtctcatttgaaatttagtagctgaacatatactgtattaattaacaatactggtcaggcacgttggckcatgcctgtcatcccagcactttgggaggccggggcaggaggatcagtcaagaccgggagtttgagactaacctgggcaacagagcaagaccctgtctctacaaaaaaaaaaaaaaaaa

SEQ ID NO: 11755 - DNA, 302 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagctwgcagtgagcagagatagctgcactgcattccagcctgggtgacagagcgagactctgtctccaaaaaa

SEQ ID NO: 11756 - DNA, 129 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggt

SEQ ID NO: 11757 - DNA, 462 bp, Homo sapiens
gtgtgcgcggcacgagccccgaagttgcttaggagctggcgagccagtccctcaaaacgacttcgttcgaggttggcgcccgcctttttcagagagcacttcttagtgggtattccgtccggggccacttttctgaggccgaagacccctagtcagtgtgtgagacatagcctggccgagcctgggaaccacctggggctgagaggagaagagatagaaaataaggaagtcatcacccaggagctggaggattctgtccgcgtggtcttgggaaacttggacaatcttcagccctttgctacagaacacttcattggaaaccaataagtgacagtcctcttgggttggtcccagttgagaagaaagcagtaggagctgtgatgaggaaacgaaaacacatggacgagcccagctcccccagcaggccagggctggacagggccaagatagggacttccagcc

SEQ ID NO: 11758 - DNA, 130 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggt

SEQ ID NO: 11759 - DNA, 136 bp, Homo sapiens
ctaaaaattagccaggcctggtggcaggtgactgtaatgccagctactcgggagghtgaggtaagagaattgcttgaacctgggtggaagaagttgcagtgagccaagattgtgccactgcactcctgcctgggtg

SEQ ID NO: 11760 - DNA, 271 bp, Homo sapiens
ctagaaagtacagttggccaggcatggtggctcatgctgtaatccccacacttgaggaggccgggatgggtggattacttgagctcaggagtttcagaccagcctgggcaacatggtgaaacccatctctacaaaaratacagaaattagccagacatgatggcccacacctgtggtcccagctgcttgggaggctaaggtgagagggatcaacttgagcccaggagattgaggctgcagtgagctgagatcgcgcactgcaatccagcct

SEQ ID NO: 11761 - DNA, 136 bp, Homo sapiens
  misc_feature 81..83,91,114: n=a, g, c or t
gaacacttccatggattgtccttggacttagggcgccctgccgccttttgcagaggagaaaaaacttttttttttttttdnnnmccccganaattttccccccttctcctcccngcctctaaactccgatccccct

SEQ ID NO: 11762 - DNA, 200 bp, Homo sapiens; identical to SEQ ID NO: 11569

SEQ ID NO: 11763 - DNA, 309 bp, Homo sapiens
atatacaaatgtcggctgggcacggtggatcacacctgtaatcccagcactttgggaggccgaagcaggtggatcacgaggtcaggagattgagaccatcctggctaacacagtgaaaccccgtctctactaaaaacagaaaaaattagctgggcatggtggcacgtgcctgtaatcccagctacttgggaggctgaggcaggagaatcgtttgaacctgggaggtggaggttgcagtgagccgcgatgctgagatcacgccactgcactccagcctgggtgacagagcgagactccgtctccgaaaaa

SEQ ID NO: 11764 - DNA, 152 bp, Homo sapiens
  misc_feature 78,120: n=a, g, c or t
gttaaatattgtctaatcaggccgggcgcggtggctcacgtctgtggtcccggcactttgggagcctgaggcaggcgnatcatgaggtcaggagatcaagaccatcgtggcttacacggntgaaacccacgtctctactaaaaaaaaaaaaa

SEQ ID NO: 11765 - DNA, 196 bp, Homo sapiens
  misc_feature 10: n=a, g, c or t
tgaatataantctagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaa

SEQ ID NO: 11766 - DNA, 118 bp, Homo sapiens; identical to SEQ ID NO: 11594

SEQ ID NO: 11767 - DNA, 111 bp, Homo sapiens
ctttaggtgtattaagatataaggccaggctgggcatggtggctcatgcctgtaatcccagcactttgagtggctgaggtgggaggatcacttgagcccaggatttcaagg

SEQ ID NO: 11768 - DNA, 448 bp, Homo sapiens
tttgttcctagcaaccagcctgaggtctggaggtggtgcggagggagccgcctagggaccagggactcctgccaaatccgccggggtccctagaggccctggacccgaacgtggacgagcacttgtccacccagattctcgcgccctcggtccactccgacaactctcaggagcgcatccaggcccggcgcctccgcatcgctgcgcgcttagaagcccggagcggaagcacttggagaatatttagatgggaagaaggagagtgaggaggatcaaagcaagagctacaaacagaaagaagaaagccgattgaaattggctaaacttctgctctgtggcaccgagttggtgacaaatatccaggtggctatagatatcagagagattcacaggagagtcgaagaagaggagataaagcgtcaaaggagttararcaaaggatgaccag

SEQ ID NO: 11769 - DNA, 283 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgagacggcagaggttgtggtgagccaagatcatgacactgcaccccagcgtgggcaacaagagtgaaa

SEQ ID NO: 11770 - DNA, 340 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaaaaaa

SEQ ID NO: 11771 - DNA, 173 bp, Homo sapiens; identical to SEQ ID NO: 11575

SEQ ID NO: 11772 - DNA, 200 bp, Homo sapiens; identical to SEQ ID NO: 11569

SEQ ID NO: 11773 - DNA, 200 bp, Homo sapiens; identical to SEQ ID NO: 11569

SEQ ID NO: 11774 - DNA, 257 bp, Homo sapiens
gatagattaaaaattttctgggctgggcgcggtggctcatgccggtaatcccagcactttgggaggccgaggcaggcggatcacaaggtcaggagatcgagascatcctggctaacacggtgaaactcatctctactaaagatacaaaatattagtggtgtgtsgwrgsgggcgcctgtagtcccagctactcaggagcctgaggccaggagagtggcgtgaacccaggaggcagagctttcastgagccaagatcg

SEQ ID NO: 11775 - DNA, 174 bp, Homo sapiens; identical to SEQ ID NO: 11611

SEQ ID NO: 11776 - DNA, 296 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgctgtagtcccagctactcaggagcctgaggcaggagagtggcgtgaacccaggaggcagagctttcagtgagccaagatcgcaccactgcactccagcctgggcgacagagcgaggttccgt

SEQ ID NO: 11777 - DNA, 170 bp, Homo sapiens; identical to SEQ ID NO: 11644

SEQ ID NO: 11778 - DNA, 200 bp, Homo sapiens
tgaatataattagtctcatttgaaatttagtagctgaacatatactgtattaattaacaatactggtcaggcacgttggctcatgcctgtcatcccagcactttgggaggccgkggcaggaggatcagtcaagaccgggagtttgagactaacctgggcaacagagcaagaccctgtctctacaaaaaaaaaaaaaaaaa

SEQ ID NO: 11779 - DNA, 207 bp, Homo sapiens
atttccaatgctttctctgttcaggctgctgggtgacatttctatgtctccccttcaacggtgaaatatttcagtggttgtccatcacctatgggagtctgacatggcataatcaggccactggggcattgctagttgtgctgtccctgatattcaccgtggtaggcagtttctgaaatggctcccagtgatctccaactcctgaaa

SEQ ID NO: 11780 - DNA, 246 bp, Homo sapiens
atacaattagccaggtgtggcgcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaact

SEQ ID NO: 11781 - DNA, 110 bp, Homo sapiens
ctttaggtgtattaagatataaggccaggctgggcatggtggctcatgctgtaatcccagcactttgagtggctgaggtgggaggatcacttgagcccaggatttcaagg

SEQ ID NO: 11782 - DNA, 226 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaaaaaaaaaaaa

SEQ ID NO: 11783 - DNA, 126 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcc

SEQ ID NO: 11784 - DNA, 222 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacggtgaaaccacgtctctactaaaaaaaaaaaaawtacaaaaaattcagccgggcatgatggcgggsacctgtagtccmagctatttcgggaggctgaggcgggaga

SEQ ID NO: 11785 - DNA, 200 bp, Homo sapiens; identical to SEQ ID NO: 11569

SEQ ID NO: 11786 - DNA, 162 bp, Homo sapiens
  misc_feature 105: n=a, g, c or t
tasaaaaaattagctgggcgtggtggcaggcgcctgtggtcccagctactcgggaggytgaggcaggagaatagtgtgaacccaggaggcggasttscagtgasncaagatagtgscactgcacttcagbctgggtgacagagtgagactctgtcacaaaaa

SEQ ID NO: 11787 - DNA, 254 bp, Homo sapiens
ccgaggtgggtgtatcacctgaggtcaggagtttgagayccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcaaaaaaaaaaaaaaaaa

SEQ ID NO: 11788 - DNA, 172 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctcaaaaaaaaaaaaaaaaaa

SEQ ID NO: 11789 - DNA, 186 bp, Homo sapiens
tgaatataattagtctcatttgaaatttagtagctgaacatatactgtattaattaacaatactggtcaggcacgttggsdcatgcctgtcatcccagcactttgggaggccggggcaggaggatcagtcaagaccgggagtttgagactaacctgggcaacagagcaagaccctgtctctacaaa

SEQ ID NO: 11790 - DNA, 479 bp, Homo sapiens
ttttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaatt

SEQ ID NO: 11791 - DNA, 316 bp, Homo sapiens; identical to SEQ ID NO: 11630

SEQ ID NO: 11792 - DNA, 133 bp, Homo sapiens
  misc_feature 78: n=a, g, c or t
gttaaatattgtctaatcaggcmgggcgcggtggctcacgtctgtggtcccggcactttgggagcctgaggcaggcgnatcatgaggtcaggagatcaagaccatcgtggcttacacggtgaaacccacgtct

SEQ ID NO: 11793 - DNA, 358 bp, Homo sapiens
  misc_feature 315: n=a, g, c or t
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaanccatgatctcactactgcactccagcctgggcaagagtaagac

SEQ ID NO: 11794 - DNA, 226 bp, Homo sapiens
atgcagcgcgcggcgatggagttcaagaccagcctggccaacatggtgaaacctgtctctactaaaaatacaaaaattagctgggcgtggtggcgcacgctgtagtcccagctactcgggaggctgaagcagaagaattgcttgaacctgggaggcagaggttgcagtgagctgagatcatgccactgcactctagcctgggtgacagagtgagactgcgtctaag

SEQ ID NO: 11795 - DNA, 192 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaa

SEQ ID NO: 11796 - DNA, 186 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaa

SEQ ID NO: 11797 - DNA, 90 bp, Homo sapiens
  misc_feature 19,35: n=a, g, c or t
ccttctccccggcggttantgctgagagtgcggantgtgtgctcsgggctcggaacacacatttattattaaaaratcsaaaaaaaaaaa

SEQ ID NO: 11798 - DNA, 298 bp, Homo sapiens
cagataaaagtctatgtcctggcgcatggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgasagagcgagactctrtctcaa

SEQ ID NO: 11799 - DNA, 106 bp, Homo sapiens
cgatgagagctcattgcagctttgaactcctgggcttaagcaatcctctcacctcagccttctgagtagctggactacaggcacctgccaccatgtttsggctaat

SEQ ID NO: 11800 - DNA, 118 bp, Homo sapiens; identical to SEQ ID NO: 11692

SEQ ID NO: 11801 - DNA, 224 bp, Homo sapiens
cataagaatttataaacttgaaatagaaatattctattgtaaaggttaagaaaagtatacttggttggccaccgaggctcactaccattcccagtacttcgggaggcagggtggaaggattgctcgagcccagaaggtggaggctgcagtgagccatgatcatgccactgcactccaacctgggtaacagagggagaccttgtctgaaaaaaaaaaaaaaaaaa

SEQ ID NO: 11802 - DNA, 197 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaa

SEQ ID NO: 11803 - DNA, 213 bp, Homo sapiens; identical to SEQ ID NO: 11736

SEQ ID NO: 11804 - DNA, 226 bp, Homo sapiens; identical to SEQ ID NO: 11782

SEQ ID NO: 11805 - DNA, 340 bp, Homo sapiens
ataatacataagatatggtattgtgtgcctgggctcttagacctagcatagtattttcaaggttaatgtgtagcatgagtcactacttcattcctttctgtgtctgagtaacattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcaagaccagcttgggcaacagtgcaagaccctgtatctacccaaaa

SEQ ID NO: 11806 - DNA, 345 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaaaaaaaaagg

SEQ ID NO: 11807 - DNA, 243 bp, Homo sapiens
atgcagcgcgcggcgatggagttcaagaccagcctggccaacatggtgaaacctgtctctactaaaaatacaaaaattagctgggcgtggtggcgcacgctgtagccccagctactcgggaggctgaagcagaagaattgcttgaacctgggaggcagaggttgcagtgagctgagatcatgccactgcactctagcctgggtgacagagtgagactgcgtctaagaaaaaaaaaaaaaaaaa

SEQ ID NO: 11808 - DNA, 171 bp, Homo sapiens
  misc_feature 154: n=a, g, c or t
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctnaaaaaaaaaaaaaaaaa

SEQ ID NO: 11809 - DNA, 207 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagat

SEQ ID NO: 11810 - DNA, 126 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacaca

SEQ ID NO: 11811 - DNA, 235 bp, Homo sapiens
aaggggatttgggggaggcttaaggtagaaacaaaagatctcagttttgccatccaaatcaacccatggccagatcagatttagggtaaattgatttaatggtcaggaatgcatttggtggccagtcttccagggggcccatgaaagttcagggtgagttgtatgatgattgttttatagtagaaataaatgattgataatacctgctttcaactccaaaaaaaaaaaaaaaaag

SEQ ID NO: 11812 - DNA, 121 bp, Homo sapiens
ctttaggtgtattaagatataaggccaggctgggcatggtggctcatgcctgtaatcccagcactttgagtggctgaggtgggaggatcacttgagcccaggrtttcaaggcgagcctggg

SEQ ID NO: 11813 - DNA, 172 bp, Homo sapiens; identical to SEQ ID NO: 11523

SEQ ID NO: 11814 - DNA, 331 bp, Homo sapiens
taaatgatatcgtttggatgtttgtaccctccaaatctcatgttgaaatgtgatcttcaatcttggaggtggagcctaatgggaaatgtttggattatgggggcagatcctttataaatggattggtgccttcccagcagtaaatgtgagtgagttctagctctcctacttcatgcaacagctggttgtttaaagagcttggcaccccctcttctctctcttgatcactctcttcaccttgtgacacccctgctctccttttgccttctaccaccattgtaagcttcctgaggccctcatcagaagcagatgctggtgccatgcctttttt

SEQ ID NO: 11815 - DNA, 117 bp, Homo sapiens
ctttaggtgtattaagatataaggccaggctgggcatggtggctcatgctgtaatcccagcactttgagtggctgaggtgggaggatcacttgagcccaggatttcaaggcgagcct

SEQ ID NO: 11816 - DNA, 213 bp, Homo sapiens; identical to SEQ ID NO: 11736

SEQ ID NO: 11817 - DNA, 79 bp, Homo sapiens
gamcacttccatggattgtcsttggacttagggcgcsctgsscgcsttttgcagacgagaaaaaacttttttttttttt

SEQ ID NO: 11818 - DNA, 187 bp, Homo sapiens; identical to SEQ ID NO: 11697

SEQ ID NO: 11819 - DNA, 53 bp, Homo sapiens
gtcagacaataaagtctttgtaaaaagagaaaaaaaaaaaaaaaaaaaaaaaa

SEQ ID NO: 11820 - DNA, 241 bp, Homo sapiens
ccgaggtgggtgtatcacctgaggtcaggagtttgagaccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcaaaaa

SEQ ID NO: 11821 - DNA, 122 bp, Homo sapiens
  misc_feature 2: n=a, g, c or t
anagaagaaaagatatataggkggctcacgcctgtaatcccaaagtgctgggattacaggtgtgagcactgcgsctggcccccatcacataattttaactcttaagtaggctgggaagttaa

SEQ ID NO: 11822 - DNA, 460 bp, Homo sapiens
ggatgtcacaatgacttggctggaggtgtcctgaagtctcttgtttgtccagggcctttgctgcagcttatatgttcactagtaatctggcctgtgcctaccttttaatcccagctggaaaatctcagtaagaatgatgataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatgg

SEQ ID NO: 11823 - DNA, 173 bp, Homo sapiens
ctaaaaattagccaggcctggtggcaggtgactgtaatgccagctactcgggaggctgaggtaagagaattgcttgaacctgggtggaagaagttgcagtgagccaagattgtkccactgcactcctgcctgggtgatagagtgacactccttctcaaaaaaaaaaaaaaaaa

SEQ ID NO: 11824 - DNA, 201 bp, Homo sapiens
tgaatataattagtctcatttgaaatttagtagctgaacatatactgtattaattaacaatactggtcaggcacgttggskcatgcctgtcatcccagcactttgggaggccggggcaggaggatcagtcaagaccgggagtttgagactaacctgggcaacagagcaagaccctgtctctacaaaaaaaaaaaaaaaaaa

SEQ ID NO: 11825 - DNA, 200 bp, Homo sapiens; identical to SEQ ID NO: 11569

SEQ ID NO: 11826 - DNA, 490 bp, Homo sapiens
gactgacaactcacacggctgggtactcttctgagacaaaacttccagaggagcgatcaggcagcaacatttgctgttcaccaatatccattgttctgcagcctctgctgctgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaagaagttaaaaaccttgaaaaa

SEQ ID NO: 11827 - DNA, 305 bp, Homo sapiens
gatagattaaaaattttctgggctgggcgcggtggctcatgccggtaatcccagcactttgggaggccgaggcaggckgatcacaaggtcaggagatcgagdbcatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctsggcgacagagcgaggttccgtctcaaaa

SEQ ID NO: 11828 - DNA, 371 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcttgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaaa

SEQ ID NO: 11829 - DNA, 336 bp, Homo sapiens; identical to SEQ ID NO: 11642

SEQ ID NO: 11830 - DNA, 225 bp, Homo sapiens; identical to SEQ ID NO: 11617

SEQ ID NO: 11831 - DNA, 306 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccaggaggcagagctttcamtgagccaagatcgsaccactgcactccagcctgggcgacagagcgaggttccgtctcaaaaaa

SEQ ID NO: 11832 - DNA, 142 bp, Homo sapiens
  misc_feature 62: n=a, g, c or t
ctttaggtgtattaagatataaggccaggctgggcatggtggctcatgcctgtaatcccagnactttgagtggctgaggtgggaggatcacttgagcccaggatttcaaggcgagcctgggacacatggtgaaacctgtctc

SEQ ID NO: 11833 - DNA, 492 bp, Homo sapiens
ttctcatcagggctgcccataggaggtctcatcatttccagcagaggaaagaaacttgaagaaagaatggatttaagtaattgcctccaggcagtcttctctctctcctccctctctttaaaaaaaatcatgggatcatgtaatttttcagcataaataatggcaataatggttggaggacaagctgtttctagaatgaaggtcaagttagctgaggcctagaaagactacattccagctgtatgggacagtgaaaggactttgctggtgcagaaactttatcaactagtgggaatctcttctgaaagcacctactcagtctgagtaccactatgagtacacggcgtgtgacagcacgggttccaggtggagggtcgccgtgccgcataccccgggcctgtgcaccagcctgcctgaccccgtcaaggcaccgagtgctccttctcctgcaacgccggggagtttctggatatgaaggaccagtcatgtaag

SEQ ID NO: 11834 - DNA, 225 bp, Homo sapiens; identical to SEQ ID NO: 11617

SEQ ID NO: 11835 - DNA, 200 bp, Homo sapiens; identical to SEQ ID NO: 11569

SEQ ID NO: 11836 - DNA, 377 bp, Homo sapiens
  misc_feature 184: n=a, g, c or t
ttagatagctgtattatagtgagtcctctgggactgtttggttcttttggtatgatggtatttttgttatgtcaaatactgtctgaaaaaattataagaaaatatgtgttctttttggccgggtgcggtggcttaccgctgtaatctcagcactttggaaggccgtggcgggtgagtcacctgnggtcagaagttcaagccagcctggccaacatggtgaaacccatctctagtaaaaataaaaaaaattagtctggcatggtagtgcgtgcctgtagtcccagctactttgtaggctgaggcaggagaattgcttgaacctgggaggcggagggtgcaatgaattgagattgcgccactgcactccagcctaggcg

SEQ ID NO: 11837 - DNA, 303 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtgaaacttcgtctccaaaaaaaaaaa

SEQ ID NO: 11838 - DNA, 156 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcactttcagcctgggtgacagagtgagactctgtc

SEQ ID NO: 11839 - DNA, 181 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctct

SEQ ID NO: 11840 - DNA, 213 bp, Homo sapiens; identical to SEQ ID NO: 11736

SEQ ID NO: 11841 - DNA, 82 bp, Homo sapiens; identical to SEQ ID NO: 11689

SEQ ID NO: 11842 - DNA, 120 bp, Homo sapiens
ctttaggtgtattaagatataaggccaggctgggcatggtggctcatgctgtaatcccagcactttgagtggctgaggtgggaggatcacttgagcccaggatttcaaggcgagcctggg

SEQ ID NO: 11843 - DNA, 507 bp, Homo sapiens
  misc_feature 367,436,478,484,489,503,505: n=a, g, c or t
ttctcatcagggctgcccataggaggtctcatcatttccagcagaggaaagaracttkaagaaagaatggatttragtaattgcctccaggcagtcttctctctctcctccctctctttaaaaaaaatcatgggatcatgtaatttttcagcataaataattggcaataatggttggaggacaagctgtttctagaatgaaggtcaagttagctgaggcctagaaagactacattccagctgtatgggacagtkaaaggactttgctggtgcagaaactttatcaactagtgggaatctcttctgaaagcacctactcagtctgagtaccactatgagtacacggcgtgtgacagcacgggttccangtggagggtcgccgtgccgcataccccgggcctgtgcaccagcctgcctgaccccgtcaaggcaccgantgctccttctcctgcaacgccggggagtttctggatatkaangaccantcatntaagccatgcgctnangg

SEQ ID NO: 11844 - DNA, 200 bp, Homo sapiens; identical to SEQ ID NO: 11569

SEQ ID NO: 11845 - DNA, 158 bp, Homo sapiens
ctttaggtgtattaagatataaggccaggstgggcatggtggctcatgctgtaatcccagcactttgagtggctgaggtgggaggatcacttgagcccaggatttcaaggcgagcctgggacacatggtgaaacctgtctctgcaaaaaaaaaaaaaa

SEQ ID NO: 11846 - DNA, 200 bp, Homo sapiens; identical to SEQ ID NO: 11569

SEQ ID NO: 11847 - DNA, 190 bp, Homo sapiens
tgaatataattagtctcatttgaaatttagtagctgaacatatactgtattaattaacaatactggtcaggcacgttggstcatgcctgtcatcccagcactttgggaggccggggcaggaggatcagtcaagaccgggagtttgagactaacctgggcaacagagcaagaccctgtctctacaaaaaaa

SEQ ID NO: 11848 - DNA, 166 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaa

SEQ ID NO: 11849 - DNA, 364 bp, Homo sapiens
  misc_feature 16,284,315..316: n=a, g, c or t
aaggatgtcaaaatgndaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcscagctacttgggaggctgaggtgggaraattncttgagcccaggagtctgaaactgcggtaanncatgatctcactactgcactccagcctgggcaagagtaagaccctgta

SEQ ID NO: 11850 - DNA, 213 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcycagaaggtggaggctgcagtgagccatgatcatgccactgcactccaacctgggtaacagagggagaccttgtctgaaaaa

SEQ ID NO: 11851 - DNA, 246 bp, Homo sapiens
  misc_feature 111: n=a, g, c or t
ccgaggtgggtgtatcacctgaggtcaggagtttgagaccagcctggacaacatggtaaaaccccgtctctgctaaaaatacaagagttagctgggcgtggtggcaggcanctgtggtcccagctactcgggaggctgaggcaggagaattgcttgagcccaggaggcagaggttgcagtgagccaagatcatgcccctgcactccagcctaggcgacagagctagactctgtctcaaaaaaaaaa

SEQ ID NO: 11852 - DNA, 314 bp, Homo sapiens; identical to SEQ ID NO: 11579

SEQ ID NO: 11853 - DNA, 200 bp, Homo sapiens; identical to SEQ ID NO: 11569

SEQ ID NO: 11854 - DNA, 373 bp, Homo sapiens
agttcaactatgcaagtcagtcacaacagtggactaaatcaatgcacgagagcccaaatctcaccaacagactgtgttttgataggggaagcacagcccccaggtgttctaaatcctggacttggtgttatcatctcatctgtcgattggattgatgcatgagagtcacaattccaacttgattgcctcttggtaggagagtcatttttgttcctgtgatctggttacagaaattggtcaacatccctcctgtggctcaatccacatgtgaccgacatgatccaactgtggactgtatctgtcagtgagattcaggaactattttgctctctccctatataaaggtgacaattttaacagtcaaaaaaaaaaa

SEQ ID NO: 11855 - DNA, 345 bp, Homo sapiens
  misc_feature 335: n=a, g, c or t
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacttcagccttccaaagtgctgagattacagtcctgagccactgctttcggccttacagaattgttttgttttggggcattcagaagtctgacataaaaattaacttgaaaaaraanaaaaaaaagg

SEQ ID NO: 11856 - DNA, 187 bp, Homo sapiens; identical to SEQ ID NO: 11697

SEQ ID NO: 11857 - DNA, 148 bp, Homo sapiens; identical to SEQ ID NO: 11566

SEQ ID NO: 11858 - DNA, 200 bp, Homo sapiens; identical to SEQ ID NO: 11569

SEQ ID NO: 11859 - DNA, 128 bp, Homo sapiens
ttaggcccaagaattacctgaacctgggacgtggaggttgcggtgagccaagatcgcaccactgtaccctagcctgggcaacagagtgactcttaaaaaaaaaaaaaaaaamaaaaaaaaaaaaaaaa

SEQ ID NO: 11860 - DNA, 174 bp, Homo sapiens; identical to SEQ ID NO: 11671

SEQ ID NO: 11861 - DNA, 99 bp, Homo sapiens
  misc_feature 28: n=a, g, c or t
atgcagcgcgcggcgatggagttcaagnbcagcctggccaacatggtgaaacctgtctvtadbtaaaaatasaaaaattagctgggcgtggtggcgcac

SEQ ID NO: 11862 - DNA, 344 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaaaaaaaaaa

SEQ ID NO: 11863 - DNA, 164 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaacccatctctactaaaaatacaacaaatyggctgggcgcggtagc

SEQ ID NO: 11864 - DNA, 82 bp, Homo sapiens; identical to SEQ ID NO: 11689

SEQ ID NO: 11865 - DNA, 200 bp, Homo sapiens; identical to SEQ ID NO: 11569

SEQ ID NO: 11866 - DNA, 141 bp, Homo sapiens
ctttaggtgtattaagatataaggccaggctgggcatggtggctcatgctgtaatcccagcactttgagtggctkaggtgggaggatcacttgagcccaggatttcaaggcgagcctgggacacatggtgaaacctgtctc

SEQ ID NO: 11867 - DNA, 304 bp, Homo sapiens
  misc_feature 252,270,284: n=a, g, c or t
aaggatgtcaaaatgahwatggtaccataaatagccaacgttgattaaaattaaacatgattactttaacaaaaagaaacttaaggccaggtatggtgggtcatgcctgtaatcctagcactttgkgaggctgaagtggaaggatcacttgagcccaggagttcaagaccagcctggagaacacagagagacccccaccatctcttccaaaaataaaaactagccaggcatggtggctcaggcctgtagtcnmagctacttgggaggctnaggtgggagaattnttgagcccaggagtctgaaa

SEQ ID NO: 11868 - DNA, 96 bp, Homo sapiens
  misc_feature 75: n=a, g, c or t
ctttaggtgtattaagatataaggccaggctgggcatggtggctcatgctgtaatcccagcactttgagtggctnaggtgggaggatcacttgags

SEQ ID NO: 11869 - DNA, 170 bp, Homo sapiens; identical to SEQ ID NO: 11644

SEQ ID NO: 11870 - DNA, 158 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaatatggtgaaacgtgtctctacgaaaaaaaaaaaaaaaaaag

SEQ ID NO: 11871 - DNA, 336 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaa

SEQ ID NO: 11872 - DNA, 57 bp, Homo sapiens
tgtkwtattttcttaaaatcaskcttttatgctttakgaactggttggtctccastt

SEQ ID NO: 11873 - DNA, 366 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatc

SEQ ID NO: 11874 - DNA, 79 bp, Homo sapiens
ctttttcgcaacgggtttgccgccagaacacaggtgtcgtgaaaactcacccctcaaaagccaaaaaaaaaaaaaaaaa

SEQ ID NO: 11875 - DNA, 381 bp, Homo sapiens
  misc_feature 318: n=a, g, c or t
acagagcaaaaatctgtctaaaaaaaaaaaagaagagactggcacatccatacaatggatgagccaactgttaaaaaaaaaagawtgaggggctgggcgtggtggctcacacctgtaatcccaggastttgggaggccgaggcgggcggatcatgaggtcaggagatcgagaccttcctggctaasacggtgaamcctgtctctactaaaaatacacacacacacaaaawttagctgggtgtggtggcaagcacctgtattcccagctactcgggaggctgaggcaggagaatggtgtgaaccaggaggtggagcttnsagtgasctgagatcgcgcmactgcactccagcctgggtgacagagcgagactccatctcaaa

SEQ ID NO: 11876 - DNA, 59 bp, Homo sapiens
gtcagacaataaagtctttgtaaaaagagaaaaaaaaaaaaaaaaaaaaaaaaaaaaaa

SEQ ID NO: 11877 - DNA, 279 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccagtaggcagagctttcagtgagccaagatcgcaccactgcactccagcctggg

SEQ ID NO: 11878 - DNA, 174 bp, Homo sapiens; identical to SEQ ID NO: 11611

SEQ ID NO: 11879 - DNA, 318 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaa

SEQ ID NO: 11880 - DNA, 360 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgaagcccaggagttcgagaccagcctgggcaacatggcgaaaaccctgtctaacaaaaaaaatacaaaagttagccaggagtggtggcacaagctgtagtccctgctgctagggagactgtagtgggaggatcacttcagcctgggagaccaaggctgcagtgagtcatgagtgtgcccattgcaccccagtgtggggccacagagcgagaccttgtctccaaaaaaa

SEQ ID NO: 11881 - DNA, 306 bp, Homo sapiens
cacgagactccatctttaaaaaaaaacaagacgggccggcacgtggctcacgcctgtaatcccagcactgagaggccgatcacttgaggtcaggagttcgggaccagcctggccggcatggtggaacccatctctactgaaaaatacaaaaattagccgggcatggtggcacacacctgtaatcgtagctggggcaggagaatcgcctgaacccgggaggcggascttgcagcgagccgagatcgtgccgctgcactccagcctgggcgacagagtgagactccatctcaaaaaaaaaaaaaaaaa

SEQ ID NO: 11882 - DNA, 188 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaa

SEQ ID NO: 11883 - DNA, 121 bp, Homo sapiens
ttaatataattagtctcatttgaaatttagtagctgaacatatactgtattaattaacaatactggtcaggcacgttggctcatgcctgtcatcccagcactttgggaggccggggcagga

SEQ ID NO: 11884 - DNA, 547 bp, Homo sapiens
tatgctattttattttaatgggtcatattccactaatgtcatttattttgatgttcatactgtctcaggtttgcctggtgggacctctttaagctggcttctgtgtcttttgacctatcatttcagagaagcatttctctacttctgacacaacagtataatctaggctcatcttgttttattcctgctgtagttctgaaatcaccatttctctgagtaaccttgatttctttttggtgagaataatatttagaagccaaagtgggtgctaggtgtgggttattgctactctcagtcagcatggctaggaaatgtgtgtttgtgtgtgtgtgtattcctacggagatacatatttctataaattcacatctattgtttctatatctatgtagaaaactgtgggccaggcgcgatggcttatgcctgtaatcctagcattttgggaggccgaagccagcgggatgacttgaggtccagagttcgaaaccagcctagctaatgaaaccctgtctctactaaaaatacaaaaaaaaaaaaaaaaaagctt

SEQ ID NO: 11885 - DNA, 117 bp, Homo sapiens
  misc_feature 33: n=a, g, c or t
tgtctaggctgagcgtggtggctcacgcctgtnctcctaccactttgggaggccaaggcaggcggatcatttgaggtcagargtkcgataccagcctgascaacatgatgaracccc

SEQ ID NO: 11886 - DNA, 209 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctga

SEQ ID NO: 11887 - DNA, 69 bp, Homo sapiens
gtcagacaataaagtctttgtaaaaagagaaaaaaaaaaaaaaaaaaaaaaaaaaaaaaaaaaaaaaaa

SEQ ID NO: 11888 - DNA, 82 bp, Homo sapiens; identical to SEQ ID NO: 11689

SEQ ID NO: 11889 - DNA, 290 bp, Homo sapiens
aaaaagtccctgggaagcggccgggcgcgtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcggga

SEQ ID NO: 11890 - DNA, 281 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgsactccagcctgggcga

SEQ ID NO: 11891 - DNA, 111 bp, Homo sapiens
ctttaggtgtattaagatataaggccaggctgggcatggtggctcatgctgtaatcccagcactttgagtggctgaggtgggaggatcacttgagcccaggatttcaaggc

SEQ ID NO: 11892 - DNA, 98 bp, Homo sapiens
  misc_feature 18..19: n=a, g, c or t
ccccttctccccggcggnnagtgctgagagtgcggagtgtgtgctccgggctcggaacacacatttattattaaaaaatccaaaaaaaaaaaaaaaaa

SEQ ID NO: 11893 - DNA, 97 bp, Homo sapiens
cccttctccccggcggttvgtgctgagagtgcggagtgtgtgctccgggctcggaacacacatttattattaaaaaatccaaaaaaaaaaaaaaaaa

SEQ ID NO: 11894 - DNA, 99 bp, Homo sapiens
cccttctccscggcggtkvgtgctgagagtgcggagtgtgtgctccgggctcggaacacacatttattattaaaaaatccaaaaaaaaaaaaaaaaarg

SEQ ID NO: 11895 - DNA, 483 bp, Homo sapiens
cagagagcaagagcgtcgctccccctcgccttctcggccgccctcccggtttaccgccccctgtgtccagagatcacagatggagagacattttgccacacgatgaatcacacaccacatctcatccccgagcttcagctgcaggacaatgctgccagaggcctggtcctcagagctcacgatcttatcaaatttaatgggcacatctgaagaaggaaacttgctcagcaccgtgagccccacagtgaaagcactttttggcaagactagagtctcaccgattttccctttctctcctcgatctcctttccagcctcttattccccggactcctggctcaccctggggccccgtgggtccagcttctcccttgggaccaggctttccaatagggcccatggggcgkttaamcmrktkggsccmaargscaatgttgccccttggcccctcaggaccagtgggacccacgtcacccttattccc

SEQ ID NO: 11896 - DNA, 314 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaawawaaaaa

SEQ ID NO: 11897 - DNA, 163 bp, Homo sapiens
ctttaggtgtattaagatataaggctaggctgggcatggtggctcatgcctgtaatcccagcactttgagtggctgaggtgggaggatcacttgagcccaggatttcaaggcgagcctgggacacatggtgaaaccctgtctctgcaaaaaaaaaaaaaaaaa

SEQ ID NO: 11898 - DNA, 143 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccctgtctc

SEQ ID NO: 11899 - DNA, 471 bp, Homo sapiens
gactgacaactcatacggctgggtactcttctgagacaaaacttccagaggagcgatcaggcagcaacatttgctgttcaccaatatccattgttctgcagcctctgctgctgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaag

SEQ ID NO: 11900 - DNA, 118 bp, Homo sapiens
  misc_feature 13,78: n=a, g, c or t
gttaaatattgtntaatcaggccgggcgcggtggctcacgtctgtggtcccggcactttgggagcctgaggcaggcgnatcatgaggtcaggagatcaagaccatcgtggcttacacg

SEQ ID NO: 11901 - DNA, 314 bp, Homo sapiens
atttttggattttctttaaaaatgcacattccaggctgggcgcagtggctcacgtgtgtaatcccagtactttgggaggctgagggcggatcacaaagccaggagttcaagaccaacctgggcaatatggtgaaacccatctctactaaaaatataaaaagttagccaggtatggtggcacaagcctgtagtcccagccacttgggaggctgaggcagaagaatcacttgaacccgggaggcggaggttgcagtgagccgagatcgtgccactgcactcaagcctaggcaacagagtaagactctgtctcgaaa

SEQ ID NO: 11902 - DNA, 200 bp, Homo sapiens; identical to SEQ ID NO: 11569

SEQ ID NO: 11903 - DNA, 101 bp, Homo sapiens
  misc_feature 19: n=a, g, c or t
ccccttctccccggcggtnagtgctgagagtgcggagtgtgtgctccgggctcggaacacacatttattattaaaaaatccacaaaaaaaaaaaaaaaagc

SEQ ID NO: 11904 - DNA, 207 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtct

SEQ ID NO: 11905 - DNA, 200 bp, Homo sapiens; identical to SEQ ID NO: 11569

SEQ ID NO: 11906 - DNA, 322 bp, Homo sapiens
acaatggtacaggcatcatcacgctgcacaatggtttccagkcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctcaagcccctaggaattgaggggtgaggacaaaaaaaaaaaaaaaa

SEQ ID NO: 11907 - DNA, 317 bp, Homo sapiens
  misc_feature 316: n=a, g, c or t
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaagaaaaaaaaaang

SEQ ID NO: 11908 - DNA, 296 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtct

SEQ ID NO: 11909 - DNA, 67 bp, Homo sapiens
aaaaaaaaaaaaaaaaaaaaaaaaaaaaaaaaaaaaaaaaaaaaaaaaaaaaaaaaaaaaaaaaaaa

SEQ ID NO: 11910 - DNA, 174 bp, Homo sapiens; identical to SEQ ID NO: 11611

SEQ ID NO: 11911 - DNA, 253 bp, Homo sapiens; identical to SEQ ID NO: 11749

SEQ ID NO: 11912 - DNA, 68 bp, Homo sapiens; identical to SEQ ID NO: 11613

SEQ ID NO: 11913 - DNA, 80 bp, Homo sapiens
ctttttcgcaacgggtttgccgccagaacacaggtgtcgtgaaaactacccctaaaagccaaaaaaaaaaaaaaaaargy

SEQ ID NO: 11914 - DNA, 306 bp, Homo sapiens
aaaaagtccctgggaagcggccgggcgcggttggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaa

SEQ ID NO: 11915 - DNA, 173 bp, Homo sapiens; identical to SEQ ID NO: 11575

SEQ ID NO: 11916 - DNA, 487 bp, Homo sapiens
actcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatgagcaactctaggctaaatctgagccggggagaggaacacagaacaggggtcaggttagagataagaggaaacattggcactgcagtcaaataggctagtgtgagaaacaccaacagcaggcccatctcagatcttcactatggcaacttatgcaagaaac

SEQ ID NO: 11917 - DNA, 298 bp, Homo sapiens
  misc_feature 18..19: n=a, g, c or t
cacgagactccatctttnnaaaaaaacaagacgggccggcacgtggctcacgcctgtaatcccagcactgagaggccgatcacttgaggtcaggagttcgggaccagcctggccggcatggtggaacccatctctactgaaaaatacaaaaattagccgggcatggtggcacacacctgtaatcgtagctggggcaggagaatcgcctgaacccgggaggcggacttgcagcgagccgagatcgtgccgctgcactccagcctgggcgacagagtgagactccatctcaaaaaaaaaa

SEQ ID NO: 11918 - DNA, 353 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaa

SEQ ID NO: 11919 - DNA, 200 bp, Homo sapiens; identical to SEQ ID NO: 11569

SEQ ID NO: 11920 - DNA, 162 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaaccctgtctctgcaaaaaaaaaaaaaaaaa

SEQ ID NO: 11921 - DNA, 123 bp, Homo sapiens
ctttaggtgtattaagatataaggccaggctgggcatggtggctcatgctgtaatcccagcactttgagtggctgaggtgggaggatcacttgagcccaggatttsaaggcgagcctgggaca

SEQ ID NO: 11922 - DNA, 209 bp, Homo sapiens
ataatvcataasatatggtattgtgtgcctgggctcttagacctagcatagtattttcaaggttaatgtgtagcatgagtcactacttcattcctttctgtgtctgagtaacattccattgtatggatatgccacattattcattcatcatttatggacattrggttatcagaattactttagagtaaaactgatgswtgaagaagtgt

SEQ ID NO: 11923 - DNA, 155 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttct

SEQ ID NO: 11924 - DNA, 172 bp, Homo sapiens
  misc_feature 154: n=a, g, c or t
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctnaaaaaaaaaaaaaaaaaa

SEQ ID NO: 11925 - DNA, 172 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccctgtctctgcaaaaaaaaaaaaaaaaaagytatatc

SEQ ID NO: 11926 - DNA, 171 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctaaaaaaaaaaaaaaaaaa

SEQ ID NO: 11927 - DNA, 509 bp, Homo sapiens
taacgcgccagaacctcggcccgggcgccctcgtcggccgcggaggagctgcagcctccaacaggaaggtgtggtccctgccatgctatctgctctgctcagcgactgaaggtgcccgcatcccagctctgccaggaagcaaaggtaagggcactgctcagcactaaagccctggatagtgttcagggcatcccctcatccctggagccctgatgaagggggcacgtcttcccctctgtkattgccaagaacagtcctaagatggagtgagatggatcagttgggcagtgtgatggaatgttgtttaccttgcatgttcagagccgtttacaacagagaagcttcctgaaacttggacttagctaagacctggctggtctcatagcacaggggagacttcacaggtgatgttctggggacattacagagtgtcccgaagatagaggcctttcagagaggaccagggccatagtcagcactgaagagctggatagcagtcttggctcagt

SEQ ID NO: 11928 - DNA, 100 bp, Homo sapiens
  misc_feature 18..19,35..36: n=a, g, c or t
cccttctccccggcggtnngtgctgagagtgcggnnhvtgtgctccgggctcggaacacacatttattattaaaaaatccaaaaaaaaaaaaaaaaaagc

SEQ ID NO: 11929 - DNA, 307 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaa

SEQ ID NO: 11930 - DNA, 298 bp, Homo sapiens
  misc_feature 18..19,123: n=a, g, c or t
caaaaactagccaggcanngctgggcgcggtggctcacgcctgtaatcccagcactttgggaggccgakgcgggcggatctcgaggtcaggagattgagaccatcccggctaacacggtgaancccgtctctactaaaaatacaaaaaaaattakctgggcgtggtggcaggtgcctgtggtcccagctactcgggaggctgaggcagaagaatggcgtgaacttgggaggtggagcttacagtgagccgagatcacaccactgcactccagcctgggggacagagcgagactccgtc

SEQ ID NO: 11931 - DNA, 201 bp, Homo sapiens
  misc_feature 81: n=a, g, c or t
tgaatataattagtctcatttgaaatttagtagctgaacatatactgtattaattaacaatactggtcaggcacgttggcncatgcctgtcatcccagcactttgggaggccggggcaggaggatcagtcaagaccgggagtttgagactaacctgggcaacagagcaagaccctgtctctacaaaaaaaaaaaaaaaaaa

SEQ ID NO: 11932 - DNA, 316 bp, Homo sapiens
cagataaaagtctatgtsvtggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaagg

SEQ ID NO: 11933 - DNA, 225 bp, Homo sapiens
  misc_feature 132: n=a, g, c or t
cataagaatttataaacttgaaatagaaatattctattgtaaaggttaagaaaagtatacttggttggccaccgaggctcactaccataatcccagtacttcgggaggcagggtggaaggattgctcgagcncagaaggtggaggctgcagtgagccatgatcatgccactgcactccaacctgggtaacagagggagaccttgtctgaaaaaaaaaaaaaaaaa

SEQ ID NO: 11934 - DNA, 125 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacac

SEQ ID NO: 11935 - DNA, 314 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattggctgggcgcggtggcgggtgcctgtagtcccagctgctcgggaggctgaggcaggagaatggcctgaacccaggaggcggascttgcagtgagctgagatagtgccactgcactccggcctggtgaaagagcgagactccgtctcaaaaaaaaaaaaaaaaagg

SEQ ID NO: 11936 - DNA, 225 bp, Homo sapiens; identical to SEQ ID NO: 11617

SEQ ID NO: 11937 - DNA, 226 bp, Homo sapiens; identical to SEQ ID NO: 11782

SEQ ID NO: 11938 - DNA, 201 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaaaa

SEQ ID NO: 11939 - DNA, 303 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcactgtgatctcagctactcgggaggctgaggcaggagaatcacttgaacccaggaggcagaggttgcagtgagccaagatcacaccactgcactccagcctgggcgacaaagcaagactccatctcaaaaaaaaaaaaaaaaa

SEQ ID NO: 11940 - DNA, 198 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaa

SEQ ID NO: 11941 - DNA, 343 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaaaaaaaaa

SEQ ID NO: 11942 - DNA, 143 bp, Homo sapiens; identical to SEQ ID NO: 11898

SEQ ID NO: 11943 - DNA, 292 bp, Homo sapiens
  misc_feature 152,291: n=a, g, c or t
tcattaaaatggagagtgaagcaaggggattgctaacattggaaacagataagactttttgggtcataaatttaaaaaccatgaaaatcatcttagcttaatttataacactgtagttaaaacatatgtattccctctctcttgaataaganagcaggggtgctacactcaaacctgctttctgcccccatcacaaataatttattcctcacttaccatattgtatctgaactatttttcttgcctgactctgccagcaggatatatgtaccaaaataaaattaataaaanc

SEQ ID NO: 11944 - DNA, 82 bp, Homo sapiens; identical to SEQ ID NO: 11689

SEQ ID NO: 11945 - DNA, 173 bp, Homo sapiens; identical to SEQ ID NO: 11575

SEQ ID NO: 11946 - DNA, 200 bp, Homo sapiens
tgaatataattagtctcatttgaaatttagtagctgaacatatactgtattaattaacaatactggtcaggcacgttggctcatgcctgtcatcccagcactttgggaggccggggcakgaggatcagtcaagaccgggagtttgagactaacctgggcaacagagcaagaccctgtctctacaaaaaaaaaaaaaaaaa

SEQ ID NO: 11947 - DNA, 343 bp, Homo sapiens; identical to SEQ ID NO: 11941

SEQ ID NO: 11948 - DNA, 113 bp, Homo sapiens
ctttaggtgtattaagatataaggccaggctgggcatggtggctcatgcctgtaatcccagcactttgagtggctgaggtgggaggatcacttgagcccaggatttcaaggcg

SEQ ID NO: 11949 - DNA, 82 bp, Homo sapiens; identical to SEQ ID NO: 11689

SEQ ID NO: 11950 - DNA, 137 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaamcgtgtctcta

SEQ ID NO: 11951 - DNA, 301 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcargagaatggtgtgaacctgggaggtggagcttkcagtgarcagagatarctgcactgcattccagccttggtkacagagcgagamtctgtctccaaaaa

SEQ ID NO: 11952 - DNA, 136 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacc

SEQ ID NO: 11953 - DNA, 108 bp, Homo sapiens
ctttaggtgtattaagatataaggccaggctgggcatggtggctcatgcctgtaatcccagcactttgagtggctgaggtgggaggatcacttgagcccaggatttca

SEQ ID NO: 11954 - DNA, 165 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctgtctctgcaaaaaaaaaaaaaaaaaagc

SEQ ID NO: 11955 - DNA, 119 bp, Homo sapiens
  misc_feature 31: n=a, g, c or t
gtgtgttaagaaatgagctgtaggctcatknhgcagtggctcatgcctgtaatcccagcactttgggaggctgaggtgggcggatcatgaggtaaggagttcgagagcagcctggccaa

SEQ ID NO: 11956 - DNA, 479 bp, Homo sapiens
gactgacaactcacacggctgggtactcttctgagacaaaacttccagaggagcgatcaggcagcaacatttgctgttcaccaatatccattgttctgcagcctctgctgctgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaagaagttaaa

SEQ ID NO: 11957 - DNA, 152 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaaaccgtgtctctacgaaaaaaaaaaaa

SEQ ID NO: 11958 - DNA, 78 bp, Homo sapiens
  misc_feature 33: n=a, g, c or t
tsaattagtttttgacragttaataaaacaganaaatgaaaagacatasaaagtcsaagtcaaaactttttatcgtta

SEQ ID NO: 11959 - DNA, 273 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaaca

SEQ ID NO: 11960 - DNA, 200 bp, Homo sapiens; identical to SEQ ID NO: 11569

SEQ ID NO: 11961 - DNA, 235 bp, Homo sapiens
attaagatcagcctgggtaatacagtgagaccccatctctagaaaaaataaaaaattagtcaaatgtggtgttagtcccagctacgtgggggactagtagtccagctacttgggagggggagatgggaggattgcttgagcctgggaagcgaaggttgcagtaagatgagatcgtgccgctgcactccagcctgggtgacagagtgagactctgtctcttaggaaaaaaaaaaaa

SEQ ID NO: 11962 - DNA, 118 bp, Homo sapiens; identical to SEQ ID NO: 11692

SEQ ID NO: 11963 - DNA, 173 bp, Homo sapiens; identical to SEQ ID NO: 11575

SEQ ID NO: 11964 - DNA, 108 bp, Homo sapiens
ctttaggtgtattaagatataaggccaggctgggcatggtggctcatgctgtaatcccagcactttgagtggctgaggtgggaggatcacttgagcccaggatttcaa

SEQ ID NO: 11965 - DNA, 200 bp, Homo sapiens; identical to SEQ ID NO: 11569

SEQ ID NO: 11966 - DNA, 174 bp, Homo sapiens
tttaaaaaataaataagtaaataaaattgagcctcattttttaamctaattgaaaatgggtgataaaaatgtatacattgsgaccaggtgcggtggctmacacttgtaatcscagcamtttgggaggmmaaggcaggtggatmammtgaggtcaggagttmaagaccagcmtgg

SEQ ID NO: 11967 - DNA, 61 bp, Homo sapiens
aaaaaaaaaaaaaaaaaaaaaaaaaaaaaaaaaaaaaaaaaaaaaaaaaaaaaattttttt

SEQ ID NO: 11968 - DNA, 312 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttgttatcacaccactgcactcctgcctgggtgacagagcaagagcctgtcgccaaaaaaaaaaaaaaaaag

SEQ ID NO: 11969 - DNA, 314 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctcaaaaaaaaaaaaaaraasgs

SEQ ID NO: 11970 - DNA, 57 bp, Homo sapiens
aaaaaaaaaaaaaaaaaaaaaaaaaaaaaaaaaaaaaaaaaaaaaaaaaaaaaaaaa

SEQ ID NO: 11971 - DNA, 312 bp, Homo sapiens; identical to SEQ ID NO: 11535

SEQ ID NO: 11972 - DNA, 110 bp, Homo sapiens
tgaatataattagtctcatttgaaatttagtagctgaacatatactgtattaattaacaatactggtcaggcacgttggctcatgcctgtcatcccagcactttgggagg

SEQ ID NO: 11973 - DNA, 316 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaagg

SEQ ID NO: 11974 - DNA, 78 bp, Homo sapiens; identical to SEQ ID NO: 11631

SEQ ID NO: 11975 - DNA, 89 bp, Homo sapiens
tatattgtttcccaagaagttctacttggtttcatttcaaacctgcctggtttttttgtttgtttgtttttatttttgttttgagacga

SEQ ID NO: 11976 - DNA, 314 bp, Homo sapiens; identical to SEQ ID NO: 11579

SEQ ID NO: 11977 - DNA, 437 bp, Homo sapiens
taagacgctcgggcggcgggacccagggaaggcagcggccggagcgcgcaaggcgagtgggacccggggctgggtaggggttcaagtctggttcggggatcgagtgtgcaccccctccacacacacctactaccctaccccccgcctccaaccctgggacacgacctcgctggtctcaacgagccgctgcctccaactccaccttctgtgcccaaactttccagacttggagtgtctgtccccgcgtccctgccccctcctcgtctttgaccccatacccccatcgattcctcccagtaccccccatcgattcctcgtgccctgcccgtttctcctgtcttggctcccctctgcccgctctcccctgtctctgtcccactttctgcctctgktcctccccggctctgccctctycccgcactgkcccccctcgccct

SEQ ID NO: 11978 - DNA, 106 bp, Homo sapiens
ctttaggtgtattaagatataaggccaggctgggcatggtggctcatgcctgtaatcccagcactttgagtggctgaggtgggaggatcacttgagcccaggattt

SEQ ID NO: 11979 - DNA, 201 bp, Homo sapiens; identical to SEQ ID NO: 11938

SEQ ID NO: 11980 - DNA, 132 bp, Homo sapiens
ctttaggtgtattaagatataaggcctggctgggcatggtggctcatgctgtaatcccagcactttgagtggctgaggtgggaggatcacttgagcccaggatttcaaggcgagcctgggacacatggtgaa

SEQ ID NO: 11981 - DNA, 350 bp, Homo sapiens
ttgtttaagggtggagggcagatcctggtacaccccccacagaggacgactttggatagcagccacagctaaaaaaccctcccctcaagaagtctcagaactccaggctacatatcgtcttcttcgtgggaaaggtaactgccgcatattctcctttcaattttactttatggagagaagtcattgacgttcatcttctttcacttccttctttctttggctttttctttgttaaaagagacttttaatctttgtatatgtttgtttgtttagtggtaaatcattgacagcgttcaaagcattaatctgtcaaaacagtgcaaataaaaatatcaatttccaacacaaaa

SEQ ID NO: 11982 - DNA, 311 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccagtaggcagagctttcagtgagccaagatcgcaccactgcactccagcctgggcgacagagcgaggttccgtctcaaaaaacaaaa

SEQ ID NO: 11983 - DNA, 371 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaaa

SEQ ID NO: 11984 - DNA, 331 bp, Homo sapiens
taaatgatatcgtttggatgtttgtaccctccaaatctcatgttgaaatgtgatcttcaatcttggaggtggagcctaatgggaaatgtttggatcatgggggcagatcctttataaatggattggtgccttcccagcagtaaatgtgagtgagttctagctctcctacttcatgcaacagctggttgtttaaagagcttggcaccccctcttststctcttgatcastctcttcaccttgtgacacccctggctvtccttttgccttctaccacsattgtaagcttcctgaggccctcatcagaagcagatgctggtgccatgccttttt

SEQ ID NO: 11985 - DNA, 200 bp, Homo sapiens; identical to SEQ ID NO: 11569

SEQ ID NO: 11986 - DNA, 173 bp, Homo sapiens; identical to SEQ ID NO: 11575

SEQ ID NO: 11987 - DNA, 110 bp, Homo sapiens; identical to SEQ ID NO: 11654

SEQ ID NO: 11988 - DNA, 112 bp, Homo sapiens; identical to SEQ ID NO: 11643

SEQ ID NO: 11989 - DNA, 311 bp, Homo sapiens
  misc_feature 274: n=a, g, c or t
tatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcantgctccctctgccccgcccccaaaaaaaaaaaaaaaa

SEQ ID NO: 11990 - DNA, 108 bp, Homo sapiens
gttaaatattgtctaatcaggccgggcgcggtggctcacgtctgtggtcccggcactttgggagcctgaggcaggcgatcatgaggtcaggagatcaagaccatcgtg

SEQ ID NO: 11991 - DNA, 79 bp, Homo sapiens
gaacacttccatggattgtccttggacttagggcgccctgccgccttttgcagaggagaaaaaactttttttttttttt

SEQ ID NO: 11992 - DNA, 358 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagac

SEQ ID NO: 11993 - DNA, 118 bp, Homo sapiens
ctttaggtgtattaagatataaggccaggctgggcatggtggctcatgctgtaatcccagcactttgagtggctgaggtgggaggatcacttgagcccaggatttcaaggcgagcctg

SEQ ID NO: 11994 - DNA, 265 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctaggggagactgtagtgggaggatc

SEQ ID NO: 11995 - DNA, 102 bp, Homo sapiens
  misc_feature 100: n=a, g, c or t
ccccttstccccggcggttagtgkytgagagtgcggagtgtgtgctccgggctcggaacacacatttattattaaaaaatccaaaaaaaaaaaaaaaaangc

SEQ ID NO: 11996 - DNA, 163 bp, Homo sapiens; identical to SEQ ID NO: 11668

SEQ ID NO: 11997 - DNA, 121 bp, Homo sapiens
gaattgtgaggctsagggtgggcacggtggctcacacctgtaatcccagcactttgggaggccgaggcgggtggatcacctgaggtcgggagtttgagaccagcctgactaacatggagaa

SEQ ID NO: 11998 - DNA, 330 bp, Homo sapiens
atggtttattttctgagcaaggagtcatcatgggagaccttttttccttattttgggaggtagatcctcccccaatacctgtaaattgagccattccaaatcaggattatgaatgctggaaggatgactcttgtggaaccatagggagcttcctgctttggtattttgttatcgtatttgtcctgatgttcttctctagggcttctgtctgggtaggatatctttttttcattttaaataatatgtttactgtacactaggaaaatttccataaaatacatttactatactttgatgaaaaaaaaaaaaaaaaaaaaaaaaaaaaaaarr

SEQ ID NO: 11999 - DNA, 291 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggctgtagtcccagctacttgggaggctgaaggtgggaagaaattgccttg

SEQ ID NO: 12000 - DNA, 226 bp, Homo sapiens
  misc_feature 35,60,86,120: n=a, g, c or t
cataagdatttataaacttgaaatagaaatattcnattgtaaaggttaagaaaagtatanttggttggccaccgaggctcastacnataatcccagtwhttcgggaggcagggtggaagnattgctcgagcccagaaggtggaggctgcagtgagccatgatcatgccactgcactccaacctgggtaacagagggagavcttgtctgaaaaaaaaaaaaaaaaaa

SEQ ID NO: 12001 - DNA, 99 bp, Homo sapiens
ctttaggtgtattaagatataaggccaggctgggcatggtggctcatgcctgtaatcccagcactttgagtggctgaggtgggaggatcacttgagccc

SEQ ID NO: 12002 - DNA, 200 bp, Homo sapiens
tgaatataattagtctcatttgaaatttagtagctgaacatatactgtattaattaacaatactggtcaggcacgttggctcatgcctgtcatcccagcactttgggaggcctrgggcaggaggatcagtcaagaccgggagtttgagactaacctgggcaacagagcaagaccctgtctctacaaaaaaaaaaaaaaaa

SEQ ID NO: 12003 - DNA, 250 bp, Homo sapiens
aaaaggagaagactgatgttttaggtagggagttcgagaccagcctgaccaacatggagcaaccccatctctactaaaaatataattagccgggcgtggtggggcatgcttgtagtcccagctactcaggaggctgaggcaggagaatcacctgaacccaggagacagaggttgcagtgagccgagatcgccattgtactccagcctgggcaacaagaatgaaactccgtctcaaaaaaaaaaaaaaaaa

SEQ ID NO: 12004 - DNA, 314 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttatttgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaa

SEQ ID NO: 12005 - DNA, 68 bp, Homo sapiens; identical to SEQ ID NO: 11613

SEQ ID NO: 12006 - DNA, 69 bp, Homo sapiens
ataaaaaaaaaaaaaaaaaaaaaaaaaaaaaaaaaaaaaaaaaaaaaaaaaaaaaaaaaaaaaaaaaaa

SEQ ID NO: 12007 - DNA, 103 bp, Homo sapiens
gtgtgttaagaaatgagctgtaggctcagtgcagtggctcatgcctgtaatcccagcactttgggaggctgaggtgggcggatcatgaggtaaggagttcgag

SEQ ID NO: 12008 - DNA, 303 bp, Homo sapiens
atggtttattttctgagcaaggagtcatcatgggagaccttttttccttattttgggaggtagatcctcccccaatacctgtaaattgagccattccaaatcaggattatgaatgctggaaggatgactcttgtggaaccatagggagcttcctgctttggtattttgttatcgtatttgtcctgatgttcttctctagggcttctgtctgggtaggatatctttktktcattttaaataatatgtttactgtacactaggaaaatttccataaaatacatttactatactttgatgaaaaaa

SEQ ID NO: 12009 - DNA, 321 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaaargtc

SEQ ID NO: 12010 - DNA, 173 bp, Homo sapiens; identical to SEQ ID NO: 11638

SEQ ID NO: 12011 - DNA, 170 bp, Homo sapiens; identical to SEQ ID NO: 11644

SEQ ID NO: 12012 - DNA, 200 bp, Homo sapiens; identical to SEQ ID NO: 11569

SEQ ID NO: 12013 - DNA, 181 bp, Homo sapiens; identical to SEQ ID NO: 11839

SEQ ID NO: 12014 - DNA, 200 bp, Homo sapiens; identical to SEQ ID NO: 11569

SEQ ID NO: 12015 - DNA, 82 bp, Homo sapiens; identical to SEQ ID NO: 11689

SEQ ID NO: 12016 - DNA, 433 bp, Homo sapiens
ttaaaataatacttagaggctgggtgaggtgctcacgcctgtaaccccagcactttgggaggccagggcgggtggatcacctgaggtcaggagttcaagaccagcctgaccagcatggtgaaaccccgtctttactaaaagtaccgagattaggccaggcgtggtgggtcacgcctgtaatctcagcactttcggaggccgaggtgggcggatcatctgaggtcaggagttcgagaccatcctgaccggcatggcggaaccctgcctctactaaaaatacaaaaaaaattagtccgttgtggtggcagatgcctgtagtcccggctactcgggaagctaaggcaggagaatcgcttgaaccgaggaggcggaggttgcagtgagccgaaatcacgccactacactccagcctgggcgacaagagcaaaactcc

SEQ ID NO: 12017 - DNA, 306 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaa

SEQ ID NO: 12018 - DNA, 326 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaaaaaaaaaaaaag

SEQ ID NO: 12019 - DNA, 180 bp, Homo sapiens
catcaacagaacagttaccttgccatccagagccctggctttcacataattatgtgcctttgctatttccctgtgacagtggtaattgaaacccactgctgtgtcagccctggttgtgagcttcatttcacgttccaatctgcaccaaccaggtaaacattgcaggctgggcgcggtggc

SEQ ID NO: 12020 - DNA, 516 bp, Homo sapiens
cctgattagaagctctgattgatagacagttccttatgtctttgatgaataaaaaaatgggaaatctaaatatatatggcctgttgcacagttaaaagctcatcaaagcctgaactcagccatgcatggtagctcacgcctgtaactccagcactttgcagggccaaggtgggaggatagcttgagcccaggagttcaagaccagcctggacaacatggtgaaaccccatttccacaaaaaatacaaaacctagccagccatggtggcatgcacctgtagtgtcagctactcagaaggctgaggtgggagaatcacttgagtccgggaagtcaaggctgcagtgagccatgattgtaccactgcactccagtctgggcaacagagggagagcttgtctcaaaacaaaaacaaacccccaaatcacaaaatacccctgagctccatgggataaaataattttacaagtgcactcggtgatgaactatccatggtcactgagctaaaaggtcacagca

SEQ ID NO: 12021 - DNA, 293 bp, Homo sapiens
tttaaagatgttgccatttttrgctgggcacagtggctcacacctgtaatcccagcactttgggaggccgaggtgggcagctcgcttgagtcaggagtttgagaccagcctggccaatatggtgaaaccctgtctctactaaaaaatacaaaaattagctgggcatggtggcatgtgcctgtaatcccagctactcgggaggctgaggcaggagaattgcttgaacccaggaagcagaggctgcagtgagccaagatcataccactgcactccagcctaggtgacagagcgag

SEQ ID NO: 12022 - DNA, 161 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctgtctctgcaaaaaaaaaaaaaaaa

SEQ ID NO: 12023 - DNA, 200 bp, Homo sapiens; identical to SEQ ID NO: 11569

SEQ ID NO: 12024 - DNA, 316 bp, Homo sapiens
catataacctttaaaaaataccatacatatttatgaatgcwatrtaaawccagctataggagtacggctggcgtggtggctcatgcctgcaatctcagcactttgggaggcagaggcgggcggatcactcgaggtcaggagttcaggaccagcctggccaacatggtgaaacctgtctctactggggatacaaaaagtagctgggcatggtggccgcacgcctgtaatcccagctacttgggaggctgaggcaggagaatcgcttgaaccccggagcggaggttgcggtgagcggagattgcgccactgcactccg

SEQ ID NO: 12025 - DNA, 110 bp, Homo sapiens
tgtttaaaaagagaatatccaaattttctaatttttatttttgtgctacagtgaataaaataaaaaaaaaaaaaaaaaaaaaaaaaaaaaaaaaaaaaaaaaaaaaaaaa

SEQ ID NO: 12026 - DNA, 326 bp, Homo sapiens
  misc_feature 16: n=a, g, c or t
aatggtagagacaggntttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctc

SEQ ID NO: 12027 - DNA, 142 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaamcctgtctc

SEQ ID NO: 12028 - DNA, 126 bp, Homo sapiens
  misc_feature 64: n=a, g, c or t
ctttaggtgtattaagatataaggccaggctgggcatggtggctcatgcctgtaatcccagcantttgagtggctgaggtgggaggatcacttgagcccaggatttcaaggcgagcctgggacaca

SEQ ID NO: 12029 - DNA, 219 bp, Homo sapiens
cataagaatttataaacttgaaatagaaatattctattgtaaaggttaagaaaagtatacttggttggccaccgaggctcattaccataatcccagtacttcgggaggcagggtggaaggattgctcgagcccagaaggtggaggctgcagtgagccatgatcatgccactgcactccaacctgggttagagggagaccttgtctgaaaaaaaaaaaaa

SEQ ID NO: 12030 - DNA, 294 bp, Homo sapiens
  misc_feature 16: n=a, g, c or t
aatggtagagacaggntttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtgggcggttgcagtgagcccagatcacgcaaatgtcactgtac

SEQ ID NO: 12031 - DNA, 355 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccagaaa

SEQ ID NO: 12032 - DNA, 335 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccaaaaaaaaaaaaaaaa

SEQ ID NO: 12033 - DNA, 315 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaag

SEQ ID NO: 12034 - DNA, 484 bp, Homo sapiens
tgaaggttatcagtttttgtgtatgtagagggcctagggtggccagtagtttggaggagtgacttaattaaataactacttacagtataccctttatataattaacaatctttcagcgtgtttaaagtaaatatttgcagtgagggaaccaaggaagactgcatgtagagtcctaagccaagacttgaagaaatataggatttaagttggtagaaaggaatgggggctgggcacggtggcttatgcctgtaatcccagcactttggggggcctaggggggcagatcacttgaggtcagaagttcaagaccagcctggccaatatggtgaamcctgtctctactaaaaatacaaaaaaatcagccggggatggtggtgcatgtctgtaattccagctactcaggaggctaaggcacgagatttgcttgaaccctggcaagaatcgcttgaacccgggaggcaaaggttgcagtgagcaagatcac

SEQ ID NO: 12035 - DNA, 187 bp, Homo sapiens
tgaatataattagtctcatttgawatttagtagctgaacatatactgtattaattaacaatactggtcaggcacgttggctcatgcctgtsatcccagcactttgggaggccggggcaggaggatcagtcaagaccgggagtttgagactaacctgggcaacagagcaagaccctgtctctacaaaa

SEQ ID NO: 12036 - DNA, 189 bp, Homo sapiens
  misc_feature 150: n=a, g, c or t
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagacnaacctgggcaacagagcaagaccctgtctctacaaaaaa

SEQ ID NO: 12037 - DNA, 77 bp, Homo sapiens
gaacacttccatggattgtccttggacttagggcgccctgccgccttttgcagaggagaaaaaactttttttttttt

SEQ ID NO: 12038 - DNA, 144 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctg

SEQ ID NO: 12039 - DNA, 292 bp, Homo sapiens
gcctaggtgttgtcgtccctgctagtactccgggctgtgggggtcggtgcggatattcagtcatgaaatcagggtagggacttctcccgcagcgacgcgctggcaagactgtttgtgttgcgggggccggacttcaaggtgattttacaacgaggtgctgctcccatctgccgccccccttctctcctgcaattggtttgtactcactgggctgtgctctcccctgtttacccgatgtatggaaataaaggcccttttcctcctgaaaaaaaaaaaaaaaaaaaaaaaaaaa

SEQ ID NO: 12040 - DNA, 220 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacggtgaamccacgtctctactaaaaaaaaaaaaawtacaaaaawtcagccgggcatgatggsgggcacctgtagtcccagctattcgggaggstgaggcgggaga

SEQ ID NO: 12041 - DNA, 294 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggsgtggtggctcatgcctgtaatctcagctactcgggaggctgagacaggagaattgcttgaacccgggaggcggaggttgcagtgacccgagatctcgccaccgcactccagcctgggcgacagagcgggactc

SEQ ID NO: 12042 - DNA, 125 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgcactc

SEQ ID NO: 12043 - DNA, 129 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatgg

SEQ ID NO: 12044 - DNA, 200 bp, Homo sapiens; identical to SEQ ID NO: 11569

SEQ ID NO: 12045 - DNA, 120 bp, Homo sapiens
ctttaggtgtattaagatataaggccaggctgggcatggtggctcatgcctgtaatcccagcactttgagtggctgaggtgggaggatcacttgagcccaggatttcaaggcgagcctgg

SEQ ID NO: 12046 - DNA, 344 bp, Homo sapiens
  misc_feature 309: n=a, g, c or t
tagattataaaatgactatgtttaataaaattttaaaaataaaagagggagagaatgggctcaaaaaaagaaataaaaggctgggcatggtggctcgcacctgtggtcccagcactttggaaggccgagacgggcggatcatgaggtcaggagatcgagaccatcctggccaaaatggtgaaacccgtcattgctaaaggtacagaaattagttgggtgtggtggcatgcacctgtagtccaggctgctcgggaggctgaggcgggagagtcgcatgaacccgggaggcagggttgcagtgagccgggntcgcgtcactgcactccagcctggatgacagagcg

SEQ ID NO: 12047 - DNA, 173 bp, Homo sapiens; identical to SEQ ID NO: 11575

SEQ ID NO: 12048 - DNA, 78 bp, Homo sapiens; identical to SEQ ID NO: 11631

SEQ ID NO: 12049 - DNA, 154 bp, Homo sapiens
tkaatataattagtctcakttgaratytagtagctgaacatatactgtattaatkaasaatactggtcaggcacgttggctcatgcctgtcatcccagcactttgggaggccggggcakgmggatcagtcaagaccgggagtttgagactaacc

SEQ ID NO: 12050 - DNA, 292 bp, Homo sapiens; identical to SEQ ID NO: 12039

SEQ ID NO: 12051 - DNA, 163 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacccgtgtctctgcaaaaaaaaaaaaaaaa

SEQ ID NO: 12052 - DNA, 166 bp, Homo sapiens; identical to SEQ ID NO: 11622

SEQ ID NO: 12053 - DNA, 145 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaaaccgtgtctctacgaaaaa

SEQ ID NO: 12054 - DNA, 263 bp, Homo sapiens
atttttggattttctttaaaaatgcacattccaggctgggcgcagtggctcacgtgtgtaatcccagtactttgggaggctgagggcggatcacaaagccaggagttcaagaccaacctgggcaatatggtgaaaccccatctctactaaaaatataaaaagttagccaggtatggtggcacaagcctgtagtcccagccacttgggaggctgaggcagaagaatcacttgaacccgggaggcggaggttgcagtgagccgag

SEQ ID NO: 12055 - DNA, 313 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaaaaaaaaa

SEQ ID NO: 12056 - DNA, 221 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttg

SEQ ID NO: 12057 - DNA, 194 bp, Homo sapiens; identical to SEQ ID NO: 11684

SEQ ID NO: 12058 - DNA, 175 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtcacaaaaaaaaaaaaaaaaag

SEQ ID NO: 12059 - DNA, 333 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcstggstaatttttgtatttttaatagagactgggtttcacsatgttggccatgctggtcttgaacttctggcctcaagtgatctgcccacctcagccttccaaagtgctgagattacagtcctgagccactgstttcggccttacagaattgttttgttttggggcattcagaagtctgacataaaaattaacttgaaaaaaa

SEQ ID NO: 12060 - DNA, 199 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaa

SEQ ID NO: 12061 - DNA, 287 bp, Homo sapiens
gcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgaggtgctgctcccatctgccgccccccttctctcctgcaattggtttgtactcactgggctgtgctctcccctgtttacccgatgtatggaaataaaggcccttttcctcctgaaaaaaaaaaaaaaaaaaaaa

SEQ ID NO: 12062 - DNA, 419 bp, Homo sapiens
ttaaaataatacttagaggctgggtgaggtgctcacgcctgtaaccccagcactttgggaggccagggcgggtggatcacctgaggtcaggagttcaagaccagcctgaccagcatggtgaaaccccgtctttactaaaagtaccgagattaggccaggcgtggtgggtcacgcctgtaatctcagcactttcggaggccgaggtgggcggatcatctgaggtcaggagttcgagaccatcctgaccggcatggcggaaccctgcctctactaaaaatacaaaaaaaattagtccgttgtggtggcagatgcctgtagtcccggctactcgggaagctaaggcaggagaatcgctkgaaccgaggaggcggaggttgcagtgagccgaaatcacgccactacactccagcctgggcgac

SEQ ID NO: 12063 - DNA, 447 bp, Homo sapiens
aaattgtaattaatatgcattgtatgccagtaatacctgcccccaaaccctataaatcattaatagaatttttattactctattttaatctactaattagcccatgttttccataatatttttgttcaaccctggggagaaaggataaatagtaaaattcttggcaaattttcaaatatgtaattgtgacatacaatagatagcattgattttccgctccaaaaaatgagttctgctgctttataattttgaatgcatctagaaacaagaaatttcttttgagggcttaaagtgaactctagatgaatacagaaaaaattttttctattggaatcaagtatcttaaacgtggcgatcatacaaccttcttctaaggtaacacttaagagcgttttgggagattttggtgctagctctatgactaggtttagaaargtcaaataagct

SEQ ID NO: 12064 - DNA, 306 bp, Homo sapiens
cacgagactccatctttaaaaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcggasttgcagcgagccgagatcgtgccgctgcactccagcctgggcgacagagtgagactccatctcaaaaaaaaaaaaaaaaa

SEQ ID NO: 12065 - DNA, 200 bp, Homo sapiens; identical to SEQ ID NO: 11569

SEQ ID NO: 12066 - DNA, 117 bp, Homo sapiens
ctttaggtgtattaagatataaggccaggctgggcatggtggctcatgcctgtaatcccagcactttgagtggctgaggtgggaggatcacttgagcccaggatttcaaggcgagcc

SEQ ID NO: 12067 - DNA, 383 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaacccaaaaaaaaaaaaaaaaa

SEQ ID NO: 12068 - DNA, 173 bp, Homo sapiens; identical to SEQ ID NO: 11575

SEQ ID NO: 12069 - DNA, 114 bp, Homo sapiens
ctttaggtgtattaagatataaggccaggctgggcatggtggctcatgctgtaatcccagcactttgagtggctgaggtgggaggatcacttgagcccaggatttcaacggcga

SEQ ID NO: 12070 - DNA, 161 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgcaaaaaaaaaaaaaaaaa

SEQ ID NO: 12071 - DNA, 452 bp, Homo sapiens
acggctcttctcccggtccctgaaactcggctgccaggggagctggagccacctgcgaaggtgtcctcccatactggacccctacaggaagctccgtgtgcccagctggggcacagccccagtgatgccccagaggggcacccatcgcaagaggggctttgggctctgcctccctccccatggcgcatgggccaaagcctgagactgaaggactgttggacctcagcttcctaacagaggaggagcaggaggccattgctggcgtcctccaacgagatgcccgcctgcgccactggaggaggggcgggtcagcaagctccgggcctcagtggcagaccctgggcagctgaagatcctgacaggggactggttccaggaagcacgctcccagcggcaccacaatgcccacttcggctctgaccttgtycgagcgtctatgcgcaggaagaaga

SEQ ID NO: 12072 - DNA, 412 bp, Homo sapiens
agcccggcgttcccggccgggagcgacccggagtccccagccccgcgtcccagctgccgccagcgccagttttggattcggcggattaggaaagaggagggaggggggagagagcgcgaagagggaggggaccgaagctggagggtcccgagtccagcgccgtgttggcgtagagaaactttccctctcggcctcggagacggcgccccggccgtgccgaagtggagatcgccaggctcggaggaaccggcagctctccacgcccctgcccgaagcctgacccgactgcctctctcagtgagttatttatgattccatctgatatacataggagagaaactgatagaagaattctgatggcactgtatgatagaagctataaagtcaagtgtccattttctttcaactatat

SEQ ID NO: 12073 - DNA, 174 bp, Homo sapiens; identical to SEQ ID NO: 11671

SEQ ID NO: 12074 - DNA, 164 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaaccctgtctctgcaaaaaaaaaaaaaaaaaa

SEQ ID NO: 12075 - DNA, 163 bp, Homo sapiens; identical to SEQ ID NO: 11668

SEQ ID NO: 12076 - DNA, 170 bp, Homo sapiens; identical to SEQ ID NO: 11644

SEQ ID NO: 12077 - DNA, 240 bp, Homo sapiens
  misc_feature 224: n=a, g, c or t
gactgacaactmacacggctgggtactcttctgagacaaaacttccagaggagcgatcaggcagcaacatttgctgttcaccaatatcsattgttctgcagcctctgctgctgatacccaggcaaacagggtctggagtggacctccaaactccaacccacctgcagctgagggtcctgactgttagaaggaaaactacaaaacagaaaggacatccacaccanaaccccatctgtacat

SEQ ID NO: 12078 - DNA, 225 bp, Homo sapiens; identical to SEQ ID NO: 11617

SEQ ID NO: 12079 - DNA, 106 bp, Homo sapiens
gtcagacaataaagtctttgtaaaaagagaaaaaaaaaaaaaaaaaaaaaaaaaaaaaaaaaaaaaaaaaaaaaaaaaaaaasscytycccccccccccccccccc

SEQ ID NO: 12080 - DNA, 111 bp, Homo sapiens; identical to SEQ ID NO: 11571

SEQ ID NO: 12081 - DNA, 317 bp, Homo sapiens
  misc_feature 19: n=a, g, c or t
cagataaaagtctatgtvntggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaaaaaggc

SEQ ID NO: 12082 - DNA, 490 bp, Homo sapiens
actacttacgcgccaggcgcctctttggacgccactccacagcctcgtgtgttaagaggcacacaagagctgcctgattggccaccaagctgagaaccgggagccggagaaatcatagcgaaatctcaacctgatgtagccccatcagcatcacacacaaactcakagcaaaatggcctgctcttcaatgtagcttagtttagttcaattgtcctgcccaccccctcctgaccctcctgccgctgaggggtggtatttgaaagaacaggtgagtgcttcataggtgccgggttcgtgatctaattctgggttcctcaatctattaacagcttgggaagaacagatcagaggactgatgctcacctgggtttggattcstcctttagcctttgacaagttacttaactgagtaaatcctcaattttcaccatgataaaggaaagatggtgtgtgactattatgtttttattcsggattgaaattacwtcag

SEQ ID NO: 12083 - DNA, 115 bp, Homo sapiens
ctttaggtgtattaagatataaggccaggctgggsatggtggctcatgctgtaatcccagcactttgagtggctgaggtgggaggatsacttgagssmaggatttcaaggcgagc

SEQ ID NO: 12084 - DNA, 327 bp, Homo sapiens
cttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgtttttgttttggggcattcagaagtctgacataaaaattaacttg

SEQ ID NO: 12085 - DNA, 221 bp, Homo sapiens; identical to SEQ ID NO: 11634

SEQ ID NO: 12086 - DNA, 242 bp, Homo sapiens
  misc_feature 236: n=a, g, c or t
acagagcaaaaatctgtctaaaaaaaaaaaagaagagactggcacatccatacaatggatgagccaactgttaaaaaaaaaagawtgaggggstgggcgtggtggctcacacctgtaatcccaggastttgggaggccgaggcgggcggatcatgaggtcaggagatcgaracsttcctggstaacacggtgaaaccctgtctctactaaaaatacacacacacacaaaaatttanctgggt

SEQ ID NO: 12087 - DNA, 83 bp, Homo sapiens
gtcagacaataaagtctttgtaaaaagagaaaaaaaaaaaaaaaaaaaaaaaaaaaaaaaaaaaaaaaaaaaaaaaaaaaaaa

SEQ ID NO: 12088 - DNA, 82 bp, Homo sapiens; identical to SEQ ID NO: 11689

SEQ ID NO: 12089 - DNA, 372 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaataaaaaag

SEQ ID NO: 12090 - DNA, 243 bp, Homo sapiens
atgcagcgcgcggcgatvgagttcaagaccagcctggccaacatggtgaaacctgtctctactaaaaatacaaaaattagctgggcgtggtggcgcacgctrtagatcccagctactcgggaggctgaagcagaagaattgcttgaacctgggaggcagaggttgcagtgagctgagatcaatgccactgcactctagcctgggtgacagagtgagactgcgtctaagaaaaaaaaaaaaaaa

SEQ ID NO: 12091 - DNA, 488 bp, Homo sapiens
attgggtttggggaagagaaaatcacttggcggcttccggatgaaatattcatctgttccccgaccccagccacttcctggagaagaacagtgagggggctccggcatcaggtctctctcgggtttgggcctttttagacgcaggtacagcggaagtttgtgaatgaagatctgcagagtagaagaggcgtattggtgggggctttcatgctttcagaccagaagggaaacagccaaccaccccactccacatgcccattcccgcgcgtgagtatgtgcgtgcatattcttccacaaacgagctacacaaggaaatgcagccacacagacctaagagctctttagtgggttgggcctgtcgcggtggctcacgcctgtaatcgcagcactttgggaggccaaggcaggtggatcacctgaggtcaggagttcaagaccagcctggcccaacatggtgaaacctctctctactaaaaatacaaaaattt

SEQ ID NO: 12092 - DNA, 124 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacac

SEQ ID NO: 12093 - DNA, 195 bp, Homo sapiens; identical to SEQ ID NO: 11632

SEQ ID NO: 12094 - DNA, 143 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtt

SEQ ID NO: 12095 - DNA, 200 bp, Homo sapiens; identical to SEQ ID NO: 11569

SEQ ID NO: 12096 - DNA, 368 bp, Homo sapiens
tagcttttaaacaaatttctttctaaacacaataaaaggagaaatttaattgttttgcttaagataaaaacctaagtaggctgggcgcggtggctcacgcctgtaatcccagcactttgggaggctgaggtgggtggataaggaggtcaggaggtcgagatcatcctggccaacatggtgaaaccccatggctactaaaaatacaaaaattagccagtgtagtggcgcgcacccgtagtcccagttactcaggagggtgaggcaggagaatcgcttgaacccaggaggtggaggttacagtgagctgacacagcaccgttgcagcttgggcgacagagcaagactcggtcttcaaaaaaaaaaaaaaa

SEQ ID NO: 12097 - DNA, 325 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaaaaaaaaaaaaa

SEQ ID NO: 12098 - DNA, 170 bp, Homo sapiens; identical to SEQ ID NO: 11644

SEQ ID NO: 12099 - DNA, 84 bp, Homo sapiens
aaaaaaaaaaaactacgaytacgggagctactccgggaacacacagggtggcacaaktacacaktagcsaktgtgacccagagg

SEQ ID NO: 12100 - DNA, 472 bp, Homo sapiens
attaacattttggtcaaagccattcaacaakwstcgaggaagttccaaactttcccacattttcctatcctcttctgagccttccaaactgttccagcctctccctgttacccatttccaaagttgcttccacattttcgggtatctttacagcagcaccccactctactggtatcaacttattgtattagtctgttctcacactgcaaataaagacatacctgagactgggtaatttataaaggaaagaggttgaattgactcacagttctgcatggctggggaggcctcacaatcatggtggaaggcaaggaggtgcaaaagcatgtctcacatagtggcaggcatgagagagcatgtgcaggggagctcccatttataaaaccatcagatctcatgagacttagtcactaccgcgagaacagtatggggggaacatcccmatgattcagttatctgcacccgggcccac

SEQ ID NO: 12101 - DNA, 379 bp, Homo sapiens
ccattagcctttccattttttttttcagttaataagaaacaatactgatagcaaaacttgsattgtgtgtgtgtgtgtgtgtgtgtgtgtattttttttgagacagagtcttgctctgtcactcatgckggagtssggtggcatgatcttggcttgctgsaacctccgcctcctgggttcaagctattcttatgcctcagcctccctagctgggactacaggtgcatgcctataatctcagctgcttgggaggctgaggcaggagaactgcttgaacctgggaagtgaaggatacggtgagccaagatcacaccgctgcactccagcctgggcaacaagagcaaaactctgtctcaaaaaataaataaataaaaattaa

SEQ ID NO: 12102 - DNA, 66 bp, Homo sapiens
gtcagacaataaagtctttgtaaaaagagaaaaataaaaaaaaaaaaaaaaaaaaaaaaaaaaaaa

SEQ ID NO: 12103 - DNA, 82 bp, Homo sapiens; identical to SEQ ID NO: 11689

SEQ ID NO: 12104 - DNA, 200 bp, Homo sapiens; identical to SEQ ID NO: 11569

SEQ ID NO: 12105 - DNA, 331 bp, Homo sapiens
aatggtagagacaggktttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctcaaaaa

SEQ ID NO: 12106 - DNA, 74 bp, Homo sapiens
ctaaaaattagccaggcctggtggcaggtgactgtaatgccagctactcgggaggctgaggtaagagaattgct

SEQ ID NO: 12107 - DNA, 173 bp, Homo sapiens; identical to SEQ ID NO: 11575

SEQ ID NO: 12108 - DNA, 53 bp, Homo sapiens
ctaaaaattagccaggcctggtggcaggtgactgtaatgccagctactcggga

SEQ ID NO: 12109 - DNA, 201 bp, Homo sapiens
tgaatataattagtctcatttgakatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaaaa

SEQ ID NO: 12110 - DNA, 251 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcmtgtaatctcagctactcgggaggctgagacaggagaattgcttgaacccgggagccggaggttgcagtgacccg

SEQ ID NO: 12111 - DNA, 115 bp, Homo sapiens
ctttaggtgtattaagatataaggccaggctgggcatggtggctcatgcctgtaatcccagcactttgagtggctgaggtgggaggatcacttgagcccaggatttcaatggcga

SEQ ID NO: 12112 - DNA, 478 bp, Homo sapiens
aagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgacatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatstaaagtaata

SEQ ID NO: 12113 - DNA, 304 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtgaaacttcgtctccaaaaaaaaaaaa

SEQ ID NO: 12114 - DNA, 244 bp, Homo sapiens
ccgaggtgggtgtatcacctgaggtcaggagtttgagaccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcaaaaaaaa

SEQ ID NO: 12115 - DNA, 301 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcscagatacttgggaagctgaggtaggaagatcgcttgggcccaggagatgtaggttgcagtgagttgttatcacaccactgcactcctgcctgggtgacagagcaagagcctgtcgccaaaaaaa

SEQ ID NO: 12116 - DNA, 112 bp, Homo sapiens; identical to SEQ ID NO: 11643

SEQ ID NO: 12117 - DNA, 200 bp, Homo sapiens; identical to SEQ ID NO: 11569

SEQ ID NO: 12118 - DNA, 109 bp, Homo sapiens
ctttaggtgtattaagatataaggccaggctgggcatggtggctcatgctgtaatcccagcactttgagtggctgaggtgggaggatcacttgagcccaggatttcaag

SEQ ID NO: 12119 - DNA, 108 bp, Homo sapiens; identical to SEQ ID NO: 11990

SEQ ID NO: 12120 - DNA, 424 bp, Homo sapiens
  misc_feature 265: n=a, g, c or t
ttactttatagggtcttgtgaaaataaagcattagcatggtgcctagcatacaataaatataattattbtattatcaataatataaacatggagggcgattattagctcatttgctcctcaaaggtatgtaactcaataaagatgcattctcttctaatattaagtttccattgttaatacagaaatcgtccaggtgtggtggttcatgccagtaatctcagcacttgggaggctgaagtaggtagagagagcagttcaattttnttttctccctgcaggtgctgctgtcaagcttgaatgaaaggtatctcatgggtgggcgcgtggctcatgcctgcaatcccagcacttcgggaggccaagacaggcagatcgcttgagctcaggagtttgagaccagcctggacaaaaccccatccctgt

SEQ ID NO: 12121 - DNA, 159 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtcacaa

SEQ ID NO: 12122 - DNA, 324 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaaaaaaaaaaaaa

SEQ ID NO: 12123 - DNA, 376 bp, Homo sapiens
taactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgamstcattcccttacccccggcsagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgaa

SEQ ID NO: 12124 - DNA, 324 bp, Homo sapiens; identical to SEQ ID NO: 12122

SEQ ID NO: 12125 - DNA, 153 bp, Homo sapiens
taaatatattaaatatgtgtattatattaaatacagtattaaaaaaaaaagattgaggtggccaggcgcagtggttcatgtgtgtaatctaagcactttgggaggccgaggcagatggatcatttgaggtcaggaatttcagaccagcctgkc

SEQ ID NO: 12126 - DNA, 337 bp, Homo sapiens
ataatacataagatatggtattgtgtgcctgggctcttagacctagcatagtattttcaaggttaatgtgtagcatgagtcactacttcattcctttctgtgtctgagtaasattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcamgaccagcttgggcaacagtgcaagaccctgtatctaccca

SEQ ID NO: 12127 - DNA, 82 bp, Homo sapiens; identical to SEQ ID NO: 11689

SEQ ID NO: 12128 - DNA, 200 bp, Homo sapiens; identical to SEQ ID NO: 11569

SEQ ID NO: 12129 - DNA, 164 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctgtctctgcaaaaaaaaaaaaaaaaaag

SEQ ID NO: 12130 - DNA, 77 bp, Homo sapiens; identical to SEQ ID NO: 12037

SEQ ID NO: 12131 - DNA, 82 bp, Homo sapiens; identical to SEQ ID NO: 11689

SEQ ID NO: 12132 - DNA, 200 bp, Homo sapiens; identical to SEQ ID NO: 11569

SEQ ID NO: 12133 - DNA, 113 bp, Homo sapiens
ctttaggtgtattaagatataaggccaggctgggcatggtggctcatgctgtaatcccagcactttgagtggctgaggtgggaggatcacttgagcccaggatttcaaggcga

SEQ ID NO: 12134 - DNA, 205 bp, Homo sapiens
gaagagcggcggcggcggcggcggcggtggcggaggcggacacattggcgtgagacctgggagtacgttgtgccaaatcattgccacttgccacatgagtgtaaatgatggcggatgcaagtatgtcctctgccgatgggaaaagcgattatggcctgcgaaggttttggcccgaaccgcgacttcaacaaaaaaaaaaaaaaaa

SEQ ID NO: 12135 - DNA, 52 bp, Homo sapiens
ctttakgtgtattaagatataatgmcacgctsggcatggtggctcatgccts

SEQ ID NO: 12136 - DNA, 200 bp, Homo sapiens; identical to SEQ ID NO: 11569

SEQ ID NO: 12137 - DNA, 82 bp, Homo sapiens; identical to SEQ ID NO: 11689

SEQ ID NO: 12138 - DNA, 321 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccaa

SEQ ID NO: 12139 - DNA, 56 bp, Homo sapiens
aaaaaaaaaaaaaaaaaaaaaaaaaaaaaaaaaaaaaaaaaaaaaaaaaaaaaaaa

SEQ ID NO: 12140 - DNA, 104 bp, Homo sapiens
ctttaggtgtattaagatataaggccaggctgggcatggtggctcatgctgtaatcccagcactttgagtggctgaggtgggaggatcacttgagcccaggatt

SEQ ID NO: 12141 - DNA, 200 bp, Homo sapiens; identical to SEQ ID NO: 11569

SEQ ID NO: 12142 - DNA, 420 bp, Homo sapiens
gagacagagtcttgctctgtcgcccaggctgcagtgcggtggtgcaatctcggttcactgcaacctccgactcccaggctcaagcgattcttatgcctcagcctcccgagtggctgggattatgggcctgtgccaccattcatgggtagtttttctatttttagcagggacaggatttcgccatgtttgccaggctggtcttgaactcctgaccttaagtgatctgcctgcctgggcctcccaaagtgctgggattacaggcatgagccactgtgccaggcctattttattttatttatttatttttgagacaagatctcactctgttgctcaggctggagtgtagtggtgcgatcacagctcactgcagcctcaaatgcctgggctacaagagcaaaactccgtctcaaaaaaataaaa

SEQ ID NO: 12143 - DNA, 136 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagacc

SEQ ID NO: 12144 - DNA, 108 bp, Homo sapiens
ttaggcccaagaattacctgaacctgggacgtggaggttgcggtgagccaagatcgcaccactgtaccctagcctgggcaacagagtgactcttaaaaaaaaaaaaaa

SEQ ID NO: 12145 - DNA, 458 bp, Homo sapiens
  misc_feature 372: n=a, g, c or t
tcgcggccagaggcttacaggtccaggtggagaggccgggctggcagggcttcggcctccggcgtcgggaaatggcggcggggggcaggatggaggacttgagaaaatggaaaattaactgtaagacctggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattnaaagttcakacggttataatccttgggaaakttatttkgtggattctccatttactccttgaatgctacatccagtatcaccacag

SEQ ID NO: 12146 - DNA, 459 bp, Homo sapiens
  misc_feature 368..369,396,408,411,415,420,423: n=a, g, c or t
actgtggctcatgccctaatcccagcacttttgggaggtcaaggtgagcagaacacctgaggacaggagtttgagaccagcctgcccaacgtggtgaaacccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactctatagnnccccccactgagctgtggatgggcaanccccggtggatnccnsccnccccnacnccccactgagccctgggccccctcctcccttcctca

SEQ ID NO: 12147 - DNA, 373 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcmsagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaaagg

SEQ ID NO: 12148 - DNA, 171 bp, Homo sapiens
ctaaaaattagcsaggsctggtggcakgtgactgtaatgccagctactcgggaggctgaggtaagagaattgcttkaacctgggtggaagaagttgcagtgagccaagattgtgccactgcactcctgcctgggtgatakagtgacactccttctcaaaaaaaaaaaaaaa

SEQ ID NO: 12149 - DNA, 289 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagac

SEQ ID NO: 12150 - DNA, 57 bp, Homo sapiens
aaaaataaaaaaaaaaaaaaaaaaaaaaaaaaaaaaaaaaaaaaaaaaaaaaaaaaa

SEQ ID NO: 12151 - DNA, 173 bp, Homo sapiens; identical to SEQ ID NO: 11713

SEQ ID NO: 12152 - DNA, 207 bp, Homo sapiens; identical to SEQ ID NO: 11904

SEQ ID NO: 12153 - DNA, 284 bp, Homo sapiens
cacgagactccatctttaaaaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcggasttgcagcgagccgagatcgtgccgctgcactccagcctgggcgacagagtgagactcc

SEQ ID NO: 12154 - DNA, 225 bp, Homo sapiens; identical to SEQ ID NO: 11617

SEQ ID NO: 12155 - DNA, 162 bp, Homo sapiens
  misc_feature 137: n=a, g, c or t
ctttaggtgtattaagatataaggccaggctgggcatggtggctcatgctgtaatcccagcactttgagtggctgaggtgggaggatcacttgagcccaggatttcaaggcgagcctgggacacatggtgaaacctngtctctgcaaaaaaaaaaaaaaaaa

SEQ ID NO: 12156 - DNA, 200 bp, Homo sapiens; identical to SEQ ID NO: 11569

SEQ ID NO: 12157 - DNA, 156 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaatatggtgaaacgtgtctctacgaaaaaaaaaaaaaaaaa

SEQ ID NO: 12158 - DNA, 200 bp, Homo sapiens; identical to SEQ ID NO: 11569

SEQ ID NO: 12159 - DNA, 307 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatttctactaaaaacacagaagttacctgggtgtggckacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaa

SEQ ID NO: 12160 - DNA, 98 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12161 - DNA, 91 bp, Homo sapiens
gtcagacaataaagtctttgtaaaaagagaaaaaaaaaaaaaaaaaaaaaaaaaaaaaaaaaaaaaaaaaaaaaaaaaaaaaawttttttt

SEQ ID NO: 12162 - DNA, 120 bp, Homo sapiens; identical to SEQ ID NO: 11842

SEQ ID NO: 12163 - DNA, 257 bp, Homo sapiens
tatattgtttcccaagaagttctacttggtttcatttcaaacctgcctggtttttttgtttgtttgtttttatttttgttttgagacgaagttggggtttcactcttgttgcccgggctggagtgcaatggcgtgatctcagctcactgcaacctccaccacctgggttcaagcaattctcctgcctcagcctcctgaggtcaggagtttaagaccagcctgacgaacatggagaatctccgtctctaataaatatr

SEQ ID NO: 12164 - DNA, 66 bp, Homo sapiens
aattgtgttcgcagccgccgccgcgccgccgtcgctctccaacgccagcgccgcctctcgctcgcc

SEQ ID NO: 12165 - DNA, 50 bp, Homo sapiens
ttggagttttgctctagagaactagtctcgagtttttttttttttttttt

SEQ ID NO: 12166 - DNA, 477 bp, Homo sapiens
ggagtaggattttaccgctggttctacctaggcgtagagctgtatctgcaaacaaccaggcaagaccgaaaaaagttaatgttcttaaaatatgcaagtggagcccgaaaatagttaaattcttggactaggaaggcatccttaaatgctcaagtctctggggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatcc

SEQ ID NO: 12167 - DNA, 118 bp, Homo sapiens
ctaaaaattagccaggcctggtggcaggtgactgtaatgccagctactcgggaggctgaggtaagagaattgcttgaacctgggtggaagaagttgcagtgagccaagattgtgccac

SEQ ID NO: 12168 - DNA, 383 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcctccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaaaaaag

SEQ ID NO: 12169 - DNA, 312 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctcaaaaaaaaaaaaaaaaag

SEQ ID NO: 12170 - DNA, 371 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcmsagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaaa

SEQ ID NO: 12171 - DNA, 172 bp, Homo sapiens; identical to SEQ ID NO: 11573

SEQ ID NO: 12172 - DNA, 175 bp, Homo sapiens
tacaaaaaattagctgggcgtggtggcaggcgcctgtggtcccagctactcgggaggctgaggcaggagaatagtgtgaacccaggaggcggasttgcagtgagccaagatagtgccactgcacttcagcctgggtgacagagtgagactctgtcacaaaaaaaaaaaaaaaaaa

SEQ ID NO: 12173 - DNA, 125 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacaca

SEQ ID NO: 12174 - DNA, 127 bp, Homo sapiens
  misc_feature 78: n=a, g, c or t
gttaaatattgtctaatcaggccgggcgcggtggctcacgtctgtggtcccggcactttgggagcctgaggcaggcgnatcatgaggtcaggagatcaagaccatcgtggcttacacggtgaaacca

SEQ ID NO: 12175 - DNA, 83 bp, Homo sapiens; identical to SEQ ID NO: 12087

SEQ ID NO: 12176 - DNA, 371 bp, Homo sapiens; identical to SEQ ID NO: 12170

SEQ ID NO: 12177 - DNA, 520 bp, Homo sapiens
tgattgctattaactctgacggttctgagtttactacagtggaattcattagtatgtgttatgtaagaatgaagagggaaagaacacgaagacatctttgtcttttctctttccctgaactcagttaattctgcctatttggtctgaaaagctctaataacaatgaaggcctggcagtaacttacaggatttcttttatacaaaaaagagaaaagaaaattaccaagtatttaaagacatggaaacttggaggactttcttgttcctaagtggtgactctaactggatgttcaggatggagtggttgctgaccctttgaacacagctattgtgctgggttaatattgtatttccgtctatagtttatcattcagggtgctgatctaaaacaaagcatccggtttatccagctagtccagaacatatccacttagcaacaaaaatacggataacgatttccttgcgcttgaattgctatggtttttttgttgttgtctagtggaatttcgttgtctcgtgg

SEQ ID NO: 12178 - DNA, 323 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaaaaaaaaaaaa

SEQ ID NO: 12179 - DNA, 163 bp, Homo sapiens
  misc_feature 137: n=a, g, c or t
ctttaggtgtattaagatataaggccaggctgggcatggtggctcatgctgtaatcccagcactttgagtggctgaggtgggaggatcacttgagcccaggatttcaaggcgagcctgggaacacatggtgaaaccntgtctctgcaaaaaaaaaaaaaaaaa

SEQ ID NO: 12180 - DNA, 58 bp, Homo sapiens
aaagaagaaaagatatataggkkgctcacgcctgtaatcccaaagtgctgggattaca

SEQ ID NO: 12181 - DNA, 159 bp, Homo sapiens
tacaaaaaattagctgggcgtggtggctggcgcctgtggtcccagctactcgggaggctgaggcaggagaatagtgtgaacccaggaggcggasttgcagtgagccaagatagtgccactgcacttcagcctgggtgacagagtgagactctgtcacaa

SEQ ID NO: 12182 - DNA, 160 bp, Homo sapiens
tattttcagtagggacggggttacaccatgttggccaggctggtctcgaactcctgacctcaagtgatccacccgcctcagtctcccaaagtgctgagattacaggcatgagtcactacgcccggccccatgtctggtttgtcttggatgtgtgagcagc

SEQ ID NO: 12183 - DNA, 317 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaaa

SEQ ID NO: 12184 - DNA, 336 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagc

SEQ ID NO: 12185 - DNA, 111 bp, Homo sapiens
gtagtgactcatctcgggcagagcgctagggctccgagcgaaccagcgagcgagcgaacgagcgastcagccggggacccacggcccaatcaaaaaaaaaaaaaaaaaakt

SEQ ID NO: 12186 - DNA, 304 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagactccatctcaaaaaaaaaaaaaaaaa

SEQ ID NO: 12187 - DNA, 157 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaaaccgtgtctctacgaaaaaaaaaaaaaaaaa

SEQ ID NO: 12188 - DNA, 304 bp, Homo sapiens; identical to SEQ ID NO: 12186

SEQ ID NO: 12189 - DNA, 161 bp, Homo sapiens
ctttaggtgtattaagatataaggctaggctgggcatggtggctcatgctgtaatcccagcactttgagtggctgaggtgggaggatcacttgagcccaggatttcaaggcgagcctgggacacatggtgaaacctgtctctgcaaaaaaaaaaaaaaaaa

SEQ ID NO: 12190 - DNA, 301 bp, Homo sapiens
gatagattaaaaattttctgggctgggcgcggtggctcatgcggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctca

SEQ ID NO: 12191 - DNA, 383 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaaaaaag

SEQ ID NO: 12192 - DNA, 372 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcmsagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaaag

SEQ ID NO: 12193 - DNA, 211 bp, Homo sapiens
  misc_feature 154: n=a, g, c or t
acattttcagattagggatgctcaacctgtataataataggatgacgaaaatgagaagtactacacaaatgatagttttttattacatatattgataccaaatgcccctacatgggaacagtgtacctctttcagttttttatttctcacaggngccaacatagttctgaacacatagtcagcccttgacatattaataaatatatggctc

SEQ ID NO: 12194 - DNA, 114 bp, Homo sapiens
ctaaaaattagccaggcctggtggcaggtgactgtaatgccagctactcgggaggctgaggtaagagaattgcttgaacctgggtggaagaagttgcagtgagccaagattgtg

SEQ ID NO: 12195 - DNA, 83 bp, Homo sapiens
gtcagacaataaagtctttgtaaaaagagaaaaaaaaaaaaaaaaaaaaaaaaaaaaaaaaaaaaaaaaaaaaaaaaaaaaar

SEQ ID NO: 12196 - DNA, 129 bp, Homo sapiens
ctttaggtgtattaagatataaggccaggctgggcatggtggctcatgctgtaatcccagcactttgagtggctgaggtgggaggatcacttgagcccaggatttcaaggcgagcctggtacacatggt

SEQ ID NO: 12197 - DNA, 443 bp, Homo sapiens
ctctgaggtgagggcgaggggcgcgggccggtgtgggccgcagagacgttggagccggcgggggctggggactggcctcggggcgacttgaggtgtccctggccagtgtccttccacctgtccacaagcatggggaacatcttcgccaacctcttcaagggcctttttggcaaaaaaagaaatgcgcatcctcatggtgggcctggatgctgcagggaagaccacgatcctctacaagcttaagctgggtgagatcgtgaccaccattcccaccatagkttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtga

SEQ ID NO: 12198 - DNA, 81 bp, Homo sapiens
gtcagacaataaagtctttgtaaaaagagaaaaaaaaaaaaaaaaaaaaaaaaaaaaaaaaaaaaaaaaaaaaaaaaaaaa

SEQ ID NO: 12199 - DNA, 173 bp, Homo sapiens; identical to SEQ ID NO: 11575

SEQ ID NO: 12200 - DNA, 363 bp, Homo sapiens
  misc_feature 321,361: n=a, g, c or t
caaaaactagccaggcagggctgggcgcggtggctcacgcctgtaatcccagcactttgggaggccgaggcgggcggatctcgaggtcaggagattgagaccatcccggctaacacggtgaaacccgtctctactaaaaatacaaaaaaaattagctgggcgtggtggcaggtgcctgtggtcccagctactcgggaggctgaggcagaagaatggcgtgaacttgggaggtggagcttacagtgagccgagatcacaccactgcactccagcctgggggacagagcgagactccgtctcaaaaaaaaaaaaaaaaayytncccaggcggscwtggtggtggcgcccwtctgwagtcccanct

SEQ ID NO: 12201 - DNA, 200 bp, Homo sapiens; identical to SEQ ID NO: 11569

SEQ ID NO: 12202 - DNA, 294 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgt

SEQ ID NO: 12203 - DNA, 360 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaa

SEQ ID NO: 12204 - DNA, 118 bp, Homo sapiens; identical to SEQ ID NO: 11692

SEQ ID NO: 12205 - DNA, 172 bp, Homo sapiens; identical to SEQ ID NO: 11573

SEQ ID NO: 12206 - DNA, 236 bp, Homo sapiens
attaagatcagcctgggtaatacagtgagaccccatctctagaaaaaataaaaaattagtcaaatgtggtgttagtcccagctacgtgggggactagtagtcccagctacttgggagggggagatgggaggattgcttgagcctgggaagcgaaggttgcagtaagatgagatcgtgccgctgcactccagcctgggtgacagagtgagactctgtctcttaggaaaaaaaaaaaa

SEQ ID NO: 12207 - DNA, 311 bp, Homo sapiens
  misc_feature 309: n=a, g, c or t
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtgaaacttcgtctccaaaaaaaaaaaaaaaangy

SEQ ID NO: 12208 - DNA, 500 bp, Homo sapiens
gacctgggctgcagttaggttgtcgcctgcaggaggtgtgctgttgagggagaggaaaaccgtccgaggagaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcagaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggc

SEQ ID NO: 12209 - DNA, 439 bp, Homo sapiens
ttatgaatcctgatcttattatgctaagaggacactgctccctccctgctcagagtcatatgacaaagacttcgcatgtcagtacccgcagtgaagggggctaggccaactggctcctgtacatgcgtgcgtgcgtgtgtgtgtgtgtccctggctacagaaggggcagagggcaatcttgggggcagagggcaatcttgtttgaccgggccacatttattaagtacttaggactgtgtctagcacataataagtgctcaataaacggagatgccatgatcatttgtagctagttacatacccaatatccattcttcctatttttttccttaataacagattcagatcgtgctgcctggaatgaagacatttcccagtctctcttgcattttggtgtggccccgtgactacactatgttccatggactgtagcagtgaa

SEQ ID NO: 12210 - DNA, 163 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaaccctgtctcatgcaaaaaaaaaaaaaaaaa

SEQ ID NO: 12211 - DNA, 209 bp, Homo sapiens; identical to SEQ ID NO: 11886

SEQ ID NO: 12212 - DNA, 155 bp, Homo sapiens
tacaaaaaattagctgggcgtggtggcaggsgcctgtggtsscagctactcgggaggstgaggcaggagaatagtgtgaacccaggaggcggamttgcagtgagccaagatagtgscactgcacttcagsstgggtgacagagtgagactctgtc

SEQ ID NO: 12213 - DNA, 243 bp, Homo sapiens
atgcagcgcgcggcgatggagttcaagaccagcctggccaacatggtgaaacctgtctctactaaaaatacaaaaattagctgggcgtggtggcgcacgctgtagtcccagctactcgggaggctgaagcagaagaattgcttgaacctgggaggcagaggttgcagtgagctgagatcatgccactgcactctagcctgggtgacagagtgagactgcgtctaagaaaaaaaaaaaaaaaaa

SEQ ID NO: 12214 - DNA, 128 bp, Homo sapiens
ttaggcccaagaattacctgaacctgggacgtggaggttgcggtgagccaagatcgcaccactgtaccctagcctgggcaacagagtgactcttaaaaaaaaaaaaaaaaasaaaaaaaaaaaaaaaa

SEQ ID NO: 12215 - DNA, 508 bp, Homo sapiens
gactgacaactcacacggctgggtactcttctgagacaaaacttccagaggagcgatcaggcagcaacatttgctgttcaccaatatccattgttctgcagcctctgctgtgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaagaagttaaaaaccttgaaaaaagattagatgaaagggct

SEQ ID NO: 12216 - DNA, 94 bp, Homo sapiens
ttakgsccaagaattasctgaacctgggacgtggaggttgcggtgagccaagatcgcaccactgtascctagcctgggcaacagartgactctt

SEQ ID NO: 12217 - DNA, 163 bp, Homo sapiens; identical to SEQ ID NO: 11668

SEQ ID NO: 12218 - DNA, 440 bp, Homo sapiens
cattttatcagaaaaggtaatgaagacagacagggggagactcaaatcatttttttagactcactcatttatttgcttaacaaacatttattgaacactgagcagcattctgaatgtgtgttggctgccgagcagcraacaagaaaacctatttttgcagtgcttcagaaacatgcagttamagaggwatgcagaacaggttctcagaagagagatgaggagccattcacatggaggaggtgttgaacatttggatatgccatgctcattctgggaagtttaatgaggagacgtgggagaaaaccagaaccatcaggacattgagatgcacccactttagagaatgaaggtatgaagataagacagggaagagaagagatcagaggaaaggaatgtatcccagggtagggcactagctgaatgacagttaacacaagagg

SEQ ID NO: 12219 - DNA, 192 bp, Homo sapiens; identical to SEQ ID NO: 11795

SEQ ID NO: 12220 - DNA, 225 bp, Homo sapiens; identical to SEQ ID NO: 11617

SEQ ID NO: 12221 - DNA, 162 bp, Homo sapiens; identical to SEQ ID NO: 11739

SEQ ID NO: 12222 - DNA, 443 bp, Homo sapiens
ttaaaataatacttagaggctgggtgaggtgctcacgcctgtaaccccagcactttgggaggccagggcgggtggatcacctgaggtcaggagttcaagaccagcctgaccagcatggtgaaaccccgtctttactaaaagtaccgagattggccaggcgtggtgggtcacgcctgtaatctcagcactttcggaggccgaggtgggcggatcatctgaggtcaggagttcgagaccatcctgaccggcatggcggaaccctgcctctactaaaaatacaaaaaaaattagtccgttgtggtggcagatgcctgtagtcccggctactcgggaagctaaggcaggagaatcgcttgaaccgaggaggcggaggttgcagtgagccgaaatcacgccactacactccagcctgggcgacaagagcaaaactccgtctcaaaaaa

SEQ ID NO: 12223 - DNA, 226 bp, Homo sapiens
cataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaaaaaaaaaaaaaaaaag

SEQ ID NO: 12224 - DNA, 200 bp, Homo sapiens; identical to SEQ ID NO: 11569

SEQ ID NO: 12225 - DNA, 78 bp, Homo sapiens; identical to SEQ ID NO: 11631

SEQ ID NO: 12226 - DNA, 127 bp, Homo sapiens
ctctgtaactctatgcctgtccctctcctctttatttctgtcttactaaattatacaacagatgatatatgcatatatatatacagctgtatataaatatatatattttaaatacagatagggtctc

SEQ ID NO: 12227 - DNA, 361 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcagagtgcacgcctgtaatccctgctactcgggaggctgaaacaggagaatcacttgaacccaggagacggaggttgcggtgagttgagattatgccactgtactccagcctgggtgacagagcgagactcagtctcaaaaaa

SEQ ID NO: 12228 - DNA, 134 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaa

SEQ ID NO: 12229 - DNA, 176 bp, Homo sapiens
tatatacattagctgggcatggtggtgcatgcctgtagtcgcagctgctcgggaggctgaggcaggagaatcgcttgaatctgggaggcggaggttgcagtgagccgagatcacatgacagcactccagcctgggtgacagacagagaccccatctcaaaaaaaaaaaaaaaaaag

SEQ ID NO: 12230 - DNA, 79 bp, Homo sapiens
ctttttcgcaacgggtttgccgccagaacacaggtgtcgtgaaaactacccctaaaagccaaaaaaaaaaaaaaaaarg

SEQ ID NO: 12231 - DNA, 63 bp, Homo sapiens
aaaaataaaaaaaaaaaaaaaaaaaaaaaaaaaaaaaaaaaaaaaaaaaaaaaaaaawttttt

SEQ ID NO: 12232 - DNA, 457 bp, Homo sapiens
gcgggcagatcatgaggtaaggagatcgagaccatcctggctaagacggtgaaacctgtctctactaaaaacacaaaaaattagctgggtgtggtggcagtcgcctgtggtcccagctactcgggaggctgaggcaggagaatggcgggaacctgggaggtggagcttgcagtgagccaaaatcacgccactgcactccagcctgggtgacagagtgagactctgtcccagaaaaaaaaaattgtggaacactttctgctgctcagtatgatgtgaaatctcaacaagcaaaaagattggctaggctgggagcagtggctcaggcctgtaatcccagcactttgggaggccaaggtgggtagattgcttcagctcaggagctctagaacagcctgggcaacatggcaaaacccagtctctaaaaaaatacaaaaattagttgggcgtggtggcacat

SEQ ID NO: 12233 - DNA, 172 bp, Homo sapiens; identical to SEQ ID NO: 11573

SEQ ID NO: 12234 - DNA, 343 bp, Homo sapiens; identical to SEQ ID NO: 11941

SEQ ID NO: 12235 - DNA, 174 bp, Homo sapiens
tacaaaaaattagctgggcgtggtggcaggcgcctgtggtcccagctactcgggaggctgaggcaggagaatagtgtgaacccaggaggcggasttgctgtgagccaagatagtgccactgcacttcagcctgggtgacagagtgagactctgtcacaaaaaaaaaaaaaaaaa

SEQ ID NO: 12236 - DNA, 313 bp, Homo sapiens; identical to SEQ ID NO: 12055

SEQ ID NO: 12237 - DNA, 383 bp, Homo sapiens; identical to SEQ ID NO: 12067

SEQ ID NO: 12238 - DNA, 380 bp, Homo sapiens
tttaaaaaataaataagtaaataaaattgagcctcattttttaacctaattgaaaatgggtgataaaaatgtatacattgcgaccaggtgcggtggctcacacttgtaatcccagcactttgggaggccaaggcaggtggatcacctgaggtcaggagttcaagaccagcctggccaacatggtgaaacttcgtctctattaaaaatacaaaaatcagccaagtgtggtggcacatgcctgtagtcccagctacccgggaggctgaggcaggagaatcgcttgaacttgggatgctgcagttgcagtgagctgagatcgcaccattgcactcctgcctgggtgacagagcaagactctgtctcaaaaaaaaaaaaaaaaa

SEQ ID NO: 12239 - DNA, 485 bp, Homo sapiens
ttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgtttttkgttttkgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctc

SEQ ID NO: 12240 - DNA, 176 bp, Homo sapiens
tatatacattagctgggcatrgtggtgcatgcctgtagtcgcagstgctcgggaggctkaggcaggagaatcgcttgaatctgggaggcggaggttgcagtgagccgagatcacatgacagcactccagcctgggtgacagacagagaccccatctcaaaaaaaaaaaaaaaaaag

SEQ ID NO: 12241 - DNA, 372 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaacccaaaaaa

SEQ ID NO: 12242 - DNA, 171 bp, Homo sapiens; identical to SEQ ID NO: 11926

SEQ ID NO: 12243 - DNA, 163 bp, Homo sapiens
ctttaggtgtattaagatataaggccaggctgggcatggtggctcatgcctgtaatcccagcactttgagtggctgaggtrggaggatcacttgagcccaggatttcaaggcgagcctgggacacatggtgaaaccctgtctctgcaaaaaaaaaaaaaaaaa

SEQ ID NO: 12244 - DNA, 485 bp, Homo sapiens
ctttttcttttttaagagaggggatcttgctatgttgctcaggctagcttcaaactcctgggctcaaggggtcctcccgcctcagtctccccagtagctgggacgcaggtgcacaccgcctggcctggcttagagattgtccttcttattctgtaatcattggctagaagagggcatttcattgttgtgttttgtatttttcttattaaagaagtgtatcattttcaagtgttcattagctatttttagtttttccacaatttggttatcttttgtctatttttctgttagattgcatttttgattttgtagacactctttattactattattattattatttttcgaggcagggtctcactctgtcacccaggctggagtgcagtggcgtgatcttgtctcactgcaacctccgtctcctgggttcaagcgattttcttgcctcagcctcctgaatagctggggctacaggcatgtgcaccagg

SEQ ID NO: 12245 - DNA, 155 bp, Homo sapiens; identical to SEQ ID NO: 11702

SEQ ID NO: 12246 - DNA, 211 bp, Homo sapiens
  misc_feature 78: n=a, g, c or t
gttaaatattgtctaatcaggccgggcgcggtggctcacgtctgtggtcccggcactttgggagcctgaggcaggcgnatcatgaggtcaggagatcaagaccatcgtggcttacacggtgaaaccacgtctctactaaaaaaaaaaaaaattacaaaaaattcagccgggsatgatggcgggcacctgtagctcccagctattcgggagg

SEQ ID NO: 12247 - DNA, 353 bp, Homo sapiens
ataatacataagatatggtattgtgtgcctgggctcttagacctagcatagtattttcaaggttaatgtgtagcatgagtcactacttcattcctttctgtgtctgagtaacattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcaagaccagcttgggcaacagtgcaagaccctgtatctacccaaaaaaaaaaaaaaaaa

SEQ ID NO: 12248 - DNA, 314 bp, Homo sapiens; identical to SEQ ID NO: 11579

SEQ ID NO: 12249 - DNA, 225 bp, Homo sapiens; identical to SEQ ID NO: 11617

SEQ ID NO: 12250 - DNA, 173 bp, Homo sapiens; identical to SEQ ID NO: 11575

SEQ ID NO: 12251 - DNA, 104 bp, Homo sapiens
gtgtgttaagaaatgagctgtaggctcagtgcagtggctcatgcctgtaatcccagcactttgggaggctgaggtgggcggatcatgaggtaaggagttcgaga

SEQ ID NO: 12252 - DNA, 247 bp, Homo sapiens
aaaaggagaagactgatgttttaggtagggagttcgagaccagcctgaccaacatggagcaaccccatctctactaaaaatataattagccgggcgtggtggggcatgcttgtagtcccagctactcaggaggctgaggcaggagaatcacctgaacccaggagacagaggttgcagtgagccgagatcgccattgtactccagcctgggcaacaagaatgaaactccgtctcaaaaaaaaaaaaaa

SEQ ID NO: 12253 - DNA, 173 bp, Homo sapiens; identical to SEQ ID NO: 11575

SEQ ID NO: 12254 - DNA, 162 bp, Homo sapiens
ctaaaaattagccaggcctggtggcaggtgactgtratgccagctactcgggaggctgaggtaagagaattgcttgaacctgggtggaagaagttgcagtgagccaagattgtgccactgcactcctgcctgggtgatagagtgacactccttctcaaaaaa

SEQ ID NO: 12255 - DNA, 327 bp, Homo sapiens
catataacctttaaaaaataccatacatatttatgaatgcaatagttaaaaccagctataggagtacggctggcgtggtggctcatgcctgcaatctcagcactttgggaggcagaggcgggcggatcactcgaggtcaggagttcaggaccagcctggccaacatggtgaaacctgtctctactggggatacaaaaagtagctgggcatggtggccgcacgcctgtaatcccagctacttgggaggctgaggcaggagaatcgcttgaaccccggagcggaggttgcggtgagcggagattgcgccactgcactccggcctgtgta

SEQ ID NO: 12256 - DNA, 190 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaa

SEQ ID NO: 12257 - DNA, 200 bp, Homo sapiens; identical to SEQ ID NO: 11569

SEQ ID NO: 12258 - DNA, 200 bp, Homo sapiens; identical to SEQ ID NO: 11569

SEQ ID NO: 12259 - DNA, 225 bp, Homo sapiens; identical to SEQ ID NO: 11617

SEQ ID NO: 12260 - DNA, 170 bp, Homo sapiens; identical to SEQ ID NO: 11644

SEQ ID NO: 12261 - DNA, 93 bp, Homo sapiens
cactaatgactcaccttagaaggaaaagaaaaattttaatttacttaaaaattttttttttgattgaatagataattgtgtatatttgtggtt

SEQ ID NO: 12262 - DNA, 116 bp, Homo sapiens
cataagaatttataaacttgaaatagaaatattctattgtaaaggttaagaaaagtatacttggttggccaccgaggctcactaccataatcccagtacttcgggaggcagggtgg

SEQ ID NO: 12263 - DNA, 112 bp, Homo sapiens
ttaggcccaagaattacctgaacctgggacgtggaggttgcggtgagccaagatcgcaccactgtaccctagcctgggcaacagagtgactcttaaaaaaaaaaaaaaaacc

SEQ ID NO: 12264 - DNA, 159 bp, Homo sapiens
  misc_feature 16: n=a, g, c or t
aatggtagagacaggntttcaccatgttggccaagctggtctcaaactcctgacctcatgcctgtaatcccagcagtttgggaggccaaggcgggtggatcacctgagatcaggagttcaagaccagcctggccaacatggcgaaacccccattctact

SEQ ID NO: 12265 - DNA, 89 bp, Homo sapiens
aaacctaacttgcgcagaaaacaagatgagattggcatggctttatttgttttttttgttttgttttggtttttttttttttttgggct

SEQ ID NO: 12266 - DNA, 77 bp, Homo sapiens
gtcagacaataaagtctttgtaaaaagagaaaaaaaaaaaaaaaaaaaaaaaaaaaaaaaaaaaaaaaaaaaaaaaa

SEQ ID NO: 12267 - DNA, 438 bp, Homo sapiens
atcagccccggcgctctctcatcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgagagcaccgcgcccggcctgagtgagtcttaatccgtggccatctgcgttcctgcargcttcatctggccctatkgtcccctggcatcat

SEQ ID NO: 12268 - DNA, 365 bp, Homo sapiens
tatattgtttcccaagaagttctacttggtttcatttcaaacctgcctggtttttttgtttgtttgtttttatttttgttttgagacgaaktgggggtttcactcttgttgcccgggctggagtgcaatggcgtgatctcagctcactgcaacctccaccacctgggttcaagcaattctcctgcctcagcctcctgaggtcaggagtttaagaccagcctgacgaacatggagaatctccgtctctaataaatatacaaaattagccagacatggtgatgcatgcctgtaatcccagctactcaggaggctgaggcaggagaatcacttgaacccgggagttgaaggatgcagtgagctgagat

SEQ ID NO: 12269 - DNA, 302 bp, Homo sapiens
aaaaagtccctgggaagcggccgggcgcggttggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccacccca

SEQ ID NO: 12270 - DNA, 175 bp, Homo sapiens; identical to SEQ ID NO: 12058

SEQ ID NO: 12271 - DNA, 124 bp, Homo sapiens; identical to SEQ ID NO: 12092

SEQ ID NO: 12272 - DNA, 175 bp, Homo sapiens
tatatacattagctgggcatggtggtgcatgcctgtagtcgcagctgctcgggaggctgaggcaggagaatcgcttgaatctgggaggcggaggttgcagtgagccgagatcacatgacagcactccagcctgggtgacagacagagaccccatctcaaaaaaaaaaaaaaaaaa

SEQ ID NO: 12273 - DNA, 99 bp, Homo sapiens; identical to SEQ ID NO: 12001

SEQ ID NO: 12274 - DNA, 187 bp, Homo sapiens; identical to SEQ ID NO: 11697

SEQ ID NO: 12275 - DNA, 367 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagkgggaggatcacttcagcctgggagaccaaggctgcagtgagtcatgagtgtgccattgcaccccagtgtgggccacagagcgagaccttgtctccaaaaaaaaaaaaaccca

SEQ ID NO: 12276 - DNA, 78 bp, Homo sapiens; identical to SEQ ID NO: 11631

SEQ ID NO: 12277 - DNA, 98 bp, Homo sapiens
ccccttctccccggcggtyagtgctgagagtgcggagtgtgtgctccgggctcggaacacacatttattattaaaaaatccaaaaaaaaaaaaaaaaa

SEQ ID NO: 12278 - DNA, 401 bp, Homo sapiens
aggcggcgaagatggcggagaacagcggtcgcgccggcaagagcagcgggassgcgsgggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatga

SEQ ID NO: 12279 - DNA, 360 bp, Homo sapiens
gttgtttcggccgaggagccgtcgccgccatttcaagaccgtactaggtagatggtcaattagagttcccagggtttgaagcctggtaackgctgccgccgctcaagccctccagagcattgctacggctgctgcccttgtactactacctccaaatacgttcttgctggtagtggcggcasaggaccaattacctcttttttgctctccctcgagaagctccagatggcgtcttccgtgggcaacgtggccgacagcacagggttagctgagttggcacatcgagaatatcaggcaggagattttgaggcagctgagagacactgcatgcagctctggagacaagagccagacaatact

SEQ ID NO: 12280 - DNA, 341 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcaagtgcacgcctgtaatccctgctactcgggaggctgaaacaggagaatcacttgaacccaggagacggaggttgcggtgagttgagattatgccactgtactccagcctgggtgacagagc

SEQ ID NO: 12281 - DNA, 174 bp, Homo sapiens; identical to SEQ ID NO: 11611

SEQ ID NO: 12282 - DNA, 225 bp, Homo sapiens; identical to SEQ ID NO: 11617

SEQ ID NO: 12283 - DNA, 372 bp, Homo sapiens; identical to SEQ ID NO: 12192

SEQ ID NO: 12284 - DNA, 370 bp, Homo sapiens
  misc_feature 362..363: n=a, g, c or t
ttatgttttgaaagcaataaaaatcacccagtttcaaaactgcacaaagggtttgaatagagatttttccagagaggacatacagatggccagtagcacatcaacatgattggtcattaggaaatgcaagtcaaaaccaaaataagataccacttcataccaggtatcttattttacctagtatggctataatagtttaaagaaaaaagggaaataactgttggcaaggatgtggagaaatgggaacattgctgatgaaaatgtaaagtggtgtagccmtgtggaaaagggtttggcagttcctcccaaaggtgaacacagaaaccatatgtccagcaattccactcctacatatatatccnnaacaatt

SEQ ID NO: 12285 - DNA, 165 bp, Homo sapiens
ctaaaaattagccaggcctggtggcaggtgactgtaatgccagctactcgggaggctgaggtaagagaattgcttgaacctgggtggaagaagttgcagtgagccaagattgtgccactgactcctgcctgggtgatagagtgacactccttctcaaaaaaaaaa

SEQ ID NO: 12286 - DNA, 200 bp, Homo sapiens; identical to SEQ ID NO: 11569

SEQ ID NO: 12287 - DNA, 488 bp, Homo sapiens
atgttttgtgcggcgcggagttaagcgccccggcagtaacttaagggaagtggaccagggttgccgctgcccagagcggtcctttagtttccactggagtgagggaagagtgctgccatggcasccctgcgcasccaagaaggtcgtggcccctacggtgtcccaaatcaatgcggagttcgtgacccagttagcatgtaaatactgggctccccacatcaagaagaaatcaccttttgatataaaggttattgaagatatatatgaaaaagagattgtcaaatcaaggtttgctattagaaagataatgctcttggaatttaggtaagttataaggcattccattgatgaaagagataatgtgatttcagttttagctaaattttctgtgttatttctgtgagtcactaagaaaatctaaatttgtgaagatttatatttctgtgattggcttattttggaatatgtatatgatagcctttgttttc

SEQ ID NO: 12288 - DNA, 310 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaa

SEQ ID NO: 12289 - DNA, 209 bp, Homo sapiens; identical to SEQ ID NO: 11886

SEQ ID NO: 12290 - DNA, 351 bp, Homo sapiens
  misc_feature 16: n=a, g, c or t
aatggtagagacaggntttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctcaaaaaacaaaaaaaaaaaaaaaaag

SEQ ID NO: 12291 - DNA, 124 bp, Homo sapiens; identical to SEQ ID NO: 12092

SEQ ID NO: 12292 - DNA, 255 bp, Homo sapiens
atacaattagccaggtgtggcggcgtaatcccagctggcctgtaatcccagctacttgggaggctgaggcagaactgsttgaacccaggaggtggaggttgcagtgagccgtcatcgsgccactgagcsaagatcgcgcsactgcactccagcctgggcgacagagccakactgtctcaaataaataaatatgagataatgcagtcgggagaagggakggagagaattttattaaatgtgacgaactgcsccccc

SEQ ID NO: 12293 - DNA, 485 bp, Homo sapiens
  misc_feature 472: n=a, g, c or t
gactgacaactcacacggctgggtactcttctgagacaaaacttccagaggagcgatcaggcagcaacatttgctgttcaccaatatccattgttctgcagcctctgctstgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaagangttaaaaaccttg

SEQ ID NO: 12294 - DNA, 174 bp, Homo sapiens; identical to SEQ ID NO: 11611

SEQ ID NO: 12295 - DNA, 300 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaa

SEQ ID NO: 12296 - DNA, 339 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccaaaaaaaaaaaaaaaaaagy

SEQ ID NO: 12297 - DNA, 243 bp, Homo sapiens; identical to SEQ ID NO: 11807

SEQ ID NO: 12298 - DNA, 67 bp, Homo sapiens
gttaaatattgtctaatcaggscgggcgcggtggctcamgtctgtggtcccggcactttgggagcct

SEQ ID NO: 12299 - DNA, 78 bp, Homo sapiens; identical to SEQ ID NO: 11631

SEQ ID NO: 12300 - DNA, 170 bp, Homo sapiens; identical to SEQ ID NO: 11644

SEQ ID NO: 12301 - DNA, 200 bp, Homo sapiens; identical to SEQ ID NO: 11569

SEQ ID NO: 12302 - DNA, 174 bp, Homo sapiens; identical to SEQ ID NO: 11611

SEQ ID NO: 12303 - DNA, 309 bp, Homo sapiens
atatacaaatgtcggctgggcacggtggatcacacctgtaatcccagcactttgggaggccgaagcaggtggatcacgaggtcaggagattgagaccatcctggctaacacagtgaaactccgtctctactaaaaacagaaaaaattagctgggcatggtggcacgtgcctgtaatcccagctacttgggaggctgaggcaggagaatcgtttgaacctgggaggtggaggttgcagtgagccgcgatgctgagatcacgccactgcactccagcctgggtgacagagcgagactccgtctccgaaaaa

SEQ ID NO: 12304 - DNA, 74 bp, Homo sapiens
tktctaggctgascgtggtggctcacgcctgtactcctaccastttgggaggccaaggcaggcggatcatttga

SEQ ID NO: 12305 - DNA, 246 bp, Homo sapiens
atgcagcgcgcggcgatggagttcaagaccagcctggccaacatggtgaaacctgtctctactaaaaatacaaaaattagctgggcgtggtggcgcacgctgtagtcccagctactcgggaggctgaagcagaagaattgcttgaacctgggaggcagaggttgcagtgagctgagatcatgccactgcactctagcctgggtgacagagtgagactgcgtctaagaaaaaaaaaaaaaaaaargy

SEQ ID NO: 12306 - DNA, 489 bp, Homo sapiens
atttgccagccaggctagtgacagaaatggattcgaaatatcagtgtgtgaagctgaatgatggtcacttcatgcctgtcctgggatttggcacctatgcgcctgcagaggtaacaataatatttttagtgttgagggttcaaaggagctagagtaagtggaagctgaccaggttgtcaggcttgtgttcctatgttactctgcatgactcccctttaaacgtcagtctttgttctgcaatgccatcttgtcacagggtcatctactgcttatttgtggcactgttttgtcttctgtttatgtttatttcacagcttgtcagagtctatacaactcagcagaaagaacacggcttgcctgctccctctcttgaagattgattgcaatgggagtggtttctctgtttctttgtatagtcgaacagatatttacttcttccaagaagatacaattcagaggaatttttatggcaaaagttagtggagacgg

SEQ ID NO: 12307 - DNA, 262 bp, Homo sapiens
atacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccc

SEQ ID NO: 12308 - DNA, 162 bp, Homo sapiens; identical to SEQ ID NO: 11920

SEQ ID NO: 12309 - DNA, 92 bp, Homo sapiens
ctttaggtgtattaagatataaggccaggctgggcatggtggctcatgctgtaatcccagcactttgagtggctgaggtgggaggatcactt

SEQ ID NO: 12310 - DNA, 296 bp, Homo sapiens
taaaaaagaaggtgggctgggcgcggtggctcacacctgtaatcccagcactttgggaggccgagacgggcggatcatgaggtcaggagatcgagaccatcctggctaacacagtgaaaccctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctcc

SEQ ID NO: 12311 - DNA, 149 bp, Homo sapiens
  misc_feature 78: n=a, g, c or t
gttaaatattgtctaatcaggccgggcgcggtggctcacgtctgtggtcccggcactttgggagcctgaggcaggcgnatcatgaggtcaggagatcaagaccatcgtggcttacacggtgaaaccacgtctctactaaaaaaaaaaaa

SEQ ID NO: 12312 - DNA, 401 bp, Homo sapiens
ttagatagctgtattatagtgagtcctctgggactgtttggttcttttggtatgatggtatttttgttatgtcaaatactgtctgaaaaaattataagaaaatatgtgttctttttggccgggtgcggtggcttaccgctgtaatctcagcactttggaaggccgaggcgggtgagtcacctgaggtcagaagttcaagccagcctggccaacatggtgaaacccatctctagtaaaaataaaaaaaattagtctggcatggtagtgcgtgcctgtagtcccagctactttgtaggctgaggcaggagaattgcttgaacctgggaggcggagggtgcaatgaattgagattgcgccactgcactccagcctaggcgacagagcaagactccatctcaaaa

SEQ ID NO: 12313 - DNA, 235 bp, Homo sapiens
aaggatgtcaaaatgaaaatggtaccataaatagccaacgttgattaaaattaaacatgattactttaacaaaaagaaacttaaggccaggtatggtgggtcatgcctgtaatcckagtskrctttgggaggctgaagtggaaggatcacttgagcccaggagttcaagaccagcctggagaacacagagagacccccaccatctcttccaaaaataaaaactagccaggcatgg

SEQ ID NO: 12314 - DNA, 444 bp, Homo sapiens
attctaatccgtttcacacacggtgctgctacctcgtttgcttcgtgcgtgcgtgcgcagatgtgggccccgcgggagcagctactgggctgggctgcggaasctctgcctgccaaggattctgcctggccctgggaagagaagcctagatatctgggaccagtgactttcgaggatgtggctgtgcttttcacttaggcagagtggaagagactgagccttgagcagaggaacctatacaaagaagtgatgctggaaaatctcaggaatctggtctcattggtgctctcctatcaaatctagaattggaagattgatggacagcaactgaggtgctaccaggataccaaaaagtctgctggataaacaccatctctattctaatattatggagagatcaggatctcctgtgcccaaatcaaacctgttaatacactcagctgt

SEQ ID NO: 12315 - DNA, 135 bp, Homo sapiens
  misc_feature 127: n=a, g, c or t
ctttaggtgtattaagatataaggccaggctgggcatggtggctcatgcctgtaatcccagcactttgagtggctgaggtgggaggatcacttgagcccaggatttcaaggcgagcctgggacacantggtgaaa

SEQ ID NO: 12316 - DNA, 372 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaacccaaaara

SEQ ID NO: 12317 - DNA, 400 bp, Homo sapiens
ttatcactccaagaagaaaccccagacccattagcagtgtgcctttccttcactcttccctcccccagctcattaatctacttttgctttctgtaaatccatagagagatttgctgtgagagtgtgaaagtggctgtagatagtacgtaaactgcccattccagaacttcatgtaaatggtataacacaatatgtgatcttttgtctctggcttctttcacttagcgtaatattttcaagtttcatccatgttgtggcattgatcagtattttatttctttttattgtcaaatactgttccgttgtatagatataccacatttttttgtggatttggattgtttccactttttggctactgtgaataatgctgttatgtacatttgtgtacaaaattatg

SEQ ID NO: 12318 - DNA, 475 bp, Homo sapiens
tcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcgatctatcaattttgttgatcctttccaaaaaccagctcctggattcattgattttttgaagggttttttgtgtctctatttccttcagttctgctctgattttagttatttattgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatcttta

SEQ ID NO: 12319 - DNA, 337 bp, Homo sapiens
  misc_feature 16: n=a, g, c or t
aatggtagagacakgntttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggcagggtgagaatccatctcaaaaaacaaaa

SEQ ID NO: 12320 - DNA, 225 bp, Homo sapiens; identical to SEQ ID NO: 11617

SEQ ID NO: 12321 - DNA, 81 bp, Homo sapiens
ctttttttcgcaacgggtttgccgccagaacacaggtgtcgtgaaaactacccctaaaagccaaaaaaaaaaaaaaaaarg

SEQ ID NO: 12322 - DNA, 82 bp, Homo sapiens; identical to SEQ ID NO: 11689

SEQ ID NO: 12323 - DNA, 200 bp, Homo sapiens; identical to SEQ ID NO: 11569

SEQ ID NO: 12324 - DNA, 310 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttttatcacaccactgcactcctgcctgggtgacagagcaagagcctgtcgccaaaaaaaaaaaaaaaaa

SEQ ID NO: 12325 - DNA, 117 bp, Homo sapiens
gttaaatattgtctaatcaggccgggcgcggtggctcacgtctgtggtcccggcactttgggagcctgaggcaggcgatcatgaggtcaggagatcaagaccatcgtggcttacacg

SEQ ID NO: 12326 - DNA, 289 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgg

SEQ ID NO: 12327 - DNA, 128 bp, Homo sapiens
ttccatctggatgaccaaaccgtcagctcctaaagggccgcagaggctgagggcgctgctggcagccggccctctgtggacatttgctgaataaacagaagatatgtgcaaaaaaaaaaaaaaaaagc

SEQ ID NO: 12328 - DNA, 141 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctc

SEQ ID NO: 12329 - DNA, 314 bp, Homo sapiens; identical to SEQ ID NO: 11579

SEQ ID NO: 12330 - DNA, 123 bp, Homo sapiens
gtcagacaataaagtctttgtaaaaagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12331 - DNA, 174 bp, Homo sapiens; identical to SEQ ID NO: 11671

SEQ ID NO: 12332 - DNA, 53 bp, Homo sapiens
aaaaaaaaaaaaaaaaaaaaaaaaaaaaaaaaaaaaaaaaaaaaaaaaaaaaa

SEQ ID NO: 12333 - DNA, 302 bp, Homo sapiens
tttaaagatgttgccatttttggctgggcacagtggctcacacctgtaatcccagcactttgggaggccgaggtgggcagctcgcttgagtcaggagtttgagaccagcctggccaatatggtgaaaccctgtctctactaaaaaatacaaaaattagctgggcatggtggcatgtgcctgtaatcccagctactcgggaggctgaggcaggagaattgcttgaacccaggaagcagaggctgcagtgagccaagatcataccactgcactccagcctaggtgacagagcgagactccatct

SEQ ID NO: 12334 - DNA, 163 bp, Homo sapiens
ctttaggtgtattaagatataaggccaggctgggcatggtggctcatgcctgtaatcccagcactttgagtggctgaggttggaggatcacttgagcccaggatttcaaggcgagcctgggacacatggtgaaaccctgtctctgcaaaaaaaaaaaaaaaaa

SEQ ID NO: 12335 - DNA, 162 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctgtctctgcaaaaaaaaaaaaaaaaa

SEQ ID NO: 12336 - DNA, 173 bp, Homo sapiens; identical to SEQ ID NO: 11575

SEQ ID NO: 12337 - DNA, 142 bp, Homo sapiens; identical to SEQ ID NO: 11732

SEQ ID NO: 12338 - DNA, 155 bp, Homo sapiens
ctttaggtgtattaagatataaggccaggctgggcatggtggctcatgctgtaatcccagcactttgagtggctgaggtgggaggatcacttgagcccaggatttcaaggcgtagcstgggacacatggtgaaacctgtctctgcaaaaaaaaaa

SEQ ID NO: 12339 - DNA, 366 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaaccc

SEQ ID NO: 12340 - DNA, 314 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaa

SEQ ID NO: 12341 - DNA, 80 bp, Homo sapiens
aaaaaaaaaawtttaatttggaasacttctggttttggtgsagttttctctgttatattttactttttaaaaagaaaaag

SEQ ID NO: 12342 - DNA, 360 bp, Homo sapiens
catataacctttaaaaaataccatacatatttatgaatgcaatgataaaaccagctataggagtacggctggcgtggtggctcatgcctgcaatctcagcactttgggaggcagaggcgggcggatcactcgaggtcaggagttcaggaccagcctggccaacatggtgaaacctgtctctactggggatacaaaaagtagctgggcatggtggccgcacgcctgtaatcccagctacttgggaggctgaggcaggagaatcgcttgaaccccggaggcggaggttgcggtgagcggagattgcgccactgcactccggcctgtgtaacagatgagactctgtctcaaaaaaaaaataaa

SEQ ID NO: 12343 - DNA, 225 bp, Homo sapiens; identical to SEQ ID NO: 11617

SEQ ID NO: 12344 - DNA, 187 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgsgcaacagagcaagaccctgtctctacaaaa

SEQ ID NO: 12345 - DNA, 173 bp, Homo sapiens; identical to SEQ ID NO: 11629

SEQ ID NO: 12346 - DNA, 147 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaacctgtctctgcaaa

SEQ ID NO: 12347 - DNA, 354 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaa

SEQ ID NO: 12348 - DNA, 108 bp, Homo sapiens; identical to SEQ ID NO: 11964

SEQ ID NO: 12349 - DNA, 225 bp, Homo sapiens; identical to SEQ ID NO: 11617

SEQ ID NO: 12350 - DNA, 224 bp, Homo sapiens; identical to SEQ ID NO: 11519

SEQ ID NO: 12351 - DNA, 307 bp, Homo sapiens
cacgagactccatctttaaaaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcggascttgcagcgagccgagatcgtgccgctgcactccagcctgggcgacagagtgagactccatctcaaaaaaaaaaaaaaaaa

SEQ ID NO: 12352 - DNA, 144 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaaacctagtctct

SEQ ID NO: 12353 - DNA, 200 bp, Homo sapiens; identical to SEQ ID NO: 11569

SEQ ID NO: 12354 - DNA, 132 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtga

SEQ ID NO: 12355 - DNA, 318 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaaaaaaaaaaaaaaa

SEQ ID NO: 12356 - DNA, 373 bp, Homo sapiens
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagagcagcaagaaccacacccagcagcaatgtcagcggaagtggaaacctcagagggggtagacgagtcagaaaaaaagaactctggggccctagaaaaggagraccmaaatgagaatkgctgasctctcggrgctcctgaaaggaagggmccaaggaagcacacgaccgggcagtatttctaaaaaaaa

SEQ ID NO: 12357 - DNA, 200 bp, Homo sapiens; identical to SEQ ID NO: 11569

SEQ ID NO: 12358 - DNA, 173 bp, Homo sapiens; identical to SEQ ID NO: 11575

SEQ ID NO: 12359 - DNA, 173 bp, Homo sapiens
ctaaaaattagccaggsctggtggcaggtgactgtaatgccagctactcgggaggctgaggtaagagaattgcttgaacctgggtggaagaagttgcagtgagccaagattgtgcsactgcactcctgcctgggtgatagagtgacactccttctcaaaaaaaaaaaaaaaaa

SEQ ID NO: 12360 - DNA, 200 bp, Homo sapiens; identical to SEQ ID NO: 11569

SEQ ID NO: 12361 - DNA, 344 bp, Homo sapiens
taaatgatatcgtttggatgtttgtaccctccaaatctcatgttgaaatgtgatcttcaatcttggaggtggagcctaatgggaaatgtttggatcatgggggcagatcctttataaatggattggtgccttcccagcagtaaatgtgagtgagttctagctctcctacttcatgcaacagctggttgtttaaagagcttggcaccccctcttctctctcttgatcactctcttsaccttgtgacacccctgctctccttttgccttctacsaccattgtaagcttcctgaggccctcatcagaagcagatgctggtgccatgccttttttttttttttttttt

SEQ ID NO: 12362 - DNA, 213 bp, Homo sapiens; identical to SEQ ID NO: 11736

SEQ ID NO: 12363 - DNA, 96 bp, Homo sapiens
  misc_feature 76: n=a, g, c or t
ctttaggtgtattaagatataaggccaggctgggcatggtggctcatgcctgtaatcccagcactttgagtggctnaggtgggaggatcacttgag

SEQ ID NO: 12364 - DNA, 143 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaaccctgtctct

SEQ ID NO: 12365 - DNA, 444 bp, Homo sapiens
ttaaaataatacttagaggctgggtgaggtgctcacgcctgtaaccccagcactttgggaggccagggcgggtggatcacctgaggtcaggagttcaagaccagcctgaccagcatggtgaaacccgtctttactaaaagtaccgagattaggccaggcgtggtgggtcacgctgtaatctcagcactttcggaggccgaggtgggcggatcatctgaggtcaggagttcgagaccatcctgaccggcatggcggaaccctgcctctactaaaaatacaaaaaaaattagtccgttgtggtggcagatgcctgtagtcccggctactcgggaagctaaggcaggagaatcgcttgaaccgaggaggcggaggttgcagtgagccgaaatcacgccactacactccagcctgggcgacaagagcaaaactccgtctcaaaaaaaa

SEQ ID NO: 12366 - DNA, 371 bp, Homo sapiens; identical to SEQ ID NO: 11983

SEQ ID NO: 12367 - DNA, 89 bp, Homo sapiens
ttaggcccaagaattacctgaacctgggasgtggaggttgcggtgagccaagatcgcaccactgtaccctagcctgggcaacagagtga

SEQ ID NO: 12368 - DNA, 82 bp, Homo sapiens
gtcagacaataaagtctttgtaaaaagagaaaaaaaaaaaaaaaaaaaaaaaaaaaaraaaaaaaaaaaaaaaaaaaaaaaa

SEQ ID NO: 12369 - DNA, 108 bp, Homo sapiens; identical to SEQ ID NO: 11953

SEQ ID NO: 12370 - DNA, 173 bp, Homo sapiens; identical to SEQ ID NO: 11575

SEQ ID NO: 12371 - DNA, 105 bp, Homo sapiens
gttaaatattgtctaatcaggccgggcgcggtggctcacgtctgtggtcccggcactttgggagcctgaggcaggcgatcatgaggtcaggagatcaagaccatc

SEQ ID NO: 12372 - DNA, 202 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaaagg

SEQ ID NO: 12373 - DNA, 313 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaactcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaa

SEQ ID NO: 12374 - DNA, 130 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtg

SEQ ID NO: 12375 - DNA, 449 bp, Homo sapiens
gactgacaactcacacggctgggtactcttctgagacaaaacttccagaggagcgatcaggcagcaacatttgctgttcaccaatatccattgttctgcagcctctgctstgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggagg

SEQ ID NO: 12376 - DNA, 375 bp, Homo sapiens
tatattgtttcccaagaagttctacttggtttcatttcaaacctgcctggtttttttgtttgtttgtttttatttttgttttgagacgaaktgggggtttcactcttgttgcccgggctggagtgcaatggcgtgatctcagctcactgcaacctccaccacctgggttcaagcaattctcctgcctcagcctcctgaggtcaggagtttaagaccagcctgacgaacatggagaatctccgtctctaataaatatacaaaattagccagacatggtgatgcatgcctgtaatcccagctactcaggaggctgaggcaggagaatcacttgaacccgggagttgaaggatgcagtgagctgagatcatgtcattg

SEQ ID NO: 12377 - DNA, 55 bp, Homo sapiens
acttttttttcttcagsgaggcggccgagctgacgsaaacwtgcagatctttgtg

SEQ ID NO: 12378 - DNA, 134 bp, Homo sapiens
ctttaggtgtattaagatataaggccaggctgggcatggtggctcatgcctgtaatcccagcactttgagttgctgaggtgggaggatcacttgagcccaggatttcaaggcgagcctgggacacatggtgaaa

SEQ ID NO: 12379 - DNA, 137 bp, Homo sapiens
ctttaggtgtattaagatataaggcctggctgggcatggtggctcatgcctgtaatcccagcactttgagtggctgaggtgggaggatcacttgagcccaggatttcaaggcgagcctgggacacatggtgaaaccc

SEQ ID NO: 12380 - DNA, 305 bp, Homo sapiens
cacgagactcsatctttamaaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggsatggtggcacacacctgtaatcgtagctggggcaggagaatcgcctgaacccgggaggcggasttgcagcgagccgagatcgtgccgctgcactccagcctgggcgacagagtgagactccatctcaaaaaaaaaaaaaaaa

SEQ ID NO: 12381 - DNA, 200 bp, Homo sapiens
  misc_feature 27,81: n=a, g, c or t
tgaatataattagtctmatttgaaatntagtagctgaacatatactgtattaattaacaatactggtcaggcacgttggcncatgcctgtcatcccagcactttgggaggccggggcaggaggatcagtcaagaccgggagtttgagactaacctgggcaacagagcaagaccctgtctctacaaaaaaaaaaaaaaaaa

SEQ ID NO: 12382 - DNA, 162 bp, Homo sapiens
gttaaatattgtstaatcaggcsgggcgcggtggctcacgtctgtggtcccggcactttgggagcctgaggcaggcgatcatgaggtcaggagatcaagaccatcgtggcttacacggtgaaaccacgtctctactaaaaaaaaaaaaawtacaaaaawtca

SEQ ID NO: 12383 - DNA, 175 bp, Homo sapiens; identical to SEQ ID NO: 12172

SEQ ID NO: 12384 - DNA, 243 bp, Homo sapiens; identical to SEQ ID NO: 12213

SEQ ID NO: 12385 - DNA, 343 bp, Homo sapiens; identical to SEQ ID NO: 11941

SEQ ID NO: 12386 - DNA, 433 bp, Homo sapiens
gcatttcctattagatctcttttggcagataaactgtgtgcccccttcctcccaacagattcctgtgttgaagctctcactccccagtacctcagaatggtactgtatccctttaaggaggggattaagttaaaatgaagccttagggtgggccatgatccaatctgactgtgtccttatatgaagggaaatgggccgggcacgtggttcacgcctgtaatcccagcaccttggaaggccaaggtgggcagatcacctgaggtcaggagattaagaccatcctgaccaacatggtgaaaacctgtctctactaaaaatacaaaaattagctgggcgtggtagtgggtgcctggtaatcccagctacttgggagcctgaggcaggagaatcgcttgaacccaggaggcggaggttgcagtgagctgagatcaca

SEQ ID NO: 12387 - DNA, 354 bp, Homo sapiens
ataatacataagatatggtattgtgtgcctgggctcttagacctagcatagtattttcaaggttaatgtgtagcatgagtcactacttcattcctttctgtgtctgagtaacattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcaagaccagcttgggcaacagtgcaagaccctgtatctacccaaaaaaaaaaaaaaaaag

SEQ ID NO: 12388 - DNA, 162 bp, Homo sapiens; identical to SEQ ID NO: 11920

SEQ ID NO: 12389 - DNA, 111 bp, Homo sapiens; identical to SEQ ID NO: 11891

SEQ ID NO: 12390 - DNA, 72 bp, Homo sapiens
gtcagacaataaagtctttgtaaaaagagaaaaaaaaaaaaaaaaaaaaaaaaaaaaaaaaaaaaaaaaaaa

SEQ ID NO: 12391 - DNA, 170 bp, Homo sapiens; identical to SEQ ID NO: 11644

SEQ ID NO: 12392 - DNA, 101 bp, Homo sapiens
gtgtgttaagaaatgagctgtaggctcagtgcagtggctcatgcctgtaatcccagcactttgggaggctgaggtgggcggatcatgaggtaaggagttcg

SEQ ID NO: 12393 - DNA, 302 bp, Homo sapiens
caaaaactagccaggcagggctkggcgcggtggctcacgcctgtaatcccagcactttgggaggccgaggcgggcggatctcgaggtcaggagattgagaccatcccggctaacacggtgaaaccccgtctctactaaaaatacaaaaaaaattagctgggcgtggtggcaggtgcctgtggtcccagctactcgggaggctgaggcagaagaatggcgtgaacttgggaggtggagcttacagtgagccgagatcacaccactgcactccagcctgggggacagagcgagactccgtctca

SEQ ID NO: 12394 - DNA, 253 bp, Homo sapiens; identical to SEQ ID NO: 11749

SEQ ID NO: 12395 - DNA, 123 bp, Homo sapiens
atcgaaaaattagctgggcgtggtgtgtgcctgtggttccagccacatgggaggctggcgcatccccatgcttgagcccaggaggtttaggctgcagtgagctgtgttcatgccactgcactc

SEQ ID NO: 12396 - DNA, 200 bp, Homo sapiens; identical to SEQ ID NO: 11569

SEQ ID NO: 12397 - DNA, 111 bp, Homo sapiens; identical to SEQ ID NO: 11767

SEQ ID NO: 12398 - DNA, 78 bp, Homo sapiens
aaagaagaaaagatatataggkggctcacgcctgtaatcccaaagtgctgggattacaggtgtgagcactgcgcctgg

SEQ ID NO: 12399 - DNA, 369 bp, Homo sapiens
  misc_feature 150: n=a, g, c or t
gtgagccgagatcttgccactgcactccagccagggtgatggagtgagactctcagaaaaaaattagtgccaggcacaggggctcacacctataatccccgcactttggcaggccaggtgggcaaattgcttgagcccakgagttcgagncagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaacccaaaa

SEQ ID NO: 12400 - DNA, 153 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaac

SEQ ID NO: 12401 - DNA, 148 bp, Homo sapiens; identical to SEQ ID NO: 11566

SEQ ID NO: 12402 - DNA, 174 bp, Homo sapiens
  misc_feature 94: n=a, g, c or t
tacaaaaaattagctgggcgtggtggcaggcgcctgtggtcccagctactcgggaggctgaggcaggagaatagtgtgaacccaggaggcgganttgcagtgagccaagatagtgccactgcacttcagcctgggtgacagagtgagactctgtcacaaaaaaaaaaaaaaaaa

SEQ ID NO: 12403 - DNA, 108 bp, Homo sapiens; identical to SEQ ID NO: 11964

SEQ ID NO: 12404 - DNA, 66 bp, Homo sapiens
aaaaaaaaaaaaaaaaaaaaaaaaaaaaaaaaaaaaaaaaaaaaaaaaaaaaaaaaaaaaaaaaaa

SEQ ID NO: 12405 - DNA, 311 bp, Homo sapiens
  misc_feature 118..119,287: n=a, g, c or t
gatagattaaaaattttctgggctgggcgcggtggctcatgccggtaatcccagcactttgggaggccgaggcaggcggatcacaaggtcaggagatcgagaccatcctggctaasannktgaaactcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggsgacagagngaggttccgtctcaaaaaacaaaa

SEQ ID NO: 12406 - DNA, 156 bp, Homo sapiens; identical to SEQ ID NO: 12157

SEQ ID NO: 12407 - DNA, 158 bp, Homo sapiens; identical to SEQ ID NO: 11688

SEQ ID NO: 12408 - DNA, 293 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgcctgtaatcccagctgctcgggaggctgaggcaagagaattgcttgaacggcagaggttgtggtgagccaagatcatgacactgcaccccagcgtgggcaacaagagtgaaacttcgtctcca

SEQ ID NO: 12409 - DNA, 197 bp, Homo sapiens; identical to SEQ ID NO: 11802

SEQ ID NO: 12410 - DNA, 200 bp, Homo sapiens; identical to SEQ ID NO: 11569

SEQ ID NO: 12411 - DNA, 200 bp, Homo sapiens
ttaatataattagtctcatttgaaatttagtagctgaacatatactgtattaattaacaatactggtcaggcacgttggctcatgcctgtcatcccagcactttgggaggccggggcaggaggatcagtcaagaccgggagtttgagactaacctgggcaacagagcaagaccctgtctctacaaaaaaaaaaaaaaaaa

SEQ ID NO: 12412 - DNA, 486 bp, Homo sapiens
agttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattat

SEQ ID NO: 12413 - DNA, 277 bp, Homo sapiens
  misc_feature 153..154: n=a, g, c or t
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgannccaggagttcaagaccagcctggagaacacagagagacccccaccatctcttccaaaaataaaaactagccaggcatggtggctcaggcctgtagtcccagctacttgggaggctgaggtggg

SEQ ID NO: 12414 - DNA, 163 bp, Homo sapiens; identical to SEQ ID NO: 11668

SEQ ID NO: 12415 - DNA, 173 bp, Homo sapiens; identical to SEQ ID NO: 11713

SEQ ID NO: 12416 - DNA, 162 bp, Homo sapiens; identical to SEQ ID NO: 11580

SEQ ID NO: 12417 - DNA, 109 bp, Homo sapiens; identical to SEQ ID NO: 11741

SEQ ID NO: 12418 - DNA, 312 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaa

SEQ ID NO: 12419 - DNA, 173 bp, Homo sapiens; identical to SEQ ID NO: 11575

SEQ ID NO: 12420 - DNA, 355 bp, Homo sapiens
gtgagccgagatcttgccactgcactccagccagggtgatggagtgagactctcagaaaaaaattagtgccaggcacagggsctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggaggaccaaggctgcagtgagtcatgagtgtgccattgcaccccagtgtgggccacagagcgagaccttgtctccaaaa

SEQ ID NO: 12421 - DNA, 163 bp, Homo sapiens; identical to SEQ ID NO: 11668

SEQ ID NO: 12422 - DNA, 140 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaaaccgtgtctctacg

SEQ ID NO: 12423 - DNA, 327 bp, Homo sapiens
gatagattaaaaattttctgggctgggcgcggtggctcatgccggtaatcccagcactttgggaggccgaggcaggcggatcacaaggtcaggagatcgagaccatcctggctaacacggtgaaacctcatctctactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttccgtctcaaaaaacaaaaaaaaaaaaaaaaagg

SEQ ID NO: 12424 - DNA, 173 bp, Homo sapiens; identical to SEQ ID NO: 11575

SEQ ID NO: 12425 - DNA, 306 bp, Homo sapiens
cacgagactccatctttaraaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcggasddgcagcgagccgagatcgkgccgctgcactccagcctgggcgacagagtgagactccatctcaaaaaaaaaaaaaaaaa

SEQ ID NO: 12426 - DNA, 225 bp, Homo sapiens; identical to SEQ ID NO: 11617

SEQ ID NO: 12427 - DNA, 129 bp, Homo sapiens
ttaggcccaagaattacctgaacctgggacgtggaggttgcggtgagccaagatcgcaccactgtaccctagcctgggcaacagagtgactcttaaaaaaaaaaaaaaaamsaaaaaaaaaaaaaaaaa

SEQ ID NO: 12428 - DNA, 314 bp, Homo sapiens; identical to SEQ ID NO: 11579

SEQ ID NO: 12429 - DNA, 83 bp, Homo sapiens; identical to SEQ ID NO: 12087

SEQ ID NO: 12430 - DNA, 97 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12431 - DNA, 158 bp, Homo sapiens
gtgtgttaagaaatgagctgtaggctcagttgcagtggctcatgcctgtaatcccagcactttgggaggctgaggtgggcggatcatgaggtaaggagttcgagagcagcctggccaacatggtgaaaccgtgtctctacgaaaaaaaaaaaaaaaaa

SEQ ID NO: 12432 - DNA, 125 bp, Homo sapiens; identical to SEQ ID NO: 11934

SEQ ID NO: 12433 - DNA, 367 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatca

SEQ ID NO: 12434 - DNA, 82 bp, Homo sapiens
gtcagacaataaagtctttgtaaaaagggaaaaaaaaaaaaaaaaaaaaaaaaaaaaaaaaaaaaaaaaaaaaaaaaaaaaa

SEQ ID NO: 12435 - DNA, 346 bp, Homo sapiens
cttgttctatcacccaggctggtgtgcactggtatgttctcgctcactgcaaccactatctctcaggttcaagcgattctccttcctcagcctcctgaktagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgaaaaaaaaaaaaaaaaaggs

SEQ ID NO: 12436 - DNA, 70 bp, Homo sapiens
ctatgataatatagwatgttaaagatatataatgaatataaagaacacttaataaaataaaatcatagct

SEQ ID NO: 12437 - DNA, 507 bp, Homo sapiens
tagttattagtaaaaaaagaagataacttgagagttggctgggccttagcatctaagtaagcaatcaaatggggccagcatagctcctagttggtgaagaagaaagaaatgtgcaaactgccattcatatggataggatgctttcaagtcatgtgtaactagaatgaatagcccctgggtggatcaagggtgatatcatggtcagaaccttgtggtttgtctaacttaacctctccagaactgtgattaagtgaaagatatacagaatcagagtctgctctcaaagtcacatttggaaaaatgaatcacagtttatagaaatagctagtgtaaatattaatatataataatagatgcatatttaaatatattaggtgagtatgcgtgtatcagtttcttgaatgtccccaagtccttaggtcactttgactcagaaaatttgagtgaaattggcttgagcttccactagctccaactcaagcatattttctgttatttggggggaaa

SEQ ID NO: 12438 - DNA, 158 bp, Homo sapiens
gtgtgttaagaaatgagctgtaggctcagtgcagtggctcatgcctgtaatcccagcactttgggaggctgaggtgggcggatcatgaggtaaggagttcgagagcagcctggccaacatggtgaaaccgtgtctctacgaaaaaaaaaaaaaaaaaa

SEQ ID NO: 12439 - DNA, 294 bp, Homo sapiens
cacgagactccatctttaaaaaaaaacaagacgggccggcacgtgggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcggasttgcagcgagccgagatcgtgccgctgcactccagcctgggcgacagagtgagactccatctcaaag

SEQ ID NO: 12440 - DNA, 70 bp, Homo sapiens
gtcagacaataaagtctttgtaaaaagagaaaaaaaaaaaaaaaaaaaaaaaaaaaaaaaaaaaaaaaaa

SEQ ID NO: 12441 - DNA, 94 bp, Homo sapiens
ctttaggtgtattaagatataaggccaggctgggcatggtggctcatgctgtaatcccagcactttgagtggctgaggtgggaggatcacttga

SEQ ID NO: 12442 - DNA, 374 bp, Homo sapiens
tttaaaaaataaataagtaaataaaattgagcctcattttttaacctaattgaaaatgggtgataaaaatgtatacattgcgaccaggtgcggtggctcacacttgtaatcccagcactttgggaggccaaggcaggtggatcacctgaggtcaggagttcaagaccagcctggccaacatggtgaaacttcgtctctattaaaaatacaaaaatcagccaagtgtggtggcacatgcctgtagtcccagctacccgggaggctgaggcaggagaatcgcttgaacttgggatgctgcagttgcagtgagctgagatcgcaccattgcactcctgcctgggtgacagagcaagactctgtctcaaaaaaaaaaa

SEQ ID NO: 12443 - DNA, 280 bp, Homo sapiens
gaattgtgaggctcagggtgggcacggtggctcacacctgtaatcccagcactttgggaggccgaggcgggtggatcacctgaggtcgggagtttgagaccagcctgactaacatggagaaaccccatctctactaaaaataaaaaattagccaggcatggtggcacatgctgtaatcccagctgctcgggaggctgaggcaagagaattgcttgaacggcagaggttgtggtgagccaagatcatgacactgcaccccagcgtgggcaacaagagtgaa

SEQ ID NO: 12444 - DNA, 143 bp, Homo sapiens
  misc_feature 126: n=a, g, c or t
ctttaggtgtattaagatataaggccaggctgggcatggtggctcatgctgtaatcccagcactttgagtggctgaggtgggaggatcacttgagcccaggatttcaaggcgagcctgggacacantggtgaaaccctgtctc

SEQ ID NO: 12445 - DNA, 187 bp, Homo sapiens; identical to SEQ ID NO: 11697

SEQ ID NO: 12446 - DNA, 76 bp, Homo sapiens
ataaaaaaaaaaaaaaaaaaaaaaaaaaaaaaaaaaaaaaaaaaaaaaaaaaaaaaaaaaaaaaaaaaawtttttt

SEQ ID NO: 12447 - DNA, 331 bp, Homo sapiens
ataatacataagatatggtattgtgtgcctgggctcttagacctagcatagtattttcaaggttaatgtgtagcatgagtcactacttcattcctttctgtgtctgagtaacattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcaagaccagcttgggcaacagtgcaagaccctgtatc

SEQ ID NO: 12448 - DNA, 107 bp, Homo sapiens; identical to SEQ ID NO: 11676

SEQ ID NO: 12449 - DNA, 173 bp, Homo sapiens; identical to SEQ ID NO: 11575

SEQ ID NO: 12450 - DNA, 83 bp, Homo sapiens; identical to SEQ ID NO: 12087

SEQ ID NO: 12451 - DNA, 200 bp, Homo sapiens; identical to SEQ ID NO: 11569

SEQ ID NO: 12452 - DNA, 79 bp, Homo sapiens; identical to SEQ ID NO: 12230

SEQ ID NO: 12453 - DNA, 154 bp, Homo sapiens
sataagaatttataaacttgaratagaaatattctattgtaaaggttaagamaagtatacttggttggccaccgaggctcactaccataatcccagtacttcgggaggcagggtggaagrattgctcgakcccagaaggtggaggctgcagtga

SEQ ID NO: 12454 - DNA, 69 bp, Homo sapiens; identical to SEQ ID NO: 11887

SEQ ID NO: 12455 - DNA, 99 bp, Homo sapiens; identical to SEQ ID NO: 12001

SEQ ID NO: 12456 - DNA, 408 bp, Homo sapiens
atatttttttatggctcagaatgtggtctttttgatgattgtttccatgtgagttttagaaaaagtgtgttctgctctttttgtatgcagcattttataaataaatgccaattagatcagttgactgatcatgctgtccattttaagtatgtccttactgattttttgcttgctgtatctgtccatttctgatagaaggctattaaaatttccagctacaatagtggattcatctttttttcctagcagttatatcaatttttgcctcacatagtttgttgctctgtcgttaggcacatgcacattagggattgttatatcttcttggagaattgactcttattatgtaatatgcctcttcatccctaataattttccttgctgtgaggtctcttctgtctcaagtga

SEQ ID NO: 12457 - DNA, 455 bp, Homo sapiens
atgacacagaagtgaagggcctgctcaagctcacaggcccagtgagagagtgagctgggagctttctaccgtactctgttaccttcctgggtacacataagctctaaaacagaagtgtaactctagaggaaggaacaaaatatgaatccaagagttcaggtctatgttttgcattattaatatgcaaattacttcatatatttataacataaattctgtgtgtcccagtgatgacagctaataagatactcattactggtccaaaactggaaagaaaatccgttggcccaggtgaagaagtccagtgaatgcgggtaatgccctgggctgccgaaagagatcaatgacgggtagagaaattcaattcccccgttaaggtgcaagacggtttctcccatgcaggaccgaggccctctggtggaggaacggaggaagtctccgccccgaagaggcca

SEQ ID NO: 12458 - DNA, 58 bp, Homo sapiens
atccaggtgtttgtttctaacttctgtaatacatacaatgcaaaaaaaaaaaaaaaaa

SEQ ID NO: 12459 - DNA, 369 bp, Homo sapiens
acctaaactggaagatcttcttatgttgcctctccaggtttggcttcttgcttcagaaaatgataccaatcataatctctgctccatctattgttcaaatatcaaaatgtcagaagtaggcttcagctgttaatcagctgtattgaatttctgttcttcaggatataagttctctgcactttaattcttatcaaagcabaattgtgaggaatgctattcatcaaagactgcgtggaggactgcaaggccatttactctttagacatgttatttttccctccttggatttttcccttggatcaaatcagactatcagaaatgttcaaacttaaaacatgaagagttccctttccgaaaaaaaaaaaaaat

SEQ ID NO: 12460 - DNA, 432 bp, Homo sapiens
aaaagcaggctgcccgaccctgcagtggcaactggcttgggtccctttctgtattgtgggggttttgttctttcgctctttgcaataaattttgctgctgctcactctttgggtccacgctgctcttatgagctgtaaaactcaccgcgaaggtctacagcttcactcctgagccagcgagagcacgaacccaccagaaggaagaaactccaaacacttctgaatatcagaagaaacaaactccagacgcgccaccttaagagctgtaagactcacctggagggtccgcggcttcattcttgaagtcaatgagaccaagaacccaccaattccggatacattagggtgggccctaatccaataagactggtgtccatataagaagaggaaatttggggatccggcatggtggctcacacctgtaatcccagc

SEQ ID NO: 12461 - DNA, 422 bp, Homo sapiens
agatgaaagatcagcgtcagggaggcagatgagttcaatgtaaggaaaagacttactaacagcagcagggctgcctcgtgcaggagtgggtgccctaccactgagggtatctaagctaagagggaagggtcccctttcaggggtgctggagacaggatcccacactaggtagaactggattggaccaatggtgcctgaacacaggcccaagagtcaggactggccacttcacaaagcacctggagtttactaaaaacagactcctaggaggtcaggcactgtggctcacgcctgtaaccccagcactctgggaggccaaggtgagaagatcatttgaggccaggagtttaagactagcctgtgcaacatggcaagaccctgtttatctgtacaaaatttttttttaaaaaattagccaggta

SEQ ID NO: 12462 - DNA, 325 bp, Homo sapiens
acctggatcaatgggctgccctaatgaaggatatcaaaaatgaaggggcagctaaagaaaaataaaagacacctcagaaagtagcctgcctctttgacaagggacatgccttcagaggaacataacagaaacctcygagaattgtcaacaataaaaagactgagcaacaagggaaactggtaggaagccaaaggttttaagaggtgagagtggagaaatgctgtgcttttattgatcctctccaaaggaacacctttaaaaaagcatgatataaattggcactaatcctcataagagaagaatgtcagcaagccagtgaaggaat

SEQ ID NO: 12463 - DNA, 372 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaraataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcct

SEQ ID NO: 12464 - DNA, 70 bp, Homo sapiens
aaaagatgagttcagcccctttcctttctctctcgcacacatatttgctcgcctttttgtctgccaacat

SEQ ID NO: 12465 - DNA, 287 bp, Homo sapiens
gaggagaagccaaacgtaaagacaccaggagtttctcgggcccagctgtggctgctgccggggagccccaagccttggcgggtccttgcggcgaataggagtctggtcaggcgtcaggctagtccgacgaagagtggagaatttcaagattgtggagttggactgaatgctgcacagttcaaacagctgcttatttcggctgtgaaggacctgtttggggaggctggagtgcaatggcacgatcttggctcaccgcaccctccgcctcccaggttcaagcgattckc

SEQ ID NO: 12466 - DNA, 418 bp, Homo sapiens
aagaaagatgctggctgagatcaaccattcggtttttgacacaggacggcaattgttactgaaacttacctgggcctcctaagacctggcttcttcttctgtggagagagaataataggaacatctgcttcaagattttcataaaggtcaactaagaaatgtgacaagctgtgcatccctacattttaggagttacaaaacaaagaaaaacagttaacaccactccaccaaatgaatagaggaaatttagtaaagatgtcaacctctctgtattggaagaagctccttgttgcttgtcttgaccctgcctcccatcgctgaggagtctagttcacctctaagccaagtaggatgagagtatatttggtgtctgagctcatttttgaatctacttcatttgtgttaccacacatttatt

SEQ ID NO: 12467 - DNA, 440 bp, Homo sapiens
aaccctgccgcggaggcagtgagaggccaccggcctttgttgatctgcaaggtatcaaacttcgaacatgacaagcataaaagcctgcagctcgaggagacagggtgtcacaattaccaggaacttagatgggactccattacaaaggatcatccagatgctgtttaaaattgggccaattcagcattaaaatgaaattacacattcatgggatttgttacgagagtcggtactgttttggagtgattcatatagcatttataaggaccaactctgagagagataaatcattgttatactcagcgtgtggttggaaatggaatcaaagcccagtctggaactcctgaagtcaaagtcaaaggaactgatcctgtgataaatcagattattgataaactgaagcatgttattcagggacatacctgtattgaagtatacgg

SEQ ID NO: 12468 - DNA, 325 bp, Homo sapiens
atagaaaagggacctaactatcgaaagaaaaacaaacagaaagcaacaacaacagcatcaacaaaaaagtccccacaaaaacctcatccaaaggtcagcagcctcaaagatcaaaactggacaaactcatgaagatgagaaagaatcaatgaaaaaatgctgaaaactcaaaaagccagagtgcctcttctccaaatgattgaaacacctccccagcaaaggcacagatctggacaggggttgagatggacaaattgacagaagtaggctttagaaggtgggtggtaacaaactttactgaggtaaaggagcatgttctaagccg

SEQ ID NO: 12469 - DNA, 414 bp, Homo sapiens
agcagttctgaggagaggcccaagtgaagaggaaccagttgccagcaccaccctgtcagctatgttaggcccctgcctatataaacaatttgattaaaaacatatatttaaraattcatcggtacatgtgagatatgatgatttatcattgaagatttaggatgatgggcagagaaaggcaatctgttttgtctattgtccaatcagtgcacgtgaagatttgttacagtatccagaaaagactaaaaaagaccaagcctgttaaacaactccatcaaagaaaaacaaggaagccatccagctttgttctggactcagcagctaagatggcatgagcttcatcgtaaagcatagttctatgtcatgtctactggatgaatccaatgtggctggtcccttaataaaataagttgt

SEQ ID NO: 12470 - DNA, 485 bp, Homo sapiens
tctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtgga

SEQ ID NO: 12471 - DNA, 94 bp, Homo sapiens
actattgtacctcccaacacctagctcagggtctggtgaaacttaattgctcagtaaatattttttgaattaaaaaaaaaaaaaaaaaaaaaaa

SEQ ID NO: 12472 - DNA, 485 bp, Homo sapiens
  misc_feature 373,382: n=a, g, c or t
aacaccagggatgtatagaagccgccatgtaaggacacagcaagaggacggccatctgcaagacacagagagaggcctcaggagaaaccaaccctgccaacacctcgatcttggacttccagcctctagaactgtttgacattggctgatgctctgaagcaaaatacttttcacatgctagtgtctgctcaggccctccaagaaccagactctaaggcctgaaggtttagtccatagaggctcgatcaggtttcgagtgtgccagaagcaagaagaaaatgtgctgccaaaggacactctccaggatggccatagggatacaactgcacacgccatgaagtsactgctgctaaatacgatcatactatatgtnctgtttrgnagtttgtwgtcttcacaaatcaatgtatcttgggagttttaaacatctctttgtgtagaccaggggtcatccaccaaaggccatgccaggtgcagcaaagcag

SEQ ID NO: 12473 - DNA, 450 bp, Homo sapiens
cttttctctgtgatgacaccttgagttggaactttatcctacacttgatgggctcctctcctgagtgggaaggcaaggaaataggggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataagctattctgttgactatccatcaggataataattagttgctgcagtactcataatgag

SEQ ID NO: 12474 - DNA, 217 bp, Homo sapiens
gaagtaggagttcaagaccagcctggccaacacagtgaaacctcgtctctattaaaaatacaaaaaattagctgggcgtggtggcgggcacctgtaatcccagctactcaggaggctgaggcaggagaatcacttgaacccaggaggtggaggttgcagtgagccgagttggcgccactgcactccaacctggacaagagcaaaactccgtctcaaa

SEQ ID NO: 12475 - DNA, 335 bp, Homo sapiens
aaataaggaagacttgtcgggaacacaggcagggctcaacgtcattaaagaggcagaggcgcastgtggtgggcagccaaggagctgagaagaacgaagaagctttcagactacgtggggaagaatgaaaaaaccaaaattatcgccaagattcagcaaagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataattta

SEQ ID NO: 12476 - DNA, 478 bp, Homo sapiens
agattgctctaaattttatattctaatattgtactattaaaaaccatctgttgtttaatgttcaaaaatcaatccagataatatgaaatccattgagctatttctaaaaagtgattgttaatttcagtaacatgccattttgatttttagtggattatcttgatggatctctgcctaaaagcataagatcaaccgaaccatgtcatctgaatagaagctagtgaatgggattgggtgcagtaaaatggaaatcctttttaatgaaagataagagctgcatccttacctctcaacctttcaatcctttcatttgaggatttaggaggaaccatctggattgtaacagcaagttcttttcaagcacaaaagttccaggagagagagaatatagatttagtattattcctcctggcattcctcattctaacttttgccatcacctgagttccagcattggggaagacaaaagcaccagggt

SEQ ID NO: 12477 - DNA, 473 bp, Homo sapiens
ttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatcta

SEQ ID NO: 12478 - DNA, 460 bp, Homo sapiens; identical to SEQ ID NO: 11164

SEQ ID NO: 12479 - DNA, 437 bp, Homo sapiens
atgtactaggtctttaataaatggtagttcccccttagtcacccatcactcttagaagtcaagacacttccccttctccctttttgccctctctcccagaaagccaggcaaaaggcaggaatgaggagcagcggatagtgacaaaaaggggcttggaggaggggttttgcgmcctgmccttgaatgtccgtctgatgtacaaaacagtcgttttcttaatcttatgcaaaggactatgagcgtgcattttcaagccctactaccaccaatggctgtcgctaacccacccaccgctcactatagaaattttggatcctcgcttcatgtataagaaacaggttgamctttctctagtccagagggaagcaaagggscagtcttggsgsggcttaacctgaacaaagttcaaaagtatttscttgacctccaagaaacat

SEQ ID NO: 12480 - DNA, 60 bp, Homo sapiens
aaaaaaaaaaaaaaaaaaaaaaaaaaaaaaaaaaaaaaaaaaaaaaaaaaaaaaaaaaaa

SEQ ID NO: 12481 - DNA, 459 bp, Homo sapiens
acattagaatgtattccacaacagggagacagcctgacaaagaaacattattcttagatttacaattaattacccttatgtctataccttgcattcaatttgcatatcttaagagcgctgtaaatttcacaggactccctgttatttaagatcactccgcttagtaaaagtttcttcagtgataactttttcttgattatgtagttgtgaggtcagtaaatctggctctactttgctctcccatgttataatttttcctttttgtgtgtgtttttcattatttggcttcttgttccttctgccccctcatttattattccccaaagagccgacagatagagacactggctggaagacgaagcgagtagtcgcagtctgagatgttatcttttccccactacgcattggtactgggtgtctgacatgttctatacatctttctggtgccaactcattaaa

SEQ ID NO: 12482 - DNA, 438 bp, Homo sapiens
agtagattagttgattctcttttcaggtgccgtctttgaattttccacactcttggcgcatgcgctcagctccttggatatcaccctgacattgagcccctggtgctgtgcttgggactgagggtaaatgacacagtcagtgtccccaaccccaccgcatggcaaaacaaatgctgacacttctaattgccttttgtcagccggggaagtgttgaatattaccaggatttcaggcaaaatgactgggtaagagatgacttgatacctgacttaaaagaggacaccctgatgggcagagcccaactctgactttgctctggcttgagacagtcctcagacagttctcttgggtgaggctgccagataaaacacaggatgcctagttaaattttaatttcaaataaacacggatttcttttttagtataaaaaaaaaaaa

SEQ ID NO: 12483 - DNA, 486 bp, Homo sapiens
tgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttc

SEQ ID NO: 12484 - DNA, 489 bp, Homo sapiens
  misc_feature 265: n=a, g, c or t
cattcggttactgccctttaatacastcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttstgaaaaaatcatacaactttgtgcttctattgnttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaastattctgttttttgtactttaaaactatgggggaaatatcacaggtctgtc

SEQ ID NO: 12485 - DNA, 483 bp, Homo sapiens
catgatatatagtacttccttttatatagaaaaaagctcagtgtggaaagaacaacgtatctggaattaagaaacctacattcgattcacagttctgcaggctttttcatcagcttgctgggtgactttgaacaagtgactttacctttaggcatcagtctcttggtgtcccaggggctgcaaagtgggacagagaagatgaagggaaatacttcaatttgctcctgccccttcccaccaccttcaactggaactcctttaactaattaacaatttggagttcatgtaaggatttctttgggaaaaaaagaagatcctgctgttaaaatcaagcttgaaaaactttgcactagaagagagctccagaagtttggcaaaagacatattcagtagccacttaaaaagtccctgtagtcaaccctacatctctttgctaatggaaattttggatagagaaacctgggtctgtgagatccactgatg

SEQ ID NO: 12486 - DNA, 385 bp, Homo sapiens
atcaacaacatactctgaatttaagaatgaccaccacacagtaagagaactggaatttggaggaaaacttcagctctgtgaagtgtagttggctgaaacaaacttctactagtgagagaaactctccctgcagatgctatgctgaagagaaagtacagttgcttcttcctgcctgccttccagtcctctatgccctctgttgacaaaaattaactggaagccagatggcaaaggtgtctggggaatgtagtttgcagagttcagtcacagcaccatagatcacaaaagagtgagtttgaaactaaaggaaaataagtagtagctgatggatgctgtctccataaatgttcaaaaggacaccattaaaaaaaaaaaaaaaaaaaaa

SEQ ID NO: 12487 - DNA, 455 bp, Homo sapiens
ttttaaatttcagttatgttgtctgttttactattgacagacattgttaagtataattcaaaagtaaagaagcttagaatataaacagggatctggatgtcattcagcagaagtgctctctagtcatgaagaaaatgaagcttggctatgaagtagaagaatctttctatcaaaaaataagaacgttggaacttaggatccaatagagtcgcacaatagtcatataggtgattttacacttacttcattggggctgtcatggctcaaatatatttgtgatccttttcttggaaattgctttcagagccagtttgcaggatgcccctaaaaataaatatgcacttacacttcactgtaatccaaaacctatcactctgattcattgtgcacaagacttggtgtcaaaattaaaattcagttaataaaaagggtatttgtcataattccaaatattt

SEQ ID NO: 12488 - DNA, 509 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacaggggtctcattatgttgcccagggtggtgtcaagctccaggtctcaagtgat

SEQ ID NO: 12489 - DNA, 380 bp, Homo sapiens
gggggtggcaatgaagacactctgtctgttgggccctagaatttaatgtggatttcctccttccttccaagttctgagattcttaaatgagagctggctgtcttctagagggagaggagatgcccctggggaagggtcagtcccactgacactggggcctgaagttctgatgaggaagaggacccatggcgggtagtgcagaccggctcatcctaccatcctatcatagagccttgatttcaggtcctaaagtatattcacaacacttcaggtgtggaaatgagaagtctgggtttctggaaattacagaaatcaagtcagaaaaacctggcaaaagtaataatactctgtgttctataatttgccacagtcacctcatt

SEQ ID NO: 12490 - DNA, 299 bp, Homo sapiens
  misc_feature 133: n=a, g, c or t
gtcgcgtgtgagcatgcgcagagagactgtgggcgcgtggtgcagtccctggagggttctcacgctttggctgtctggacttttaagtttttccgctttttcaggaaggcgaccggcagcctcgggcaggggngacaggactgtatgtcagagaagagacggcgcttggacgccagggaatcctctgaagcaggagactgccctatccaggttacccttcccgaggggaaaccagggtctccttcagaaagctgaggcasgccgggcgcggtggctcacgcctgtaatcccagcacttt

SEQ ID NO: 12491 - DNA, 393 bp, Homo sapiens
  misc_feature 114: n=a, g, c or t
agatatgscaragagaagccatgaagtgcatcttttaaattaaaaggtgaaagttctcaactgaattaaggaaagamaaaaatcatatgctgaggttsctaagatctatggcangaatgaatcttctatctgtgaamtgtgaagaaggaaaatgaaatttatgctagttctgctgcatatatagggttcagtattatctgcagtttcagcctacctattctcccagagggcatgcattctatggagacagagctgaatgtgtgccatcagaagaccaaratcaagcgacattttaaaaagamaacagactcttctgggawaaatggtgactccacaaagtaagaagccaccaagacttgtaggacattccttcatcttctcctggatggggca

SEQ ID NO: 12492 - DNA, 469 bp, Homo sapiens
tccgcctcagaccgatccctcgctgttgcgcctacggggagcagcaaccttggcatttggaaataatccccagcttaaacttttctatgggaaagatttgtgtcttgtyatattgggtcctcctgagttgtcacttgcaggctgaagaacctaaaatgaatttgtaatcctacaaaaaggcaggtcccccatggaggttttgaacgcactcattgaagagtagctgtgggctgtgtaataaggtaaacaagattcattgctcatggttctcttcgtttaagacagctccaccagccacaaatagagtccccgagagagagacggagagaagctcttctgagaaatggtggcaaagacatctttctggagtttttgttttgttttgttttactttgctcaaggtgaagaatccaaattccccctcccccagctagagaaatacttctgaaataaacatacattccgccaa

SEQ ID NO: 12493 - DNA, 436 bp, Homo sapiens
agattagttctgtattctagtatttatgcctcttactaaagtbbgaacggcgaagatgtccaagtccatgctaacagaaaggagcagatctcaggaacctgaagaaactggcacacaatagaatctataaaagttcagaaatggaggtcatatatgtctctttcaagggatttcatgagacttaccaaatcaactggacaccaaagtttggccaagataacacataaaattagccatcacaaagactaaatgaagatggcatctactggtgatatttaaaattactaccaaagtaaatgaaattcaaagaagtttctattttatgacaactgaaagtaagtgtggaaacaagaagtcctccaaaaaaatcagagataattatgacataaggagactttggtcagaatgaaactgactaaccgaagagtgtcatcag

SEQ ID NO: 12494 - DNA, 458 bp, Homo sapiens
aaaaagccatttttaaaaatcacatttccttttgttggcttgattaaattgggtaccaataagattaacaaatcttgattaggttaagattagtataaaagacctttcttccagtattcaatcatttagagcttgtcttcggtgctcaactttagttatcccagatcactgaagctgagatggctgatgaagtaatttgcagtgaaattttaagcgactgtgactctgctgcaagttccccagatcttgaggtaaggaattgtgagaaaaagtgggggtgaggggaatagtggggtataatgagtcacttttgattttttggtttgctaatgaggatcttctcttgtccaaatccctcggccaaccatgtttgtttaactttttggttgggctatatgtatctttcgaactgtaggttagtgtgcccacaaaaatttctcttgcaaacgtacactgcc

SEQ ID NO: 12495 - DNA, 230 bp, Homo sapiens
agggattttttaattttaagctatttgtctgttaagtatataataccaaaacgcaggttgtttaaattaggatttccaagtaatttacgtcgtcttcaaaattcctggggtctatcaatcagaaacgccagaaagtttgtgtactagtttcacattgttaagggagtatctataataaaattcaaatgcgttattttaaaaaaaaaaaaaaaaaaaaaaaaaaaaaaaaa

SEQ ID NO: 12496 - DNA, 494 bp, Homo sapiens
acaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcactttttccctaccaggtccattaatatgcttataaca

SEQ ID NO: 12497 - DNA, 468 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggagaaataaaagcctctacaaac

SEQ ID NO: 12498 - DNA, 454 bp, Homo sapiens
  misc_feature 447: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaactaagcttcataagcgaaggngaaataa

SEQ ID NO: 12499 - DNA, 146 bp, Homo sapiens
aacgattgtaaatatgtatttgcccaatgttggaacacctaaatacataaagaaaatattaatagaactgaaggrtggaacaaatagtdacacagtagtagtaaagggacttcagaccccactctccacaatggrtaaatcatcca

SEQ ID NO: 12500 - DNA, 127 bp, Homo sapiens
gtttgtttgttttagatggrgtctccctctgtcacccaggcggaggttgcagtgagctgagattgggccactgcactccaccctgggcgacagagtgagactcggtctcaagaaaawaaaaaaaaag

SEQ ID NO: 12501 - DNA, 129 bp, Homo sapiens
agatgggactgtctagttgcaagaaaacaagctcagggctctcactgattctacattatggtgagttgtattcattatatattacaatgtaataataacagaaataaagtggcacaacaaatgtaaaaa

SEQ ID NO: 12502 - DNA, 510 bp, Homo sapiens
tcatgttaatttcttacctgttagatgtttaaactgcagtgacctttacttgtatctactctgtggtggaaatgttaaaccatgatagcttttgctaccaactcaaccacttaacttttagagcagttttggggagagtttatgcttcatctgagtttagaaagtaatgtcagaaaatgttaagcatgtctgtattaagaaaaatataaggtttctaattgtcttattaatatggtaattcaagtgaattagaaatatttaactgcaatcttgaattataaagttgagatatatatatatatgtatcaagatctcaacttgatgtaaagtaaatgagcagttacctggcggatttttttttttaaataactgatttaatccataatcccataacaaacatagcttcacctcagtattttctttctttctttgttcaacagtgctccgataagggaatgctagaaaatagatgagaagtactgaaagacctttttttttaattgattagaa

SEQ ID NO: 12503 - DNA, 276 bp, Homo sapiens
attctcctgcctcagcctcccgagtacctgggactacaggtgcccaccaccacgcccggctaatttttttttttttttktwttttwagtagagacagggtttcaccgtgttaaccaggatggtctcgatctactgacctcgtgatctgcccacytcggcstcssagagtgctgggattacaggcgtgavacsgcgcccggccctgactattkggaaaawttctaaattttttkgtcccctcaawtsatgtaacagaacagtaagctgctawktata

SEQ ID NO: 12504 - DNA, 470 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacagggtctcattatg

SEQ ID NO: 12505 - DNA, 462 bp, Homo sapiens
ttaggacttttttcaaaacgaaccttgaaaaacttcttcaattttttttttttaaaagctgttctattaaagggataatatagtgaataaatatttgttgtctgtttaacttaccttatgtagagctattggctctaaggattttgaaaggacaacaataattctctaaaaataattcaggcacctttggccatttgtgtaaccaggtacaaattaccacgtttcccagtttcccccttgagtccaactgtaatgtattgttctgtaaagtatagtccagttgtcagctctgtttgccttggtcaattgaatgatcctcctccttaagcttagcctatagtgcatttggcttaataaatgaaactgtaacatgccagccacacaatagaggattttatagaactgtttctgcttggaatactataattggaatttgagttaactataattaaaaaagctttc

SEQ ID NO: 12506 - DNA, 134 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaaaaaaaaaa

SEQ ID NO: 12507 - DNA, 419 bp, Homo sapiens
ggcctggttctagcccaagcacagtctccagcttaaggaatgaccttaagcaagcacttcttccctcagggcaacatttaaaaaaataagaagattggattgatcaacattttactgcctgtatttcacaggacattctccttttaatatatttgcttgaaccttcttgaaaacaggactccatggacaaataaggtctaacaccagcaatatttacacaccgaagcacgagtatggccatttggggggctgtgatattgttattgaggagttttccagagataactagacaagagctagaaaacaaaggaaggaactttagaagctcacaggtatgtaactgaactaaaacaattaactgtgtactggaaaagaaaagaggaatttattaagtatctacttgtgccaataaacaagac

SEQ ID NO: 12508 - DNA, 455 bp, Homo sapiens
taagttcttggcattgctgcctgatccaatggagcaagattataggttaccccacctgaacatcctcctgggaggaagcagggcatgaatccgaagaattagtgaagtccttccatagccatccttgatggtggagcgggggtgtgtctcagcaaaaagtgattttacaggtcgtttattttggatttatgagcatcaacacgttttaagaagggctgaagtataaggtgctgggaccagttgtcagtaaaggcagtatgattcaatgaatcaattaaatcaggatggagaagggaagcaaaaagtccaagccagataagtggaactacccatgaaactggagggtgtggtgaacaaaagcaaaatattagtcacaaggtcaggagcaagctttttgacaggaaaaaaaaaagaaaaattctgtggaaggcagcttcgagaagacataatccatg

SEQ ID NO: 12509 - DNA, 445 bp, Homo sapiens
aaaggaacgccaaacaaagcgggcgccaggagggggcttcccaggtagatgtcccatctctaaaaatactcttgactattggaaacgtgggcaccagtacacacagctgatgagctgctctaagccagggcttgcttccagcaactcccctcacaccaaatgaagagggttttgttatgttggttgttgttagtgaaaggtttctgttttgttttttgttttgtttttgtttgtttttaaacactcttgttgggtcttctacatcctatattatcttcctaggagaaaggttaattttcatttcaaaaatgcgtgtgctgctgcacaaaactcatagtgcttcatcctaaagatttttttatgtccaaatattaaaatactataatgattctttaatggaataaaatgtttgtccaattaaccaaaaaaaaaaaaaattsccaaa

SEQ ID NO: 12510 - DNA, 458 bp, Homo sapiens
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcgtatctcagctcactgcaaccaccggctcctgggttgaggcgattcttgtgcctctgcctcccaagcagctagaattacaggtgcgcaccaccatgsccagcactttgggaggccgaggcgggcggatcacgaggtcaggagatcgagaccatcccggctaaaacggtgaaacccgtctctactaaaaatacaaaaaattagccgggcgtagtggcgggcg

SEQ ID NO: 12511 - DNA, 238 bp, Homo sapiens
agaactcccggctcagagagttctccaccgctcctcccaggctcacgaggctcacgggctacccagcgccascccaggaggctggaccacagactacgaagctgcaccgtgtggggcccactttttatacaagcgggtggcggtggatccaggcgcacagacgggagtgaggcgtggcggagacgcgtgcacgctgggtctgtgcacttttgctgctgctgctttttttttttttttt

SEQ ID NO: 12512 - DNA, 442 bp, Homo sapiens; identical to SEQ ID NO: 10991

SEQ ID NO: 12513 - DNA, 406 bp, Homo sapiens
ataaagaggtgcagggaaaagacaagatggcctaagaccaagctctgaggaactccgacatttagaggtcaggtggagaacaagttgccaaaggagaagccggcgaactaagaagaaaatcaggaggatgcggacttctggaacccaaaagaaaagagtgttccaaaaaaggaatgggaaactgtgctgaaggctgcagagacatgaagcaagcctgccctgagaagtgtgcagtggattgggtagaagccactgtagctctgcctacggcatttgcaatgggcgtgctggcacctgcctgtaatcccagctacttgggaggctgaggaggatcgcttgagctcaggagttcgagaccagcctgggcaacatcacaagacctccgtctctaccataaaaataaaat

SEQ ID NO: 12514 - DNA, 233 bp, Homo sapiens
agctgattgtaaaccaccttctaaagaggaacaaaacgagactacaatttttttatggatgacaaaaagttttagcacagtcaagccaaaattgactaggaaattttgagtacctttgtggcacacaaggattttatgtaacaatcgtacactaagtcctgtcagaattacaggagttttaaaataattttggaacacataccaataacacatttatacaaaaaaaaaaaaaa

SEQ ID NO: 12515 - DNA, 406 bp, Homo sapiens
agcttgacctctggaggcactggagacaaagatcagccacgtggcagtcaaccatgtctatctgaccaagttccaatgaaaactctggacaccaaggcttgggagatatttctcaaaagactcctctgcgggagaggagaatagagaaagaaagaaaacaactgtgtaagcagacatcagtgtaaaccttagcactgtctcttgatgagaataggaggatggcagtgacaggagtgtggtggcgagccagtcacctgcagtcaaccacggctcattgctctcaccatgcctgttacatgaaggtatgtatgtataggaaaaagcactgaaaaactctccagtttcaggcatccactggggatcttggaacgcatcctccaaggataagtggggtctactgtacaac

SEQ ID NO: 12516 - DNA, 75 bp, Homo sapiens
ttttcctaaaaaaaaaaaaaaaaaaaaaaaaaaaaaaaaaaaaaaaaaaaaaaaaaaaaaaaaaaaaaaaaaaaa

SEQ ID NO: 12517 - DNA, 399 bp, Homo sapiens; identical to SEQ ID NO: 11121

SEQ ID NO: 12518 - DNA, 118 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaa

SEQ ID NO: 12519 - DNA, 495 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacagggtctcattatgttgcccagggtggtgtcaagctcca

SEQ ID NO: 12520 - DNA, 240 bp, Homo sapiens
aacaacccgctctgattctcttccaaataatgggaaggttttccccccgtttttacagtaagttttgctgctaatcactttggattttcactgcatttatgagctgtgacattcactgtgaaggtttaaggttttgctgttgaagctggcaaaaccacaaaaccaccaagagaaactaacagttccacaggcactgtcttaagagctgtaacacccaccatgaaggtctgcagtttcact

SEQ ID NO: 12521 - DNA, 527 bp, Homo sapiens
tttctcatttcattttcacttttcttatcaacaggccttttttggccaccttatctaaaatagacaccacttcatcactcagtatcccattacctattttactttttcttcatagtacttacttctatctaatattttattagctattactattgtttgtctattatctccccaaatagaagataagtcccttgaggacagaagtttattcctcatgttcgctgttatctgcccagtacacacaggtgtaacacattcaatatttgctgaatgaatcatttattagcaaggttaaagatgggttggggaaaataatcctctacccctatagaaatgacaggtagagctctctaagaaatcaccgaactgtatcttcaagtcatatatttcagtgactttacaaacacagccattattggctgaacgagtcgatagggtcaggcatttttttcctggttaagtgaaaatagcacttcaagggaccaaaaacctaaagtttcagccctggttctatgtttgtttactga

SEQ ID NO: 12522 - DNA, 531 bp, Homo sapiens
agttgagtgtgaagacctgaggtatcaggggtaggggttgctctgcttgtgtaagtcccatagtgtgaaggccagagaaccaagagatggtcaagaagagagagtaagtgtccaatgtcccagctcaagaagagagaatggtgaattgcactctgaagagcttcctaagcttgtaagaaagtgattctgaaaagctcaacattttggtagaatggagagatttgacattgcttctgctccaaaagcaaaagacttgggaagggcacctgggagttgagaacatccaccacagagaggcctggcgtaaaggagatgggactcacacccaagaggatgcatttccatacacccatttctgaaatatgaagagcccagaagctaaaaaatcacctgccatcttggaaataatccctggaggatcaagtccatgggggagaagtggactggtcaccccagccgaggttatctaagttccatggcttactccagacaggragcccacatcctgcagctcattcataatccataata

SEQ ID NO: 12523 - DNA, 450 bp, Homo sapiens
tttatttatttatttttagagatggggtcacactatgttgcccaggctggtctcaaattcctggactcaagacacccctctgccttagcctccctaatagctgggactataggcataccctagggtgtcttggcctttatctatatttagctattagatacctgttatcttcctgtatcggtaacacgaggtgctctcatttcttttattactgtgtactattttacaatattataatctgttggtggacatttgttgtttttaagcagtgccatcataaacattctgtttatattcacttttttatacttttatgtctctttgtgaactaaatacctaaaactgattgttgagttgagtattgcagaatttgataggctgccaaattgtctcataaaaaggttattcctatttacattcccccaaatgatgtaatgaaattacccttgt

SEQ ID NO: 12524 - DNA, 205 bp, Homo sapiens
attaaaatcaagactttgggccaggtacggtggctcacgcctgtaatcccaaattgctgggattacaggcatgagcacacaccctgcccatgtgttccctcttaatgtatgattacatggatcttaaacatgatccttctctcctcattcttcaactatctttgatggggtctttcaaggggaaaaaaatccaagcttttttaaa

SEQ ID NO: 12525 - DNA, 448 bp, Homo sapiens
cttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagag

SEQ ID NO: 12526 - DNA, 415 bp, Homo sapiens
aagaaataaaactgctatagatattcatgtgcaggatttatgtggacatgttttcatttatccaagataaatgctcaaggggctaattgctgattcttaagagctgkgaggccgaggagtggtgcaagcacctctgcatggagtgtctggggaccaggctcaatgacatcagccttggggagcccgaccttctggccgcagagtgcagcggaacagaatgagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgt

SEQ ID NO: 12527 - DNA, 312 bp, Homo sapiens
  misc_feature 309: n=a, g, c or t
atttagctcccacttataaatgtgaacattcggtatttggctttcttttcctttgtaagtttgctaaggataatggcctccagctctatccatgtccctgcaaaggacatgatctagttcttttatgtgactgcagagtagtccatggtgcacatgtaccacatttttttttaaatccagtctgccgtggatggacatttaggttgattccatgtctttgctattgtgaatggtgctgcaatgaacatgtgtgtatgtatttctttatggtagaacaataaatcacaataaatggctgtaaaatctcanaaa

SEQ ID NO: 12528 - DNA, 472 bp, Homo sapiens
acaagttccctaacaccagcatgtggcaagccgtctatcatctatggagactggctgagcttgttatgatgcagacatgacagattgtaacgtatgcccttttggtattttctctgtaatcattcaggaactatgagattgtttcatttcctgttgtaaaaaacagcagacattttctctgccttgcatgtaactatatcggtgggagggcattttctaaagaaatcatattgaactcttttcttaaaaaaaagagatttcactgaagttaaaacaagaataattggtaggcttcctttttgcctgtcttgaagcaaaataaaatactctatcctgttttaaagatctataaacagctcagctaatagaaaggggatgggcaaaaaaaataataaaaagcattaacttctgaattttagcagaggcctatatattggaataaagaaaatgattcataaaagttctttgatag

SEQ ID NO: 12529 - DNA, 483 bp, Homo sapiens
acaggcaccctggtctcacttgagggtcaccaccaatggggatcattccttcagcattcactctcagtattcgtgtacccttgtgacaatgccacagacccatctctttcccaatacatctaagcatattcctcactgtttatctcttgtctgtacaacatcatcaaccagaaacagtttcccaacaggttatattttcttaatggtagtcatgaagtcaccccacctgctctaagttaaaacagagcttaagccttttccacagaacatggcaagataagtttatggtcagggttggttggtgatcctcagtgttgctgcgcagtagaaggttttgtgagcctggaacttgggagactgttcggtagcccaggtctcctaagagtgggtgcagtggctgtgaccctgggctgctcagcattcatgtggaaatgaaggaaggaggactggatcaatcccatttgaaagcatccttctctgcag

SEQ ID NO: 12530 - DNA, 53 bp, Homo sapiens
gtgtcatgagaatgtaagyttttttctactttaawatttagtaggttcactga

SEQ ID NO: 12531 - DNA, 302 bp, Homo sapiens
attctggcggctgggcacagtggctcaagcctgtaatcccagcactttgggaggccgaggcgggcggatcacgaggtcaggagatccagaccatcctggttaacacggtgaaacctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaaaaaaaaaaa

SEQ ID NO: 12532 - DNA, 465 bp, Homo sapiens
aaaatagttaatagtaagagatataatttgtagcttaggaaagaagtcagagtcaaagacaatgatttgggtgttacccacacacataataggagttgttgaavttacctccaacattcatgtcagtgattcaccactctccatgaagagctgaactggcacaagtggcaacgtatgttactgatgtaattggcacaaaactgttttcttattatctccttcactgaagccctatagccaaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaaaaaaag

SEQ ID NO: 12533 - DNA, 445 bp, Homo sapiens
  misc_feature 73,370: n=a, g, c or t
ttcaggggttgtattataaaatatgcactggctgtggtttttcataagatgttttgtggctttttaaagaagngtcttactccctctkctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctaygtaagcacactgtctttctggatggggacttgtattttaaataanttatcattccagctatgttggactagggtccaaagcattttataatatttttttttaatctaggaaaaaggccca

SEQ ID NO: 12534 - DNA, 106 bp, Homo sapiens
aatttttataaacttttgttctttcttgtaactttttatcagtcagctattccaatgaagcaaaatctgataatatattgcttttatactaaaaaaaaaaaaaaaa

SEQ ID NO: 12535 - DNA, 440 bp, Homo sapiens
gcaaatcatttgggtcccgtcagtattgtggaagctttgttcttttactttttgcagtaaatgttggtgctggtcactctttgggtctgtgctgcctttatgagctgtaacactcaccacaaaggtctgcagcttcactcctgaagtcagcgagagcatgaagccaccgggaggaaagaacaactctggacgcgccaactttatgaactgtaacactcaacgcaaaggtctgcagcttcactcctgacgtctgtaagamcatgaacccaccagaaggaagcaagtctggagatgtccgaacatcagaaggaacaaactccagataaaccgtctctaagaactgtaacactcactgccagggtccgcggcttcattcttgaagtgagcaagaccaagagctcaccaattctggacacagcaccattattcacaacagccaa

SEQ ID NO: 12536 - DNA, 193 bp, Homo sapiens
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttc

SEQ ID NO: 12537 - DNA, 347 bp, Homo sapiens
taaaaaaattcaagtttttctgaggaagcagaaaatccattaagcacaatcagatggaaagtcttgtctctgtaaaaataagcaaagttacatagatgaagcttggtattcctcttacttttgagtgggtggcattcctgttggagaaacatctcaacacaaagttattaccaacactactagcaagcagccattcacccacatgagtgtttggagggttggtgctatgctcacaaaatatgtggatgactaaatgctactgtcagcttccaaagagacatttagaaacattcttgcagcaaatttatttccactcctaattttaaaacaccagcgaaaacaaaaaa

SEQ ID NO: 12538 - DNA, 421 bp, Homo sapiens
ataggaatgcaaatagttaatagtaagagatataatttgtagcttaggaaagaagtcagagtcaaagacaatgatttgggtgttacccacacacataataggagttgttgaaattacctccaacattcatgtcagtgattcaccactctccatgaagagctgaactggcacaagtggcaacgtatgttactgatgtaattggcacaaaactgttttcttattatctccttcactgaagccctatagccaaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaatgaatctgaata

SEQ ID NO: 12539 - DNA, 103 bp, Homo sapiens
atgtcgggtcgcggggtctcgcggcacatggcggactacctgatcagcggcggcaccggctacgtgcccgaggatgggctcaccgcgcasagctcttcgccag

SEQ ID NO: 12540 - DNA, 477 bp, Homo sapiens
aaaaaaaattatcccctaagaattagtcatcacatgctttccccctcctaggttttggtgaatcccttagcctcaccccaatttctatgtttctgaaatggagtggttgtgaaaattaaatgagttcacaaatgtaaagtgcttgacacatggtaagttctaagtctgagtgagatgttgttgttatttattatgtaagaaattgagagttaatggaactttttaagtgaggactacccagtagtgtgctcatggatgtttaacaaccagctctccaagatgccggagaggaccctggcttgcagtgtttgctgatttccatagtgtaaatactsccaccatggccagtttcaaactaccaacctgctgccacaagcatggagttgagaagaggtgcacacggtcagctttcatgagcgggtggcagctggctttgtcatattgctgatgctacaggactagcttgtagccatgctg

SEQ ID NO: 12541 - DNA, 473 bp, Homo sapiens
  misc_feature 385,393,453: n=a, g, c or t
gaaacagatccaagatgttgtttgagccatgcaactagaagatctcatagaactaaagttatctaatttacagaaaaggttttacgtgacgtctattgtacagattcatatgaaaaccatagttcaaactccaaggtttaagaagtaagaaagatcatgccatttgcaacaaacatgcatgcatatttgaaaagcaactatctgttgtgggaaaactagaagaccaaaaaaagcacgaaagtcaagaaagaagtctcttttcacatgaaagtggcctgaagacaaatactgctatgaatggttacatctaggacttctgaaattagccccagattcaactcatttttttctgcatttgctgagcaatatgacatgtttacaccgnttagctanaaagttatgtgaagaatgggcaacaatatctctaaggcagatatgttcagatccaatatngttcatatagaccttgtcag

SEQ ID NO: 12542 - DNA, 266 bp, Homo sapiens
gtccttttcacscaataaaccctgccctactcaccctttaaagtgtctgsaagcctaatctttcctgatcctgsgasaagaacccggtttttcctacaacatattgtytgagaaacataaggcttgagaaagggcttcccaaaatcaaacttcagtttcaaaattgcctttcctgacgccaggcttttccgatgcttcagaagggcctctggagtatccagaaaagaggtaaacaggattatgtgacatgtttacttacataggat

SEQ ID NO: 12543 - DNA, 315 bp, Homo sapiens
atctcgttcacacgctctgtccgccatgtttgtgagtggtwkkckgstcattaccccttcaagcgactgaaggctgcagggcctctggtggccgcatgggagaccagacccgccagcccgcctttccgcactcagtccgggcttactttattttgtgagacagggtctcgctgtgttgtccacaccagagtgctgtggggcgatcatggctcaccgcagcctccacttcctgggctcaagggatcctcctgcctcagcctctcgagtaacttggactacaggggcgcgccaccatgcctggctaatatatatata

SEQ ID NO: 12544 - DNA, 476 bp, Homo sapiens
agataaatgctctacagaatgtgtagttagcgccttacagatatgagactggaccttacctgaaactctctggttcccttttccaaatctataactataatcgcttaaatcactacagagtcaataataagaaaacctttgtagtcacttataagccaacttataactgagaacaagacagaaatccacaacttacatctgttggaacttgtagctcttctttggtatattcatgaactacctggattaaatcttttggaaaatatccaaaagtgcgtccaacctatacaaaagaatgggcaaaagggacacatatcaatcaaattctgtatgagaaatatgaacgatagagctgcaaacctcaatctacagcacatatcaagcaatcaactttttcttgtaatgtcattacttttctccgctatttgagaccacttccaacatcactagtgacactttgtatgggtcccagagtg

SEQ ID NO: 12545 - DNA, 443 bp, Homo sapiens
aaggacattttcctacctagtcaaaatacaaccatcaaaatcaggaaattaacattgatataaaacctctatataaaccttggaccccattaaagttttgccagttgtcctaggaatgttctttgcagcaaagtgatccagttcagaatcgtgggttgcatttggttatcaagtctctagtctcctttagactttcctcagtaaacgttccttggcattcatgaccttgatacttttgaagattacaggctggttattgtttagattgtctctcaattagggtttgtgtgacattttctcatgattagatttaggttgtgtagcttcaggaatataacagaaatgatgctttgttcttctcgtcgtgtgattttgatttatcccattattgataatgttcactttgatcacttgattaaggtgatgtctgccaggcttctcca

SEQ ID NO: 12546 - DNA, 488 bp, Homo sapiens
  misc_feature 334,353: n=a, g, c or t
attatttgaccaggttctttattctgtggcagcctttttgaacctccttctacagatagctgttattggaacactgtgcttttgtactaactgaagtttgcggaggagtacatctggagctgtgagagaggaaatgtacactctttattaagcctactgtgtgccaggcactggtactgggcattggaaatacagtggtgagcaagttgttgaaattacctccaacattcatgtcagtgattcaccactctccatgaagagctgaactggcacaagtggcaacgtatgttactgatgtaattggcacaaaactgttttcttattactcctdcantgaagccctatagccahrnttgcaacaaggacagtgtcagagcaggctgtaaaaaatgtggctaccctggtcacctgacttttgaatgccgcaattttctccgagtagaccctaaaagggacatagttttggatgtcagcagtacaagtagtga

SEQ ID NO: 12547 - DNA, 146 bp, Homo sapiens
tgaagtactaccagctcttcttagactccctgagagacccaaataaagtattccctgagcatataggggaagatgttcttcgccctgccatgttagctaagtttcgagttgcccgtctctatggsaaaatcattactgcagatccc

SEQ ID NO: 12548 - DNA, 104 bp, Homo sapiens
atttaggggcggttggctttgttgggtgagcttgtttgtgtccctgtggaggacgtggttggtgattggcagttttcgcattttttttttttttcctttttttt

SEQ ID NO: 12549 - DNA, 194 bp, Homo sapiens
agttttgggagctttaaaaccatttgtgactgacacattattgctttccaggaagtggtagggatgacaaaaaagcatattccaacagggctttggagaggataaagtccaagaagtactgaaaccaagagtcactttaaatttttaagaatctttcattttaaagattaagtagtagtccacataggaatgca

SEQ ID NO: 12550 - DNA, 414 bp, Homo sapiens
aaaaatgtttgctcctaattgagtcttctgtgagaaggacatttcttactgcagataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccata

SEQ ID NO: 12551 - DNA, 195 bp, Homo sapiens
caagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttttatgttcgtaaacttttctgtaaagaaagacacaaggacttttcaaa

SEQ ID NO: 12552 - DNA, 450 bp, Homo sapiens
agggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttt

SEQ ID NO: 12553 - DNA, 419 bp, Homo sapiens
aagaacattcggattgtggtgatgaacaatcttttaccaagatcggtaaaaaagcatatcaaatatgasctcaaaggctcaasctacaggcggcgggcttcccggaaagagcgaaagaagcctcttcccacatttaaagacctaaacttcttacaagacatccctgatggtcttttttttggatgctgacgtgcacaacgctctctgtaagaccctgcagcgtgactgtttggtgctgcagagcttcaagataatggattatagcctcttgatgtcaatccataatatagatcatgcacaacgagagcccttaagcagcgaaacacaatactcagttgatactcgaagaccagccccccaaaaggctctgtattccacagccatggaatccatccagggagaggctcgasggggtggca

SEQ ID NO: 12554 - DNA, 307 bp, Homo sapiens
tttttttgagacagagtctcactgtgtcatccaggttggagttcattggcgtgatcttggctcactataacctccaccttccaggttctagcaattctcatgcctcagcctcscaagtagctgggattacagacccgcaccaccacgcctggctaattttttttatttttggtagagatgaggttttgccgtgttggccaggctggtctcaaacttctgaccttatgtgatcctccctccttggcctcctaaagtgctgggattacaagcatgagccattgtgccaggcctggctaaacagcaagaa

SEQ ID NO: 12555 - DNA, 468 bp, Homo sapiens
tatttttaattatttggtaaatattttgtcatatgaccttctgaagcagccacaacttagataatgtcagaactaaggtgatttttttttttttaattttgaaagcccagccaaaatgaggtgtgaatttgtcatactgttacattgaaattggtaacaaaatatatcccctcccatttggacttttagggtaaatgaaaattttattgtattttaaagtagtttctaagttagcaagactgactataattccagtttctgttttctatggacagacctgataaactggagaccctaaagcaggaatacccaaattatagtgtcaggattttagctgtaccagaggcctttatgtgctacatataatttgtataaaattttatatgtgcagattgggtacataaacagttctccatttttctaagggaatgcaataaatgtagcatcgtgaataaatataacttttat

SEQ ID NO: 12556 - DNA, 425 bp, Homo sapiens
  misc_feature 337: n=a, g, c or t
aaaaaaaaasttgtatcaktstgsactcccaccagcattgtacatgatgatgttttsattcttcctagcaaactgttatattttsttttcsaacttgcttattctttaggtggaaatggcattcgcctatsattgactaatgaatcaagtgttccmatgtgccaaggggaactgaggcattggaagaccggtmactacactttaattcatgacsatagcaaggctgaatttgccctagacttaattctgtactgtggctgtgaaggctgggagccagaatatggcgtttwacttctwasattgccaaaggtgaagatgaagagctgctaacagtgantccagaaagcaattctttggsattggtctacagagacagagagactctgaaatttgtcaagcatattaaccaccgaagcctggaacaa

SEQ ID NO: 12557 - DNA, 395 bp, Homo sapiens
agaatcttaataggtgggctttgtgcacatggatttctaatactgcttaccctgtattttaagtcaaagagggtctttgtgtgaaggattctccacctccttttccctttctacgaaggaggtccttcctccactgaagtttcgaaccctcaaagtcatccatggggtttggaatcaacttcattcaagctcctgttactgttgctatcctaacctcctttcatgaatcatgaatgctggttgaagaagaggaagagagacaaggaattgctggcacaaagctgatcattcagtggagtccattctcaccgtgagaagaacattctactgtcagcaggcagagtgaggatggagacatcactgattcacttggctagttcgatgtgggcattcca

SEQ ID NO: 12558 - DNA, 493 bp, Homo sapiens
  misc_feature 414: n=a, g, c or t
agttcaagaaatgtgttccatcgaaatgctggcttgagagatgtttctggccatcttcaaagagataaagtttcagaatctgagggagagaaaattctagaaagtgccacaaggggtgtggctggaaccaaggactcaaaccgtagtttggctaaaaccaatctgtgcccaggaccctcggtctcctgtggcgtcgcgtccacagtcaagggcagccctggccgcccctgagcaatggaaaacggtgttaccagaaggaacggaggaaaattaccatgatcctaagaagctgaggtcatcaagcggagtaggaggtagatttcctatccaggagcagtgagccaaattaaatgcacagaaaattagaccttaacaatatcaaataacctccaacaagcatagactcgcagttgnaaagaacacacctggatttcaaatgtttcacagaaaaacagaggtgaagaaggaggttgaatcaactataatttcttct

SEQ ID NO: 12559 - DNA, 471 bp, Homo sapiens
aagatctaatgttcttgttggacgccatttgggttctagatttaattttcctcgttcttgaggggtttctttgtgttaaccttaaattctcacaattttcaagaaaaacattactctaatgttgtactcctgggccgacctcaagctcttctctgttttttcgattttttgaaaaattgtggacttaattttctgtaaaaatgattttcatttgtggttcttgattataatttcagttttaaagtattactggattcaggtttatatttacggtggtaaagatcagcacctagtggtgttctcacgggaagtgcatttatttgaactgcatatttgcaaatacatttttaaccctatttttacctgttctgttatggatgtgtggatgtttacaaaacagaaacaattttagttttgggaatattgggggaacgggaatagtggaagaaattacagtataatcgaaaatga

SEQ ID NO: 12560 - DNA, 445 bp, Homo sapiens
agtttgggtattctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaaggttgatcttctgaaatactttggccatttttcactactgccttatgaggttatcattaatctggcatatatttattgagtgcttgggtgtcactcatatggcacacgtttgctgttagagatgaaagctatgttttgtggagtttattgcagaggcgaccaaggctagaagggaaagaccaactcgtgctgttctaacaattgtttgcca

SEQ ID NO: 12561 - DNA, 479 bp, Homo sapiens
atccttatggaaatagacagtacacggatctggaatggaagcaaataataaccgggtctccagattccatcgtatcacagaatatagaaccaagaaagtaccttagaagtcatctgatccagtcacccctgttttaccaatgaggaatctagacccagaagaagttaaaggacttacccaagagtacccaacaactctctcaccaccccaggctcccatctttgtgtctctcctgtgtgagctgttccctgaagttcttcctgaacttgcacattgcctttccctttgattttaaatccttggctcaaatgacatgcccggactatatcgtgtgatatgagcttgaaaagtaatttacgtacaagtcttgaaagcaaatcaagttttaaaacaaagtagcatctactctgccccagccttgacatcttattacagagcaaatgctggctctttaatttccctaatcaagactggtccta

SEQ ID NO: 12562 - DNA, 428 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtaagggccaatactcaatgttcttaaagaaaagaattttcaacctagaatttcatatccagccaaact

SEQ ID NO: 12563 - DNA, 284 bp, Homo sapiens
agaaaagcttagacattcataggaataagacctccagctatttatgggttgattacaagctcagtatgattcaattgatgattagatagtagacatcacctgttacgattggagccctgtggccaagaggacgcctgtgaactatttcacctgattaggccacgctgggattttttgcttgggtgagaggtcgtgcttccccaggacacgggcagcagcctggagagaggagtctcagagggtaaccctgctcttctcaaatatggaaagctcctatgtggaag

SEQ ID NO: 12564 - DNA, 458 bp, Homo sapiens
atataaaaccagggcacttgagccagcagcagcaacctgctcaggtgcccttccaccttgttcttccgctctttgcaataaattttactgctgctcattctttgggtccgcactgcctttatgagctataacaccgtgaaggttggcagcctcacttctaaagccagcgagaccacaaacccaccaggagagacaaacaactctggacgtgccactttatgaactgtaacagtcagtgcaaaggtctgcagcttcactcctgaggccagcgagaccaggaacccaccggaagggacaaacaactccagacgcctcaccttaaaagctgtaacacttacagtgaagctctgcagcttcactcaaacccagcgagaccacgaacccaccagaaggddwgaaactcggaacacgtccgaacatcacaaggaacaaactccagataccatctttwgaactgt

SEQ ID NO: 12565 - DNA, 335 bp, Homo sapiens
  misc_feature 105: n=a, g, c or t
ataaaaaatgttatattaggttggtgcaaaagtaattgtgttttatttatttatttatttattattttttcctttgagacagagttttgttctggagtgcagcgntgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaa

SEQ ID NO: 12566 - DNA, 77 bp, Homo sapiens; identical to SEQ ID NO: 10181

SEQ ID NO: 12567 - DNA, 422 bp, Homo sapiens
aagagattagcacttctgaaagaagaagttagatgttaataggttatgttatgcttccttcattaacggtttagaatgagaaaatgagacacatctatggagaggagactacgaccttcattccttccaggggaggctgactgcatcattctgggtggtgagcttggtgttactacaataatttaacatcgaagagaagctctccaagtgattcaagggcattcacacctgttcttccgagatgggtattccaaggatattgggaagcttgaagggtgttagaagactaacctttcagcaggaccaatttgaaatattaatgcttcattcatcattattccttgagaagaatttggccaatatgtttaacacagctgtttttaaatgaagaactcgcttgtttcttaaaaaaaaaaaaaara

SEQ ID NO: 12568 - DNA, 373 bp, Homo sapiens
aattggatagcgacgaaggccggcastaggcgtggacccaactggcgaggctgctggggttgcagcgggacagttggggcggccccgcagcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcgccctctactttctggtatgacatcatcctatttgtagtagcaagttgaggctctattttagagatatgcacaaagatatt

SEQ ID NO: 12569 - DNA, 392 bp, Homo sapiens
  misc_feature 374: n=a, g, c or t
aagatctcaaacatgggagaccacatgcaaaggaaactacgttttcacaacacatggttggagaggtcaaagaaaatgtgatgtattactttcaattttatcatcagcgggaccatctggggctagtggtggggctcgaagaaggaagaagaaaataaagaagagaatcaggcaagtggacatctgtaggaagagtgatataggtagagagaacaaccagatcagaggaaggggtgtacctgacaaagttgaaaaacaaactccacttgactttaagatttactataaatggtaatcaagacaatgtgactggtaaaagaatggaaaaatagatcagtaaaacagaactgggagcccataaatagatacacaanaatttagtcatctgatct

SEQ ID NO: 12570 - DNA, 393 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacag

SEQ ID NO: 12571 - DNA, 314 bp, Homo sapiens
aaatttcgacctgtcctttcccgggagttagcgatccctcaacccctgcactgcgctagtcctaaagaggaaatgtctctacgcttgcgggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggtatgtgaggragctcgatgtc

SEQ ID NO: 12572 - DNA, 477 bp, Homo sapiens
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagcactttgggaggccgaggcgggcggatcacgaggtcaggagatcgagaccatcccggctaaaacggtgaaacccgtctctactaaaaatacaaaaaattagccgggcgtagtggcgggcgctgtagtcccagctacttg

SEQ ID NO: 12573 - DNA, 134 bp, Homo sapiens
atcatcgtccccagtggtgaccagccctgccatgggaaactatagttcccacaaaaggaccaaagcacccaagcaggcccgcaaggagaggccggctgacatggacaaggcctggtggaaatcgttccgtaacc

SEQ ID NO: 12574 - DNA, 428 bp, Homo sapiens
aaattccaccagatgtacaaagaagagctagtaccaattctactgaaactattccaaaaattgaaatcaaggaggagggactctctatgactcattctatgaagccagcatcaccctgatatgaaaacctggcaaagaaacaacaaaaaagaaaactacaggccaacatccctgataaacatagacacaaaaatcctcaacaaaatacaagcaaaccaaactcaacagcacatcaaaaagttaatttaggctgggtgcaatggctcatgcctgtaatcctagcactttggaagaccgaggcaggaggactccttgaacccaggaatttgagaccagcttgggcaacataggagaccccatctctacaaaataattagcaagtatagtgatgtgtgcctgtagccagctactcagaaggctgaggtggg

SEQ ID NO: 12575 - DNA, 70 bp, Homo sapiens; identical to SEQ ID NO: 12464

SEQ ID NO: 12576 - DNA, 304 bp, Homo sapiens
tgaaatatgagctgagattgtgccactgcactccagcctgggtgacagagatcctgtcatatgaaataatgaaatgaaatgaaataaatgaaatgatgaaatgaaataaaatgtgagctgagattgtgccactgcactccagcctgagtgacagagtgagatcctgagtgagatcctgtcatatgaaatgaaatgraataatgaaatgaaataaatgaaatgragaaatgaaatgtgaactgagattgtgccactacactccaggctgggtgacagagtgagatcctgtcgaaagaaatgaaat

SEQ ID NO: 12577 - DNA, 318 bp, Homo sapiens
  misc_feature 303: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcagggaatacagagaaggtgacaaagatactccttgagaagagcaaccccaagacaaataatcatcagattccccaaggttgaaatgaaggaaaaaatgttaagggcagccagggagaaagtcaggttacccacmaagggnagcccatcagactaa

SEQ ID NO: 12578 - DNA, 59 bp, Homo sapiens
tttcctttatgccattttttgtttttgttatttgcaaaagatcttgtattccttttttt

SEQ ID NO: 12579 - DNA, 432 bp, Homo sapiens
ctcacgcctgtaattccagcactttgggagcccgaggtgggtggatcacctgaggttgggagttcaagaccagcctgaccaacatggagaaaccccgtctctactaaaaatacagggttggccgggatggtggtgcatgcctgtaatcccagctactcaggaggctgaggcaggaaagtcgcttgaacccgggaggcagaggttgtggtgagccgagattgcgccattgcactccagtctaggcaacaagagtgaaactctgtctcaaaararaaaaaagaaaaacasttctgagggccgggtgtggtggctcacacctgtaatcccagcaytttgggaggccgaggcaggcggattsccttgaggtcaggagttcaggaccagcctggccaatctggtgaaacccgtgtstacgaaaaatataaagawtta

SEQ ID NO: 12580 - DNA, 444 bp, Homo sapiens
tttaaaaaatgtgttaaggctttgtttttggcctaacaggtggtctataaagaagaaagttgtatgaggtaatgagaaggctgtgtatcctgattttgtcgaggagtgttctctataccttcattagaaataattgtttttttactgccttctagtcttctgtttccttactaatattctctcttgttttattacagaaagtggagtattgaaatatcctactataattgtattgctctctttgtgtttattcagttttgttagtatttgctttatatagctgaaaccccaatatgagacacacacacataaatacacacatgtatatacaaatttgtaataggttccagtgaatgaatctaatgtccttctttgtctttttgaagttttgacttaaatacactttataaagtatgacagtttttaactaaaaaaaaaaaaaaa

SEQ ID NO: 12581 - DNA, 409 bp, Homo sapiens
ccacacattgttcctcttgtccaggggagggtggaggagctgcttcccaggactggaggagcagctgggcccctgctgcacgtccggtgggacacacctgtgagccctccagagggagagtgcaggccccttctgagcctggtgttgcagggctccgctctctcccggaagccagggcacccagggcggaggctcctcaggccggggaggcggggagggtgccctgcatggagagagacgccggcgctccccgccttctctgatgctcacccctcccaggccctgttctccctggggtccccccgtttagtagcccccctgcactctttgatatcttagtgtctgaggttgactgtgggtaaatctttaagacactccccagctgtgtttgtttataaatgctgtttat

SEQ ID NO: 12582 - DNA, 444 bp, Homo sapiens
cacttttatagctgaataatatttcattgttcatatcacattttgtttgtccattcgtccactgatgggctttgaattgtttccaccttttccctatttgaatactgctgctgtgaacattttgtttgaacatctgttttcagttctttttggtatatactaaggattggaattactgggtcatatggtattttaggtttaaccttttgaggaaccaaaaaaagtttcaaacattaattggtttgccttttaaattgagaaatttaaacattgtatttatttatcgtgtacaatctgatgttttgaaatacatatatgtatgttgtggccgggcacggtggctcacgcctgtagtcccagcactttgggaggtcgaggcgggtggattacctgaggtcagaagtttgagaccagcctggccaatgtggtgaaacctgtctctac

SEQ ID NO: 12583 - DNA, 467 bp, Homo sapiens
cccaatgattttcttgacatttttttcctcaaaagcacaactcctctattttctttttgcctcagcaacaagaaaaaaaaatctcatgatagctgtacaactttgcaaattaactactttcctactgttctccatcctatctcatcctcatctaatcaatgaattataaagccaacatataggccaggtgccatggctcacatctttaatcacagcactttgggaggctgaggaggacagatcatttgaggtcaggagttcaagaccagcctggccaacacggtgaaaccctgtttctactaaaaatacaaaaaaaatgagccaggtgtggtggtgcgtgcctgtaatcccagctactcaggaggctgaggcactagaatcacttgaacccaggaggtggaaattgcagtgagccaagatggcaccacagcactacagcctgggtgacagagtgagactgtgtatca

SEQ ID NO: 12584 - DNA, 423 bp, Homo sapiens
cacctgtgtattctcttcagtgaatcatctggatgtcttttgcccactttctttttttttcatttttattattttcattaatttttttctttggccactggaataaagactcaccattttctaactgagtgatgttttttaaatatatattttttagagacagggtctcactctgtggcacagagtcattgtagctttgaactcctcagctcaagctgtcctcccgcctcagcctcatgagtagctagtactacaggcacatgccactacacctggctaatttttttatttgtttgtggagacagggtcttactatgttgctgaggctggtgtttaactcctggactgcagtgaccctctcatctcagcctcccaaagtgttgggattacaggcatgcgcccctgtgcccagcctatggcatg

SEQ ID NO: 12585 - DNA, 423 bp, Homo sapiens
gaaaactacaaaacactgctgaaagaaattatagaaaacacaaacaaaatggaaacacatcacatgctcatgggtgggtagaatcagtattgtgaaaatgaccatactgccaaaagcaatctacaaaatgcaatttccatcaaaataccactgtcattcttcacagaactagaaaaaaaactcccaaaattcatatggaaccaaaaaagggcctgcatagctaaagcaagactaagcaaaaagaacaaatctggagacatcacattacctgacttcaaactatactataagggcatactaaccaaaacaacatggtactggtataaaaataggcacataggccgggtgcggtggctcacacctgtaatccctgcactttgggaggccgaggcaggcagatcacctgaggtcaggagtttgaga

SEQ ID NO: 12586 - DNA, 328 bp, Homo sapiens
  misc_feature 169,184,250: n=a, g, c or t
ctggcgggaaagtggaaaactatcggcggtggcccaggctcggtggctcactcctggaatcccagcactttgggaggccaaggtggggggatcacgaggtcaggggatcgagaccatcctggctaacaggtgaaaccctgtctctactaaaaatacaaaaaaattagcnaggcgtggtggaggngcctgtagtcgcagcdactcgggagghtgaggcaggagaatggcgtgaacccaggaggcggastgncagtgagccgagattgctgcactvcactccagcctgggcdacagaggaagactccgtctcaaaaaaaaaaaaaaaaag

SEQ ID NO: 12587 - DNA, 393 bp, Homo sapiens
  misc_feature 372: n=a, g, c or t
attttcgggtcccgcgcccaggtgggaagaggccggcgactggggtgaccgcggggaaactgaggcagagagatgggctccaaggcaaakaagcgcgtgctgctkcccacccgcccagcgcsccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctasgtggctgccaaccagcggctgcagcaggcgggcaacgtgctgaggcagaggtgtgagctcctgcagcgagccggcgaggacctggagcgggangtggcccagatgaagcaggca

SEQ ID NO: 12588 - DNA, 95 bp, Homo sapiens
  misc_feature 63: n=a, g, c or t
agtkccttattcagtcttststctcgctctctycgctgstgtwgccggrccctttgccttygncactgctcagcgtctgcwcatccctacaatgg

SEQ ID NO: 12589 - DNA, 76 bp, Homo sapiens
atttttscccccttgstcgggatggtgccacaggakgstgtgcgggctccgctccgsttcgaatggtggatgctgt

SEQ ID NO: 12590 - DNA, 440 bp, Homo sapiens
gaactgtagattaataaactgaaattgatgttacagatgcccctggctgacttttataacctgttactgcacaggggtagacatactgggagcttccttttaattcccatactgagaaaagaagagtcctggggttcacatggcctttgtgagactcacatgaagctggagccctcaaagggaggcaactcacatgaaagcatagattagaaaaaatgtttcactaccacatgctgatgacaaagaagcttgtttttctgggtttagtctcagggtggggttggaggtgaggctggggtcccccctagctttatacttagaaaccctgcctttattagggtttgagaaatgaatttacattccctgctcaacccaggagtcatgaagtccaaagactgacagaatggtcctgggtgcattaaacctttgagtcacctggc

SEQ ID NO: 12591 - DNA, 222 bp, Homo sapiens
gagaccagcctggccaacgcggtgaaacctgtctctactgaaaatacaaaaattagctgggcgtggtggcaggcgcctgtaatcccagctacctgggaggctgaggcaggagaattgcttgaacccgggaaccagaggttgcagtgagccgagatcatgccattgtacttcagcctgggcgacagagtgagactccatctccaaaaaaaaaaaaaaaaaagc

SEQ ID NO: 12592 - DNA, 156 bp, Homo sapiens
aaccatttctagtcssctttcctcgcaggacctcatgagtaagctgtggcgcgtgggagcacctctggggctatggaggcccctgagccgggagaagccctggagttgagcctggcggtgcccatggccatggagtgcacaagaaaaaacacaaga

SEQ ID NO: 12593 - DNA, 473 bp, Homo sapiens
gaaaactacaaaacactgctgaaagaaattatagaaaacacaaacaaaatggaaacacatcacatgctcatgggtgggtagaatcagtattgtgaaaatgaccatactgccaaaagcaatctacaaaatgcaatttccatcaaaataccactgtcattcttcacagaactagaaaaaaaactcccaaaattcatatggaaccaaaaaagggcctgcatagctaaagcaagactaagcaaaaagaacaaatctggagacatcacattacctgacttcaaactatactataagggcatactaaccaaaacaacatggtactggtataaaaataggcacataggccgggtgcggtggctcacacctgtaatccctgcactttgggaggccgaggcaggcagatcacctgaggtcaggagtttgagaccagcctgaacaacatagtgaaaccctgtctctactaaaaataaaaaaaa

SEQ ID NO: 12594 - DNA, 412 bp, Homo sapiens
tttttaacatttcaaaataagcatggcaggcttctattgaggtttggacttctctcatttctaaagaattagagttgtaacttcatattagttgtaagtttggggtttggtcctcacccaagttggaaagctgtttgcttaagacatagatgtattataataatagaagggagggagtagaaagctgatgaacccttgttacttatagcaaacttcctgctgttttaaatgcacagagattattttatcaactgtggttagcacgcaattggtatttttattgttctgccattttattgaggctatcaagtgggacttcagacctggctctgagcaggaccacacgtgtgtatttatattgagtgccctcactcatgataaggtgacttcatggagacccagaaactcaccc

SEQ ID NO: 12595 - DNA, 398 bp, Homo sapiens
atttttgaaaagttgtgttttcattttcattaaattttctcttgagatttcttctttcacccatgtgttattagaagtgtgctccttaattcccaagtatttggggattttccagctacctttgttttatcaatttctagtgtaattctgttgagatttttgtttttgtcttagtgatatcatcctaatattttgatttatccataatacatgcatgagtctcaaaatatcaatactacaacatataattactatgaacagtttagacattttctccagattgttatgtgtttaaataaaagcacaaggaatagcccctctgtgaggacttatgacatcaagtgggtatgagtttattttactttcaagtcatagcgattactcttttagatttaatt

SEQ ID NO: 12596 - DNA, 102 bp, Homo sapiens
atcgccttcgccgccgcccgcccgcaaaccttcgtgcccggcccgtggcctgcgcggastgtgtccaataaagttcttggatgtgaaaaaaaaaaaaaaaaa

SEQ ID NO: 12597 - DNA, 370 bp, Homo sapiens
caaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatcccaaaaaaaaaaaaaaaaag

SEQ ID NO: 12598 - DNA, 461 bp, Homo sapiens
  misc_feature 438: n=a, g, c or t
aaaaaagcagaagsggaagtaaactcattcacttattaacaaataattactggctagatgaagtggattatacttgtaatcccaacactttgagaggtgaaggcaagaggattgcttgaagttcaagccagaagttcaagactgcattgagasatgattgcaccactatactccagcctgggcaacagagcaagatcccatctcaaaaatttagcagggtgggtgcggtgactcatgcctgtaataccagcattttggaaamctggtgggcggatgacttgagctcaggagttcgagmctaggctaggcaatatggtgaaatcctgtctctatgamcaaaawtttagctggatgtggtggtgtgttcctgtggtcccagctacttgggaggctgaggtgggaggactgcttgggctgataggttgaggctgtggtganccgtgattgtgccactgctctgc

SEQ ID NO: 12599 - DNA, 54 bp, Homo sapiens
ctckctctytccgctgctgtagmsggagcctttgccttcgccactgstcagcgt

SEQ ID NO: 12600 - DNA, 169 bp, Homo sapiens
tatagcagtcttttgataacaatagttaagaggccaggcacggtggctcatgcctgtaattccggcactttgggaggctgaggcgggcggatcacctgaggttgggagttcgagaccggcctgggccaacatggtgaaaccccgtctctaccaaaaaaaaaaaaaaaaa

SEQ ID NO: 12601 - DNA, 243 bp, Homo sapiens
ttccacaatggctgaactaatttacactcccaccaacagtgtaaaagcgttcctatttctccacagccttgccagcatctgttgttttctgactttttaataatcgccattctaactggtgtgagatggtatctcattgtggttttgatttgcatgtctctaatgaccagtgatgatgagcgtttcttcatatgtttgttggctacataaatatcttcttttgaaaaaaaaaaaaaaaaargy

SEQ ID NO: 12602 - DNA, 397 bp, Homo sapiens
tctactgaaattatcagacagaaaactggacgggcgtgatggcttaggtctgtaatcccagcacttttggaggctgatgtaggtggatcacttgaggtcaggagttcaagaccagcctcgccaacatggtgaatccccatctctgttgaaaatacaagaaaaattagccagccttggtggtgggcacctgtatcccaactactcaggaggctgaggcacgagaattgcttggactcaggagtcggaggttgcagtgagccatccctgcactccagcctggacgacagagcaaaactgtctcacaaaaaaagaagaaaacttagtggctgttaacactgaaaatacgtacattgaaatagtgtatcaaattcaagtgaatagcttgtaataaagtgtt

SEQ ID NO: 12603 - DNA, 478 bp, Homo sapiens
aagatcaaaacttgtggatctatagataattcatagtgcagagatgctttacaaatgaaaagagtgtggcaaaacctttaccagagttcaatccctactggacagaagggagtttatactgataggaaatctacacatatgtgccatactttccccaggcatcggaactccagacatcaaaatatacaactttgagaggaaccacacaaacgtaatatgtgtggtaagacttttacctgaacatcaaaatggaaaccagagtattcatactgaagagctaccttacaaatgtaacaaatgtagtaagactttttaaaaaatcaaatgttcggccaggtgcggtgtctcacgcctgtaatcccagcactttgggaggccgaggcaggtggatcatgaggtcaggagatcgagaccatcctggctaacatggtgaaacccgtctctactggaaatacgaagattagctgggcgaggtggt

SEQ ID NO: 12604 - DNA, 436 bp, Homo sapiens
  misc_feature 305: n=a, g, c or t
catgggattgcagtaagtataataaacatgttttcactgtttagtcaggtgaattccttttctgtaggtccctattttttcattcccttaataatttagtagttcatgtttgaacatttttggtgaactttgtcatttgcattgaatttgggggaagattactggtaattgccagcattaggtgtctgtagccacatttcataatccctctagtctgacatggctctgaatcctggctgggtttaagtcaagcttgtccaacctgtgggctgcaggcatgggcacatgcggcctaggacagcttncagtgtggcccatagcaaattcgtaaactttcttaaaacattatgagatttttttgcaattttttttaagctcttcagctatcgtttgtgttagtgtattttatgtgtggcccaagacaattcttcttctt

SEQ ID NO: 12605 - DNA, 377 bp, Homo sapiens
actcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataascttggactcacactgctgtctctgtat

SEQ ID NO: 12606 - DNA, 458 bp, Homo sapiens
  misc_feature 393: n=a, g, c or t
tacaaaatgatgtaagccattaaaaccatgtactgtatagaattataagaaattttgccaacatttctctggtgtaatcagtatcatccggtttcgttttaaaaaaaaaaaaawttwttgggctgggcacggtggctcacacctgtaatcccagcactttgggaggccaaggccagtggatcacctgaggtcaggagttcgagattagcctggccaacatggtgaaacccgatctctactagaaatacaaaaattagccaggtgtggtgcctcacgcctgtggtcccagctactcgggagggtgaggcagaagaattgcttgaaccagggaatcggaggttgcagtgacccgaggtcacgccactgcactccagcstgggtgacagagcaagnctccatctcaaaaaaattgtttttattaatttttattttttgagacggggtctggttctgtttcc

SEQ ID NO: 12607 - DNA, 90 bp, Homo sapiens
aattgtgttcgcagccgccgccgcgccgccgtcvmtctccaacgccagcgccgcctctcgctcgccgactccagccgaagagaagggggg

SEQ ID NO: 12608 - DNA, 64 bp, Homo sapiens
cctgggcaacacggtgaaacccgtctctaccaaaaacacaaaaaahtagccaggtgtggtggct

SEQ ID NO: 12609 - DNA, 342 bp, Homo sapiens
caaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatg

SEQ ID NO: 12610 - DNA, 521 bp, Homo sapiens
  misc_feature 296: n=a, g, c or t
cttcagaaacttgttcgagtcaggactcctctaccactacctctgctttgcctccttcctggacttcaagcacttctgtgtcccaaaagcagaaaagaaagactggcacaaagccaagtacagaaccacagaatgaagccgtcacaaatgttgaatcccaaaacactaacaggaacaactmaactgccttgcagttagctagccgtcctcccgattctgtsacagaggggcccacgtctaaaagagcacatataaagccaaatgctttgctgactaatgttgacmagattgtccangaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccattggttcatcctcttttaaa

SEQ ID NO: 12611 - DNA, 347 bp, Homo sapiens
agattaaatctattaatttttctctagcccatgtaagaatccsatttatggctgggcgcggtagctcacgcctgtaatcccagcactttgggaggccgaggtgggcggatcaggaggtcaggggatggagaccatcctggctaacacgatgaaaccccgtctctactaaaaaatacaaaaaattagctggccgtggtggtgggtgcctgtagtcccagctactcgggaggctgaggcaggagaatggcgtgaacctgggaggcggacttgcagtgagccgagatcccgccactgcactccagcctgggcaacagagcgagactctgtcccaaaaaaaaaaaaaaaaa

SEQ ID NO: 12612 - DNA, 200 bp, Homo sapiens
  misc_feature 113: n=a, g, c or t
attttgatgtgactttaaaaatgtacttgataaggccggggcacggtggctcacgcctataatcccagcactttgggaggccgaggtaggagaatcgcttgaagccgggagsngaggttgcggtgagccgagatttgcgcccttgcactccaaccagggcaacaagagtgaaattccatctccaaaaaaaaaaaaaaaaa

SEQ ID NO: 12613 - DNA, 409 bp, Homo sapiens
atcactcatttgtgttaagagcattcaaaatcctctcttccagctatttgaaaatatacaataaattattgttaactaagcatacttcttttatttaccaagcatgtatttgaatgacatacttcctcttcagtaatgcctggtcacatatcagttcctatttttctattttttttcccctcctactggtctttttcttaatgtttaggagcccattgttatatttgttaccgatatttctccctacttgttgtcatttgagtttgtttatggaaccttttgccaatattaaagtgttatacttatttatgatcaaatttacagtgtgctccaccctcccctatttatagtttcactttccttatattgcttagaaaggccttacccactaaatattctcattttcttt

SEQ ID NO: 12614 - DNA, 376 bp, Homo sapiens
cacaagattaaatgaaggagatagatattaattacataatttcataaataattgattgattaaaactatggtaagtgctggctgggcacggtggctcacgcccataatcccagcactttgggaggctgaggcgggcggatcacggggtcaggagtttcagaccagcctgaccaacatggtgaaatcccatctctactaaaaatacaaaaattagctgggtgtggtggcatgcgcctgtaatcccagctactcaggaggctgaggcaggagaatcacttgaacctggggggcagaggttgcagtgagccaagattgtgccactgtcctccagcctgggtgacagtgcgagactccatcccaaaaaaaaaaaaaaaaa

SEQ ID NO: 12615 - DNA, 397 bp, Homo sapiens
cattttgttgagtcttttcatagagtttggcaagaccagatattacctgccagtgtgcattcatatatgtgtgacatgttaactttagtttttaaaattaagaaaatgaatgcggggccgggcgcggtggctcacgcctgtaatcccagcactttgggaggcagaggcgggcggatcacaaggtcaggagatcgagaccatcctggctaacacggtgaaacccgtctctactaaaaatacgaaaaattagccgggcgtggtggcgggcgcctgtggtcccagctactcgggaggctgaggcaggagaatggcgtgaacctgggaggcagagcttgcagtgagccgagaatgcgccactgcactccagcctgagcgacagagcgagacgccgtctcaa

SEQ ID NO: 12616 - DNA, 506 bp, Homo sapiens
agtttggaggtttctcaaagaacacagaactatcattcaatccagcaatcttgttactaggtgtatatccaaaggaaaagaaattgttataacaaaaagacacatgcactcatatattcattgcagtactatttgctatagcaaagagatgaagtcaacctaggtgcgcatcagtggtggatttggtaaagaaaatggtacatdtacaccatggaataatgtacagccataaaagagaacaaaacaggccgggcacagtggctcacatctgtaatttcagcactttgggaggctgaggcaggtggatcacctgaggtcaggagttcaagacaagcctggccaacatggcaaaagccccgtctctactaagaatacaaaaaacattagctgggcatggtggtgcgcacctgtactcccaactactcgggaggcaggcatgagaatcacttgaacccaggaggcagaggttgcagtgagccgaaatcattccactgcactccagcctg

SEQ ID NO: 12617 - DNA, 458 bp, Homo sapiens
tgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagcactgcacctggcctgtagcaaataatttttaagcattctcaagatgtatgatgttgggtttaacatcatatgttcacagtgttttaaataagaaataatctgtctttagtatacaggatggttctttgtttgcctgaaaagtataa

SEQ ID NO: 12618 - DNA, 544 bp, Homo sapiens
aaaaatagaatgttggtgaggaaggtggatgccctcccacctggcgtaggcaccacttgcaactattaaaacgtgaggctggcaactgaccaccacttgggtaagaagtcattccttcagcaaaatactgtatgcaggaatagcatttctgtgaactaagaaaatcaagaagatgcttgcatatgttcttaaaactgtggcttttcaaaagctagagtgatcctgtggttcccagggaaatgagatggcctgttccccagattaaagaaaaaagaaacgattccattcaatgctcacactgataataatatataccttgatttcagaaataactaaatgtgaaaaaaaaaagtacatattagaatcaaagaaatgtaatgkgtttcttgtcaacagacttcaaagtttttggggataagccaatttctggctgatgctggaatgcttttctcaggactggcttcctgccatcttcctccacttcaatctcacaggtttagagcaggcagtgamatcttmtttctgatgcaactgaaatgaactt

SEQ ID NO: 12619 - DNA, 463 bp, Homo sapiens
gtttttggtggagacggggtttcgccatgttgcccaggctggtctcaaactactgagctcaggcgatccacctgcctcggccatctaaagtgctgggattataggtgtatgccactgtgcccagcctgagtaattatttttaacttcactgatttttttaattggaatttaattttttataaattttgaagatctctgagaagtatttcaaattgatattacagtttttttttcttctttggttttatcatagtcatttgtttatgaacagatcttgttgaactgctttgttttcctaaagaaataaaggtcttcgaggctgggcatagtggctcacgtctgtaatcccagcactttgggagcctgaggtgggtggatcacctgagtgcaagaccagcctggtcaacatggcaaagccgtctttactaaaaaacacaaaaattagccgggcatggtggcacat

SEQ ID NO: 12620 - DNA, 325 bp, Homo sapiens
gaaaactacaaaacactgctgaaagaaattatagaaaacacaaacaaaatggaaacacatcacatgctcatgggtgghgtagaatcagtattgtgaaaatgacmwtactgccaaaagcaatctacaaaatgcaatttccatcaaaataccactgtcattcttcacagaactagaaaaaaaactcccaaaattcatatggaaccaaaaaakggcctgcatagctaaagcwagactaagcaaaaagaacaaatctggagacatcacattacctgacttcaaactatactatrrgggcatactacccaaaacaacatggtactggtat

SEQ ID NO: 12621 - DNA, 70 bp, Homo sapiens
  misc_feature 55: n=a, g, c or t
atcatatttttgattttgcstttggssacaccacataaaatattcaatacctggnctttttttttttttt

SEQ ID NO: 12622 - DNA, 97 bp, Homo sapiens
aggagaatgatgggaaccgggaggcggasttgcagtgagccgagatcgcgccactgcactccagcctgggcgacagagcgagactccatctcaaaaa

SEQ ID NO: 12623 - DNA, 274 bp, Homo sapiens
ttggggggccggggcgggcagatcacctgaggtcaggagttggagaccagtcctggccaatatggtgaaacctgtctctgctagagatgcagagattagccgggtgtggtggcacacacctgtaatcccagaggctataattctgtaatcgggaggctgaggcgggagaatcactggaacccgggaggcagaggctgcagtgagccgacatcgggccgctgcactgcasctgggtgacagagcaggaccctctcaaaaaaaaaaaaaaaaaggc

SEQ ID NO: 12624 - DNA, 466 bp, Homo sapiens
ataaaatttttcagtatagtacagtasatatactgtgaggcgcgtgctaaagtgaataagcgagttttcatgctgacccactcaatgctattcagaaatmaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtt

SEQ ID NO: 12625 - DNA, 438 bp, Homo sapiens
cagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaacatgtcctttgtgcctactgctatgaaaaggtgtgcaaggagacttgcagaaatcagacgacagataggg

SEQ ID NO: 12626 - DNA, 147 bp, Homo sapiens
  misc_feature 81..82: n=a, g, c or t
gtgagaacctgtctctacaaaaaaatatgaagattagctgtgcatggtggcacacacttgtggtctcagctacccaggagnntgaggcgggcggttcaaatgagcccatgagattgcggctgcagtgagccatgatcgcgccactgc

SEQ ID NO: 12627 - DNA, 272 bp, Homo sapiens
gggtgcattggctcacgccagtwatcccagcactttgagcggctgaggtgggaggattgcttgggcccgggagttcaagaccagcctggacagcaaggtgaggccccatttctacaaaaaattagccacatgtggtggcatttgcctgtagtcccagctgcatgggagagtgaggtgagagggtcgcttgggcccagagggtagagactgcmgtgagccgtgtttgcacccctgcactccagcctgtgtgacagagtgagactgtgtctcca

SEQ ID NO: 12628 - DNA, 412 bp, Homo sapiens
ttgagtccatacgttatataaataagaatgtaagacatttatcaactgttacgtgtctcagagagtttctacagaaagtcaacccttgaaaataaatcttttccttttattttggatgtttaaaattttacaggtgaaaaaaattctttgaaatataatttcaggccgggcacgtagctcacgccagtaatcccagcactttgggaggccgaggcgggtggatcacttgaggtcacgtgtttgagaccacccttaccaatgttgcgaaactccatctccactaaaaaaaaaatagaaaattagctgggcgtggtggtatgcacctgtaatcctagctactctggaggttgaggcggaagaatcgcttgaacctgggaggcagaggttgcagtgagccgagatcacgccactg

SEQ ID NO: 12629 - DNA, 409 bp, Homo sapiens
cagtggctcatgtgtgtaatcccagcactctgggaggctgagacaggtagatcatttgaggtcaggagttcaaaaccaacctggtctacatggtgaaacccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaaccctgtctctattaaaaatacaaaaattagctgggcgtggtggcgcatgctgtagtcccaactactagggaggctgaggcaggagaatcacttgaacccaggaggtggaggttgcagtgagccgagatcacgccactgcactccagcctggcgacagagcgagactccc

SEQ ID NO: 12630 - DNA, 456 bp, Homo sapiens
atggatgcgggagtatactgattctgtttatataaaattctagaacgtgcaagactggagatggaaatcagatcagtgggtgtctggggtgggatggaggttagagatagactgaaaagcatgaaggaactttttggggtggatagaaatgttttataccttcactagggtagtggttacatgggtatatacattggttaaaagtcattcacctatgtatacccttacagtgtgtgaattttattgtatgtaaattgtacctcagtagattttattaaaaaaaaaaatcaaaggctgggcacagtggctcattcctgtaatcccagcactttgggagggccgagacgggcagatcacgaggtcaggagatcgagaccatcctggctagcatagtgaaaccccatctctactaaaaatgcgaaaaattagcagggcgtggtggcgggcactgtagtc

SEQ ID NO: 12631 - DNA, 297 bp, Homo sapiens
ttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccaccaaaaaaaaaa

SEQ ID NO: 12632 - DNA, 263 bp, Homo sapiens
ctttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcgctccagcctgggagacagagcaagactctatctcaaaaaaaaaaaaaaaaa

SEQ ID NO: 12633 - DNA, 421 bp, Homo sapiens
aaccttaaatagatgtaatttctatttgtcaatgatgcctcagcaaagctagggagaaaataaaaaggatccttctgtgcaacagcccgcatgtccattaccgatgactggataaagaaaacgtgctccacccatgcagtggaatactacgcagccataaaacggaatgaagctcggatccaagctagaacgtaggtgagccttggaaacgtggcgctgagtgagagaagctggacacaaaataaggccaggaatggtggctcacagccgtaatcccagcactttacgaggccaagatgggcagatcacttgagtccaggagtttgaggccagcctgggcaacatgacgaaatcctgcctctacaaaaaatacaaagttagccaggagttcatttagaggagtcatgtgactatagtccca

SEQ ID NO: 12634 - DNA, 322 bp, Homo sapiens
aaatctgaaagtgtctgtgtgatggagagagacatggaaaaggcgacgtcscagcggctggaactggggcggaggaacgggaacagggaaggcctgwkttaggcaccacaaaggttttcaggagaaaagtggggcgagccgagaggtcgtccagcatgctctgcccaccccacgccgaggtgcactgaccatgagcctcaactcctccctcagctgcaggaaggagctgagtaatctcactgaggaggagggtggcgaagggggcgtcatcatcacccagttcatcgccatcattgtcatcaccatttttgtctgcctggga

SEQ ID NO: 12635 - DNA, 553 bp, Homo sapiens
taagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggraggtctgcggtaaaatgctgtgactgtttactttcaattgcattgtgtgttgc

SEQ ID NO: 12636 - DNA, 426 bp, Homo sapiens
accccttctgtcagtacagtgcactgcacagtggataagaatgtagactccagagccagagagagttgtgtttgacttgtatctacggagcttgtgatttttgacttggcaatttatgwgtttaatgtgagaatttccacttcaccacttgaatcaacttgctgcattgtgaaaatatctagcaaacgacaggagaaaactaacttttactgacacctgctgtgcctgcaaacatatgttatctcaatttatcctcaaaattgtgctgggacatgaagtattgttcccattttacagatgaggaaactgataccatgccgtgctaccaggctaaccaaaactgcagcccaggtttatttaacttcaggtctagtggattcgaagtctacgatctccctcctacaccatgaaatcaaagtaagtctt

SEQ ID NO: 12637 - DNA, 50 bp, Homo sapiens
aggaagaagcggaggaggcggctcccgcgctcgcagggccgtaaccacca

SEQ ID NO: 12638 - DNA, 449 bp, Homo sapiens
tagaatgtcaactgccatcgttattttaaccaatactcccattctccartattcctagaactcttttaggcattgatctgatggcaatattcattcatttattcaacaaatatttatagagcaatcacagtgccatatagtgggaatgcactaattaagatatgacacctggctgggcgcggtggctcacacttgtaatcccagcaccttggaaggctgaggcaggtggattacttgactccaggagtttaagaacagcctggacgacaacctgtctctactaaaagtacgaaaaattagctgggcgtggtggcatgtgcctgtggtcttagctacgtgggaggstgaggtgggagaatcacctgagcccagggaggttgaggctgcagtgagctgagatcgcaccattccactcccgcctgggcaattggagtgagaccctatctgcc

SEQ ID NO: 12639 - DNA, 432 bp, Homo sapiens
cacttttatagctgaataatatttcattgttcatatcacattttgtttgtccattcgtccactgatgggctttgaattgtttccaccttttccctatttgaatactgctgctgtgaacattttgtttgaacatctgttttcagttctttttggtatatactaaggattggaattactgggtcatatggtattttaggyttaaccttttgaggaaccaaaaaaagtttcaaacattaattggtttgccttttaaattgagaaatttaaacattgtatttatttatcgtgtacaatctgatgttttgaaatrcatatatgtatgttgtggccgggcacggtggctcacgcctgtagtcccagcactttgggaggtcgaggcgggtggattacctgaggtcagaagtttgagaccagcctggccaatgtggtgaa

SEQ ID NO: 12640 - DNA, 67 bp, Homo sapiens
cagttagcccagatcatgccagcctgggtgacagaacaagactgcttcttaaaaaaaaaaaaaaaaa

SEQ ID NO: 12641 - DNA, 402 bp, Homo sapiens
aatattaatgaaaaaggtttaatgtgacatataaagtataaagacataattaaaacttagattggagggacaaattcttagaaaaatataacaagaactaactctagctgggcacagtggctcatgcttataatcccagcactttggaaagccaaggcagttggattgcttaagcccatgagttcaagaccaacctgggcaacagcaagaccctgtctctacaaaaaaatttttttaattagccatgtgtagtcccacctgtagtacacatgtgtggtgcgcacctgtagtcccagctactcgggaggctgaggcaggagggttacttgagcccaggaagtcgaggctgcagtgagccgtgactactactgcatgccagcctgggtgacagagcagacccta

SEQ ID NO: 12642 - DNA, 291 bp, Homo sapiens
cttttttaagactttctggctgggtgctgtggctcatgactgtaatcccagcactttgagaggccaaggagggcagatcaaggtcaggagtttgagaccggcctggccaacatggtgaaaccccgtctctactgaaaatgcaaaggttggccgggcatggtggcaggtgcctgtagtcacagctgctcgaggctgaggcaggagaattgcttgaacctggggggcggaggttgcagtgagctgagatcgcgggcaacagagcgagactttgtcacaaaaaaaaaaaaaaaa

SEQ ID NO: 12643 - DNA, 488 bp, Homo sapiens
tctctttggatgatctgttcagtgctgaaagtagggtgttgaagtctcctattattgaaatgcagtctgtctctccctttagatctaatatttgctctggtgttgggatttctaatgtgaagtctattttatctgataaaactacaactactcctgctttcttttgctttccatttgcatggaatatcttcatgtgtccttacgggtgaggtctaccagcaacaaattgcctcaatttttgttttctacaaaagtctctgccaggcacggtagctcacagctgtaatcccagcactttgggaggccaaggcaggtggatcacttggtcagcagttcaagaccggcctggccaacatggtgaaaacccacctctactaaaaatacaaaaattagctgggcgtggtggtgtgtgcctgtaatcccagctactcgggaggctgaggcagaagaatcacttgaacctgggaggcggaggttgcagtgagcca

SEQ ID NO: 12644 - DNA, 344 bp, Homo sapiens
tggctagagtgtacctagagagggaaaatttcaatagacagtaggccagttcaagactggatagaggccgggcgcggggcctgtggtcctagcactttgggaggtcgaggcgggtggatcacctgagctcaggagttcgagagcaacctgaccaacatggtgaaacaccgtctctgctaagaatacagaaattagctaggtgtggtggtgggctcctgtagtcccaggtactcgggaggctgaggcaggaggatcgcttgaacccggaaggcgaaggttgcaatgagccgagatcgtgccattgcactccagcctgggcgacttagcgaaactccgtctcaaaa

SEQ ID NO: 12645 - DNA, 316 bp, Homo sapiens
aaaattgtggcagtttctggccgggcgcagtggctcacgcctgtaatcccagagctttgggaggccgaggcgggcggattacctgaggtgaggagttcgagatcagcctgggcaacacggtgaagccccgtctctactaaaaatacaaaattagccgggcgtggtcgcacatgcctgtaatcccggctgctcgggagcctgaggcaggagaatcgcttggacctgggaggcggaggatgcggtgagccgggatcgcgccattgcactccagcctgggcaacgagtaaatctccgtctcaccaaaaaaaaaaaaaaa

SEQ ID NO: 12646 - DNA, 139 bp, Homo sapiens
gaacattctttaagaagaccaccacatagaataccccttcctatcagctcgctctgatttagccttaattttgttaaattttttagagatgaatgaagtgctgctgtggaaagaaatgtacatatactatttctgtatc

SEQ ID NO: 12647 - DNA, 122 bp, Homo sapiens
attagctaggcatggtggcgtggcacgtgcctgtagtcccagctactcgggaagctgaggcaagagaatcacttgaaccagggaggcggaggttgcagtgagccgaggtcgcaccgttgtac

SEQ ID NO: 12648 - DNA, 331 bp, Homo sapiens
ttgtcaaagatggttgtaggctgggcacagtggcttacgcctgtaatcccagcactttgggaggccgaggcaggcggatcacctgaggttgagagtttgagaccagcctgacgaacatggagaaacccctgttgggagaaatctctactaaaaatgcaaaaaaattagccgggcgtggtggcacatgcctgtaatcccagctactagggaggctgaggcaggagaatcacttgaatctgggaggcggaggttgtggtgagccaagatcacaccattgcactccagcctgggcaacaaaagtgaaactccgtcccaaaaaaaaaaaaaaaaa

SEQ ID NO: 12649 - DNA, 424 bp, Homo sapiens
ttttggggggataaatacctagatagatagggactgctaggtcatgtggtcagtgcacgctcaaccttttacaaaactgcccagttgctttccacatggctgcaccattttgcattcccatcaacaatggataagaactccggctgggtgcagtggctcacgcctataatcccagcactttgggaggccgaggcagttggatcaactgaggtcaggagtttgagacaaggcggactaacatggtgaaacctgtctctactaaaaatacaaaaattagctgggcatggtagcatgggcctgtagtcccacctgcttgggatgctgaggcaggaggcaggagaatcacttgaacccaggaggcaaaggttgcagtgagccaagatcacaccactgcactccagcctgggagacagagcaagactct

SEQ ID NO: 12650 - DNA, 395 bp, Homo sapiens
tagtgaagatttaaaagtgggtagtgttataaagagtaaagtatatttgtagttattgacctgcgaggatacgcgattttgattgagtaaaggaagcaaattggccgggcatggcggctcatgcctgtagtcccagcactttgggaggctgaggcgggcagatcagttgaggttagtttgaggccagcctgaccaacatggcgaaaccccgtctctacaaacaaatgcaaaaattagccgggcaaggtggtgcctgcctgtaataccagctacgcgtgaggctgaggcaggagaatcgcttgaacccgggaggtggggctgaagtgagctgcaattgcaccactacactccagcctgggcgacagagcaagattcggtctcaaaaaaacaaaaca

SEQ ID NO: 12651 - DNA, 344 bp, Homo sapiens; identical to SEQ ID NO: 12644

SEQ ID NO: 12652 - DNA, 60 bp, Homo sapiens
  misc_feature 18..19: n=a, g, c or t
cttttcctttcagcggannggcgcaagatggcagtgcaaatatccaaaaaaaaaaaaaaa

SEQ ID NO: 12653 - DNA, 347 bp, Homo sapiens
caatagttcttaatgtgttcagagttgcaaccatctagttcagttttagaatatttcatcgcttaagaaaaaaccctagtaactattagcacttacactgcattctgccctcccgccatcccctgataacaacaaatatacattctgtttgtatagatttacttagtctggacgtttcatagaaatggaatcccacatccttttgtgactggattctttcacttagcaaaatgttttcaaggttcatctaggcatttaaaatttttaactgtcttaaaacctcatgagttcttatttttaaatctaagagaatggttgcttgaaatattcttacaagggacagaact

SEQ ID NO: 12654 - DNA, 324 bp, Homo sapiens
tttatttttgagacagcttgttgcctaggctggagtgcaatggcgtgatctcggctcactgcagcctctgcctcctgggttcaagcgattctcctgcctcagtctccagaatacctgggattacaggtgcccacaatgatgcccagctaatttttgtatttttagtagagatggggtttaacccttgttggccaggctggtctcgaactcctgagctccagtgatccacccccctcggcctcccaaagtactgggattacagcggtgagccaccgcgcctggccagctttttagttctatttgatatttttaaagaaactgtaa

SEQ ID NO: 12655 - DNA, 422 bp, Homo sapiens
aaatgaaggagaaatacataggtaaaaaattaaaactgggaaaaaaaagtttggcagaaaagatctaatatagatatataataggatcttcccaccccgcccccagaaagaaaaccaaaataaaggaatagcttaaatactgacaagtggccgggtacgtggctcacacctgtaatcccagcagtttgggaggccgaggggggcagatcacgaggtcaggagatcgagaccatcctgactaacatgttgaaaccctgtctctactaaaaatacaaaaaattagccaggcatggtggcgggcgctgtagtcctagctactcgggaggctgtgaggcaggagaatggcgtgaacccgggaggtggagcttgcagtgagctgagatcgcgccactgcactccagcctggggacagagtgagactc

SEQ ID NO: 12656 - DNA, 152 bp, Homo sapiens
tcatggcasaatttatttattaactcaacacatasttattaaaaatcctccataagaaagacasgtagcsgggtasgtggctcasacctgtaatccsagcacttttagaggctsaggtgggtggatcacctgaggtcaggagtttgasacca

SEQ ID NO: 12657 - DNA, 54 bp, Homo sapiens
  misc_feature 23: n=a, g, c or t
gtaggtcatatcgccgcgghganwtttgctctgtgttgtattaagtctgcgcta

SEQ ID NO: 12658 - DNA, 145 bp, Homo sapiens
atatccgtgcgccgagctgataaaggcgccattttggaggggccgcgggatacgtggtgccgctgcgggctcgctctgccgtgcgctaggcttkgtgggaaggcctgttctcgagtccgcgcttttcgtcaccgccatgtcggga

SEQ ID NO: 12659 - DNA, 321 bp, Homo sapiens
tattctggattttctctaacaaataatacttgatagggccaggcatggtggctcacgcctacaatcccagcacttttggaggctgacaggggtggatcactttagctcaggagtttgagaccaacctgggcaacatggtgaaacccatgtctaccaaaaatacaaaaaattaaccgggcctggtggtgtgtggtcccagctactaaggaggctgagatggaaggatgacttgaacccgggaggcggaagttgcagcaagccaagatcacgctactgcactccagcctgggtgacccagtgagaccacatctcaaaaaaaaa

SEQ ID NO: 12660 - DNA, 240 bp, Homo sapiens
gactcacgccttgggaggccgaggcgggtggattacctgaggtcaggagttcaggaccagcctggccaacatggtgaaactccgtctttacaaaaaatacaaaaattagccgggcgtggtggcatacgcctgtaatcccagctacttgggaggctgagacaggagaattgcttgaacctgggaggtggaggttgcagtgagccaagatcgcgccactgcactctagcctgggggacatag

SEQ ID NO: 12661 - DNA, 292 bp, Homo sapiens
tatatgtttggctgggtgtggtggttcacgcctgtaatcccagcactttgggaggccgaggcaggcggatcacaaggtcaggagatcgagaccatcctggctaacacggtgaaacccatctctactaaaaatacaaaaaattagccgggcatggtggtgggcgcctgtagtcccagctactcgggaggctgaggcagaagaatggtgtgaactgggaggcggasttgcagtgagccgagatcgagccagtgcactccagcctgggagacagagcgagactctgtctcaaaaa

SEQ ID NO: 12662 - DNA, 177 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaacaaaaggacaaaaaaaaaaaaaaaaaggttttttg

SEQ ID NO: 12663 - DNA, 293 bp, Homo sapiens
  misc_feature 61..62: n=a, g, c or t
tactagatggcagccagtgatggaactataaagatgtctgtggtcatatgttgaatgtggnnkcttgaagatgtactgccacgggtgatctagggcaggctgtcttccagtccatgtgttctcggtcgccgtagacagcgctctggctaccaccgtgagctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaargs

SEQ ID NO: 12664 - DNA, 424 bp, Homo sapiens
atgggatatgcctagaaacgtgtctttttaaaaaagcctctatgataattttgacatccattgttgagaaccactgctgtaatgaaacttaaattttggttttcatttcattattcgtcaaaggtttgaaatgatcttttagtcaagtcttatggtaattttggttcttgaaggctccccagtatgagccactttggctaattagaattaatctagttttaaaatacatatcacataataactttttgctgaataatcctttgtgaattttaactcacttgctatgtattttagtcatttacaggtggaggatacagattgggtagttctttttgtaagcggtctgaatatatctatggagaaaatcagctgcaagattgtaggtacaataatcaaaatgaaaaagtataaatatttgcttcta

SEQ ID NO: 12665 - DNA, 396 bp, Homo sapiens
  misc_feature 106: n=a, g, c or t
atcagtttcagttttggaggctggaascaagatgaaagcaccagtagatgcaacctcttttgtgagggtgatggtcccatgatgaggctgtgccctgycctgtgwncggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgastgcctgcaggcccctgcgtcattcctcagctgcgtgcgaggcctctgg

SEQ ID NO: 12666 - DNA, 214 bp, Homo sapiens
tacgaaggaaatgcatgcggccaggaggagaatccgcaccaggagcagggagctctacccaggaaaaagaagaaaaggacagattcatttggggttcagcctcatgccccccacacccaagactttgtggctaagagaatcaggccaccttgaggttcatcaagttcatcccattaaaacctcccaaaactctgcaaaaaaaaaaaaaaaaagg

SEQ ID NO: 12667 - DNA, 380 bp, Homo sapiens
cagaaagcattagtatgtcgaggagcactcataactcttgagttccaacgaaaggtgatatctagaagattaataaatgtttaatttaagagaacattggttgggcacggtgtcttatacctgtaatcccagcactttgggaggccgaggtaggcggatcatttgaggtcaggagttcgagaccagcttgaccaatatggtgaaactctgtctctactaaaatacaaaaaattagccaggtgtggtggtgggtgtctgtaatcccagctaattgggaggctgaggcaggagaatcgcctgaacccaggagacggatgttgcagtgagccgagatcacaccactgcactccagcctgggcaacagagcaagactccctctc

SEQ ID NO: 12668 - DNA, 182 bp, Homo sapiens
  misc_feature 90: n=a, g, c or t
cattggatgcatgatggggcagggccggtgatggtgcctcccccttgctggtgtcaggagaggggaaggcagccgctttcaccgctcatnatgtagtctggctacagccctcaaaaacagcttatactctwaagactaattttgaaataaaaccttcatttaatcaaaaaaaaaagaaaaaa

SEQ ID NO: 12669 - DNA, 490 bp, Homo sapiens
tttttcctccacctcttccccctccctgcatcatgttatataagagacttgagcatctgtggattttgttatctgcagggagtcctgaaaccatggatactgagggaaaactatatgatttcccccaagaaggcagtgacatgcacctgtaactctttttcccctagacatatctgtgacatgcttaactacttttatttttccgatgtcaccttaatcagagaaaacttcccagaccaccctatgtaaaataaagcacctctgctgctgctttattctccttaacactactttttttctatagcacctgtcaccagttgacaggttaagtttaacaacttctctcctgtagaatatgaggtgctttaaaatacatgtatgactgaacctcacccacacctactgaagctcttcatttcgggttctgaatgcctattttggggaaacatttctgggattatgacagacatttcaatgacaacctgctcta

SEQ ID NO: 12670 - DNA, 526 bp, Homo sapiens
cccgcttagacaatgccccggagccgccagaccgtcgcgcccctgccccatcgtagtatatgagctcgcctacacaaggacccccgctaaaagccagagccccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctgga

SEQ ID NO: 12671 - DNA, 120 bp, Homo sapiens
ggccgggcgcggtggctcacgcctgtaatcccagctctcagggaggctaagaggcgggaggatagcttgagcccaggagttcgagacctgcctgggcaatatagcgagaccccgttctcc

SEQ ID NO: 12672 - DNA, 459 bp, Homo sapiens
ataattgtattttaattaaatgtttttataaacatttagtcaaaatgtacctagagtcaaaatagcagtttttgaaaagtatcttgttctgtgagtatggtgatgaacaaatcaaaacatactctcaggactttataagttactggggaaggctgacattaaataatttgttacataactaattattgagataatgttgaggtaatagggtaactagatctaatttggcaatcggaaatttaagttgtacagagagtagaagthmatttagataagggcattagaagaagacaggtaaaagtctatagctggaaatagcatacttccttsaagattactaggactcatggattttaagcaagagggatactttatcagattcacatttaaaaatagatahctataataaatgtggaaacggttttagagaatagaggtggcaaaagacgctgtcagtag

SEQ ID NO: 12673 - DNA, 505 bp, Homo sapiens
cactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactgtggaaaaggattgctgattctgactgacccctgatcagagacatta

SEQ ID NO: 12674 - DNA, 292 bp, Homo sapiens
accaaggccgagtgtggtagctaatgcctgtaatcccagcactttgggaggctgaggtgggcggaacacttgagctcatgagttgaagatcagcctgggtaacatggcaaaaccttgtctctacaaaaaatatagaaattggcgtggtgtggtggtgtgtgcctgwagtcccagctgcttggggggccgvggcaggaggatcgcaccagcctaggaagtcaaggctgaggtaagatgtgttacatgccactgtgctccagcctgggcaacacagtgagactctgccaaaaaa

SEQ ID NO: 12675 - DNA, 444 bp, Homo sapiens
tttagttgtgaatcagaagttttagagctagaaaagaaaaaatgattatgtagttccatgctcactttttttttgttgtttttgaaacaagagttttgctctgttgcccaggctagagtgcaatggcgcagtctcaggtcactgcaacctctgtctcctgggttcaagcgattctcctacctcagcctcctgagtagctgggattgcaggcacctgccaccacacctggctaatttttatatttttagtagagacggggtttcaccatgttggccaggctggtctcaaactcctgacctcaagtgatccacccaccttggcctcccaaagtgttgggattacaggtgtgagccaccgcgcctggccaccatgctcactttttacagcattggaaaggctaagtgatttacccaaaaccatgtattagtggtactgctaggactg

SEQ ID NO: 12676 - DNA, 298 bp, Homo sapiens
tgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaggctgaggccgtatcacttgaggtcaggtgtttgagattagcctggccaacaagctgaaactccatctctacta

SEQ ID NO: 12677 - DNA, 429 bp, Homo sapiens
agcgctgcacgccggcggcagcatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacatcta

SEQ ID NO: 12678 - DNA, 397 bp, Homo sapiens
cattaattttattgatttttaaaaaattaaatgttctgagttgtagattcacatgcagttgtgaaataatgtagagtgagcctagatatcttttacctgttttgccccagtgttaacatcttgcataactattaatacaatatcacaactaggatattggcattaacacagtcactctatagaacattcctgtcactgccaggagtcatgctaccctttatagtcatacccaccttctacccctgaacttggccaactgttattctgtaatcgatttctataattttgtcatttcaagaatgttccataaatgaagtcatacatttatgacttcatttgacccagtatgtgaccttttggcattgactttttttatccagcgtgattccctagagag

SEQ ID NO: 12679 - DNA, 328 bp, Homo sapiens
  misc_feature 319: n=a, g, c or t
acagcctgggcaacacagtgagaccctatctcttcaaagaaaaaaaaaaattggccgggcgtggtggcaggtgcctgtggcccttgctactgacagggctgaggcgggaggatgtcttgagcccaggagttgggctgcagtgagctgtgattgtaccactgcactscagcccaggcgacagagggtgaccctgtgtacaaacaaacaaaagaatagtattttgtgacccatgaaaatgatatgacattcaaatttcagtgtcaaaaagtaaagttttggccgggcccagtggctcaacgcctgtaatcccagcagtttnggaggccga

SEQ ID NO: 12680 - DNA, 318 bp, Homo sapiens
tattctggattttctctaacaaataatacttgatagggccaggcatggtggctcacgcctacaatcccagcacttttggaggctgacaggggtggatcactttagctcaggagtttgagaccaacctgggcaacatggtgaaacccatgtctaccaaaaatacaaaaaattaaccgggcctggtggtgtgtggtcccagctactaaggaggctgagatggaaggatgacttgaacccgggaggcggaagttgcagcaagccaagatcacgctactgcactccagcctgggtgacccagtgagaccacatctcaaaaaa

SEQ ID NO: 12681 - DNA, 88 bp, Homo sapiens
ttttccactatggcttcsagcactgtcscggtgagcgstgsttgctcggmtaatgaaactcccgaaatascggacaacgtgggagatt

SEQ ID NO: 12682 - DNA, 83 bp, Homo sapiens
tgacaagtgtgtcttcgtttcgtagctggaactcagctcaaggacactgttgctgaggcctcaaaggagtgcagacttcctga

SEQ ID NO: 12683 - DNA, 460 bp, Homo sapiens
aaaaaagcagaagcggaagtaaactcattcacttattaacaaataattactggctagatgaagtggattatacttgtaatcccaacactttgagaggtgaaggcaagaggattgcttgaagttcaagccagaagttcaagactgcattgagacatgattgcaccactatactccagcctgggcaacagagcaagatcccatctcaaaaatttagcagggtgggtgcggtgactcatgcctgtaataccagcattttggaaaactggtgggcggatgacttgagctcaggagttcgagactaggctaggcaatatggtgaaatcctgtctctatgaacaaaaattagctggatgtggtggtgtgttcctgtggtcccagctacttgggaggctgaggtgggaggactgcttgggctgataggttgaggctgtggtgaaccgtgattgtgccactgctctgc

SEQ ID NO: 12684 - DNA, 177 bp, Homo sapiens
cccaagccccactccatggkgccaggtttcctsacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttg

SEQ ID NO: 12685 - DNA, 361 bp, Homo sapiens
caagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaa

SEQ ID NO: 12686 - DNA, 138 bp, Homo sapiens
cagtactgtgacccagcttgcagcctttactaagagcatgtcttccctccaggatgatcgtgacagggtgatagatgaagctaagaaatgggagaggaagtttagtgatgcgattcaaagcaaaaaaaaaaaaaaaaa

SEQ ID NO: 12687 - DNA, 395 bp, Homo sapiens
cctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctggccaaaaaaaaaaaaaaaagg

SEQ ID NO: 12688 - DNA, 468 bp, Homo sapiens
  misc_feature 284,370: n=a, g, c or t
aggagggcgttctgggtttcgggctggggagctggcagaggcgcgtcttacccctgtggtgggtgtcccgaggccggcgcgtctgtggacaggcaacgcaggccggagggctaggactccggcctctgagaggcgggcggttgtccaggggagtccttcgtgccggcgggaagcgcaagggtgccggaagcctgaggtccgccgcccggccaccccttctcgcatcttgactctgagatttgctccgggtccggcggggagactcgaggtcgatcgggagtttnggttgagaaaacgcccactgagcggtagctcttgtctccttgacatctgagccctgggaattaaactcacgctacataaaacggtnggcacagacccccttgagaatctggggcggtgacggatgcccgaagctgtccactttgagggcgaaaattgtaagcagtgttgcaacgatttttaaaa

SEQ ID NO: 12689 - DNA, 281 bp, Homo sapiens
cattttagaaggatctatttggaaggatccatttggaaggattgcttgagcccaggagttcgagactagcctgggcgatgtgatgagacactgtatttacaaaaatacaaaaaaattaaccaggtgtggtgacatgtgcctgtagtcccagctattcgagagcctgaggtaggaggatcacttaagcctagggaggccaaggctgcagtgagccgagattgcaccattgctctgcagccagcctgggtgacagagtgagaccgtgtaacaaaaaacaacaa

SEQ ID NO: 12690 - DNA, 453 bp, Homo sapiens
  misc_feature 437: n=a, g, c or t
tttttgagacggagtctctctctgtcacccaggctggagtgcagtggtgcgatctctgctcactgcaagctccgcctcccgggttcacgccattttcctgcctcagcctcccgagtagacaggactacaggcatgtgccaccacgcctggctaattttttgtatttttagtagagatggggtttcactgtgttagccaggatggtctcgatctgctgacctcgtgatcttcccgccttggcctcccaaagtgctgggattacaggcgtgagcaccgcgcccggcctgattcttctctgttcataaaactctttgtcmcgtctcaggaaaatctatcttgccagatctctaccagttaatgctaattactaatagatttatccacctttttgtctgcaaagtcaagacaagtacacatttagatgtggcagaaatganatgttacttcatagca

SEQ ID NO: 12691 - DNA, 460 bp, Homo sapiens
tcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaatt

SEQ ID NO: 12692 - DNA, 61 bp, Homo sapiens
cttttcctttcagcggascgggcgcaagatggcagtgcaaatatccaaaaaaaaaaaaaaa

SEQ ID NO: 12693 - DNA, 193 bp, Homo sapiens
caagggatcgagactatcttggccaacatggtgaaacccatctctacaaaaaatacaaaaattagctggtcgtggtggcacatgcctgtagtcccagctactcgggaggctgaggcaggagaatcgcttgagcccgggagacagaggttgcagtaagccgagaccacaccactgcactccagcatggcgacag

SEQ ID NO: 12694 - DNA, 447 bp, Homo sapiens
cttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagacgcggcgctgacccttccaggtcagctggagttgacccgcccacctgggcttttcaaccccagtccgcgagtttctttcttgaa

SEQ ID NO: 12695 - DNA, 315 bp, Homo sapiens
tatcgtcgggcacggtgactcacgcctgtggtcccggcatcttgggaggctgaggcgggtggatcatgaggtcggatcgggaccatcctggccagcatggtgaaacctgtctctgataaaggtgcaagggttatccgggtgtggtggtgtgtgcctgtggtcccggctgctcggggggctgaggcgggagagtcgcttgggcccggaaatcggaggttgcagtgagtgagctgggatcgcgccactgcactccagcctggcgacggagtgagactctgtctcaataaaaaaaacaaaaaacaaaaacaacaacaa

SEQ ID NO: 12696 - DNA, 108 bp, Homo sapiens
atttttcatagagacatggtttcaccatgttagccatgatggtctcgatctcctgacctcgtgatccacatgccttggcctcccaaagtgctgggattacatgcgtga

SEQ ID NO: 12697 - DNA, 398 bp, Homo sapiens
attcccagcgtgcagctcagcaaggggtccgtccttctctgtcactgtctcttttgcctgttgtaattctgtctgcctctctgggactctgcctgtctcactctttctgtctgtgcctctcctcactcttgttctttctgcctgaatcacagccctcagtktttctgtcctcatgcatttgtctttgtggctctttccgtctttctgcccttgacaccatcccctctcccagtgcttcccctctgcttccagatcgcttcatgacttaggcagggaaacagaggtcagggcctccttccaggcttccctctgcatcttactgagtatgcgtcggaagagcctcgggtcctgcctccgcgggtggcctagagccaaaggaaggcggascgttcggggcg

SEQ ID NO: 12698 - DNA, 267 bp, Homo sapiens
cattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattaccgtcatttccttttgagcttgtggacaagctgaatgtcaggactgacttctccagctcccagccctgcggggtgtccttggcatcccatcagcagaggagatgcgtcccttgtt

SEQ ID NO: 12699 - DNA, 318 bp, Homo sapiens
cagaaaatcttaaaatatgtatcatcgagggctgggcgcggtggctcacgcctataatcccagcactttgggaggccgagacgggcagatcaggaggtcaggagatcgagaccatcctggctaacacggtgaaacccagtctctactaaaaatacaaaaaaaaattagccaggcgtggtggtgggtgcctgtagtcccagctactcaggaggctgaagcaggagaatggcgtgaacccgggaggcggacttgcagtgagccaggatcacaccactgcactacagcctgggcgacagagcgagactctgtctcaaaaaa

SEQ ID NO: 12700 - DNA, 385 bp, Homo sapiens
tagtgaagatttaaaagtgggtagtgttataaagagtaaagtatatttgtagttattgacctgcgaggatacgcgattttgattgagtaaaggaagcaaattggccgggcatggcggctcatgcctgtagtcccagcactttgggaggctgaggcgggcagatcagttgaggttagtttgaggccagcctgaccaacatggcgaaaccccgtctctacaaacaaatgcaaaaattagccgggcaaggtggtgcctgcctgtaataccagctacgcgggaggctgaggcaggagaatcgcttgaacccgggaggtggggctgaagtgagctgcaattgcaccactacactccagcctgggcgacagagcaagattcggtctcaaaa

SEQ ID NO: 12701 - DNA, 50 bp, Homo sapiens
atagcctttgtaggggttttttggttcctttttttttttwcagtttttgt

SEQ ID NO: 12702 - DNA, 286 bp, Homo sapiens
  misc_feature 218: n=a, g, c or t
gggtgcattggctcacgccagtaatcccagcactttgagcggctgaggtgggaggattgcttgggcccgggagttcaagaccagcctggacagcaaggtgaggccccatttctacaaaaaattagccacatgtggtggcatttgcctgtagtcccagctgcatgggagagtgaggtgagagggtcgcttgggcccagaggtagagactgcagtgagcngtgtttgcacccctgcactccagcctgtgtgacagagtgagactgtgtctccaaaaaaaaaaaaaaaa

SEQ ID NO: 12703 - DNA, 315 bp, Homo sapiens
  misc_feature 178..179: n=a, g, c or t
actcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagnnaaacacagtrccatcctggcatcccccaaccccgatgagaagaggdwggaggagctggaagaactcatgtccgacataaagaagacagcaaacaaagttcgttccaagttaaagakcatcgagcagtccatcgagc

SEQ ID NO: 12704 - DNA, 219 bp, Homo sapiens
gagaccagcctggccaacgcggtgaaacctgtctctactgaaaatacaaaaattagctgggcgtggtggcaggcgcctgtaatcccagctacctgggaggctgaggcaggagaattgcttgaacccgggaaccagaggttgcagtgagccgagatcatgccattgtacttcagcctgggcgacagagtgagactccatctccaaaaaaaaaaaaaaaaa

SEQ ID NO: 12705 - DNA, 63 bp, Homo sapiens
  misc_feature 20,25: n=a, g, c or t
cttttcctttcagcggacgnggcgncaagatggcagtgcaaatatccaaaaaaaaaaaaaaaa

SEQ ID NO: 12706 - DNA, 184 bp, Homo sapiens
tatagcagtcttttgataacaatagttaagaggccaggcacggtggctcatgcctgtaattccggcactttgggaggctgaggcgggcggatcacctgaggttgggagttcgagaccggcctgggccaacatggtgaaacccgtctctaccaaaaaaaaaaaaaaaaaggcttatcgawaccgt

SEQ ID NO: 12707 - DNA, 199 bp, Homo sapiens
aaatacaaaaaattagctgggcgtggtggcgggtgcctgtagtcccagctactcgacgctcagtagctattcagtagctactgaggcaggagaatggcctggacccgggaggtggagtttgcagtgagccgagatcctgccactgcactccggcctgggtgacagagcaagactctatctctaaaaaaaaaaaaaaaaa

SEQ ID NO: 12708 - DNA, 299 bp, Homo sapiens
tacaaataaaatatcaaaaacatggccaggcgcggtggctcacgcctgtaatcccagcactttgggaggccgaagccgcggatcacgaggtcaggagatcgaaaccgtcctggctaacacagtgaaaccccgtctctactaaaaatacaaaaaattagcctggcttggtgctactcgggaggctgcggcaggagaatggcgtgaacccgggaggcggacttgcagtgagccgagatctcgccactgcactccagcctgggtgacagggcaagactccatctcaaaaaacaaaaacaaaa

SEQ ID NO: 12709 - DNA, 134 bp, Homo sapiens
caaatccggagtagttcgtgccacagtcgtcctcggaaccctgtggccccttcctcacccgtttcagggccacttggttcccacctccaccttcttagtctgcctgccctgctttccatcttcttggaattcgc

SEQ ID NO: 12710 - DNA, 81 bp, Homo sapiens
acaaaataatatattaaattcatgtttgggcactggcaataactgatgttaaaaaaaaaaaagcgccaaagtatagtcaga

SEQ ID NO: 12711 - DNA, 293 bp, Homo sapiens
ttctggatgagtgtagtggctcacgcttgtaattccagcagtttgggaggccaaggtgggagaattgcttgagcctaggagtttgagatcagcctgggcaacataactagatgctgtgtctacaaataataaaaaaattagctgagtgtcgtggcctgtgtatctggtcccacctactcgggaggctgggatgggaggattgcttgagcctaggaggtcaaggcagtagtgtgttgtgataatactaccgtactccagcctgggcaacagagtgagaccccatccctccacaa

SEQ ID NO: 12712 - DNA, 372 bp, Homo sapiens
ggattacaaaaattggctgggcatggtggcgtgtggctgtggtcccagctacttgggaggctgaggcaggagagtcacttgaactcgggagccagagactgcagtgagctgagatcgcgccactgcattccagcctgggcgacagagtgagactctgtctcaatcagtcaatcaatcaatcaatcaaattggaatatgagcactaaccttggtaagttaaaattttgggaaaattgtacctgcagaatatgatggatgaaaacaacagccaggtgcggtggctcgcgcgtgtaatcccagcactttgggaggccgagacaggcacatcatctgaggtcaggacttccagaccagcctgtccaacatggtgaa

SEQ ID NO: 12713 - DNA, 208 bp, Homo sapiens
  misc_feature 125: n=a, g, c or t
ttactttttgataataggctgttgtttttcttaaataagcttaaaacaattctatctgaaattggtagcatgggttcacttggctacaactgagcaaaatagatgcaactttcttttaatggggnctgcctctttaggactgactgtactatccactgacactggtttggcagttggtactgctgaacatttttatacatgctaccat

SEQ ID NO: 12714 - DNA, 264 bp, Homo sapiens
tttcctgaagctatgcttctatttctggactcatcgccaagtcacctgaaggcaatacaaatgaagtatctgggccacatgcagtggctcacgcctgtaatcccagcactttgggaagctgaggtgggaggataccttgagcccagaaaaaaaaaaaattagcctggcatggtggcacgtgcctgtagtcccagttacttgggaggctgaggtgggaggatcacttgagcctgggagttggaggctacattgatccttggtcgt

SEQ ID NO: 12715 - DNA, 120 bp, Homo sapiens
ttttattttctgtttgtccccacctccccagccttccacctcctgttcttcctamcttcttcctttttgactaaataatccccacctcccttgatcatacagtgaggctacagtgactga

SEQ ID NO: 12716 - DNA, 479 bp, Homo sapiens
  misc_feature 40: n=a, g, c or t
aatgtcccattggatcctattactgagccatctccttcanccccctttccgccccctcctctaggtttccgagagggagcagcaggggattggcgcccgtktccccgcccgacagccgcccgacagccccccgacccgtggccccattacagcgcgtgggcggcgatccagcaggaggaggcgcagatccacaggccgaagagatgcagacgcggttgcgggcgaaagcggtccaggagtcgctggtgttgatgctgaaaagttacaggatctcttccaggaggaggatggcagtacagcagcttaccctacaaagacaacatgaatgacaacagtgcagcctaagtgccatctgtggcctcagaggagacagctccacccagtcacactctgatggagctttctgccttctggttaagttagctgagttgagtttttggtctactgcagctgaagagtcctttttctaatacatcaat

SEQ ID NO: 12717 - DNA, 169 bp, Homo sapiens; identical to SEQ ID NO: 12600

SEQ ID NO: 12718 - DNA, 328 bp, Homo sapiens
atgggacatagtcttaaaaatgtctgaaacakgctgggcatggtggctcacacctgtattcccagcagtttgggaggctgaggtgggtggatcacgaggtcaggagaccgagaccatcctgaccaacacggtgaaacctcgtctctactaaaaatgcaaaaattggctgggcatggtggtgtgcacctgtagtctcagctacttgggaggctgaggcaggagagtcatttgaacccgggaggcggaggttgcagtgagccgagataggccactgcactccagcctggcagcagagtggagactccatctcaaaaaaaaaaaaaaaaag

SEQ ID NO: 12719 - DNA, 333 bp, Homo sapiens
  misc_feature 7: n=a, g, c or t
tgtttantcccgggacgtgggcagaccttgtaccaggcgagctctcgctttgctagcaaaagagctcctctcttcccaaaccctgctactacgctgtccaccccgtatggtctttgaggtctttgaggtttttttggaattcacttgctggagactacagctcacagaacgccctgggctggattgtgccagctgtagttcgcgaaccaaggacatttcctggaaatgcatgcggccacgttatctgtgacagaaatggcagttgctsacgtgcgttacgccccctrgaagacttrgraatacggaacttgagtgagcactgwgaggatacag

SEQ ID NO: 12720 - DNA, 291 bp, Homo sapiens
accaaggccgagtgtggtagctaatgcctgtaatcccagcactttgggaggctgaggtgggcggaacacttgagctcatgagttgaagatcagcctgggtaacatggcaaaaccttgtctctacaaaaaatatagaaattggcgtggtgtggtggtgtgtgcctgtagtcccagctgcttggggggccgaggcaggaggatcgcaccagcctaggaagtcaaggctgaggtaagatgtgttcatgccactgtgctccagcctgggcaacacagtgagactctgccaaaaaa

SEQ ID NO: 12721 - DNA, 203 bp, Homo sapiens
tgaactatcaaacttaggagccatctagcttacacgtgttccttaaaaagtttgctgtaggccgggcacagtggctcgtacctgtagtcccagcacttttgggagcccagggtgggggatcacttgagctcaggagttcaagaccagcctgggcaacatggcaaaacgccatctctacaaaaatacaaaaaaaaaaaaaaaaa

SEQ ID NO: 12722 - DNA, 329 bp, Homo sapiens
cagaaaatcttaaaatatgtatcatcgagggctgggcgcggtggctcacgcctataatcccagcactttgggaggccgagacgggcagatcaggaggtcaggagatcgagaccatcctggctaacacggtgaaaccagtctctactaaaaatacaaaaaaaaattagccaggcgtggtggtgggtgcctgtagtcccagctactcaggaggctgaagcaggagaatggcgtgaacccgggaggcggasttgcagtgagccaggatcacaccactgcactacagcctgggcgacagagcgagactctgtctcaaaaaaaaaaaaaaaaag

SEQ ID NO: 12723 - DNA, 400 bp, Homo sapiens
cacctgtgtattctcttcagtgaatcatctggatgtcttttgcccactttctttttttttcatttttattattttcattaatttttttctttggccactggaataaagactcaccattttctaactgagtgatgttttttaaatatatattttttagagacagggtctcactctgtggcacagagtgcattgtagctttgaactcctcagctcaagctgtcctcccgcctcagcctcatgagtagctagtactacaggcacatgccactacacctggctaatttttttatttgtttgtggagacagggtcttactatgttgctgaggctggtgtttaactcctggactgcagtgaccctctcatctcagcctcccaaagtgttgggattacaggcatgcg

SEQ ID NO: 12724 - DNA, 499 bp, Homo sapiens
cacttttatagctgaataatatttcattgttcatatcacattttgtttgtccattcgtccactgatgggctttgaattgtttccaccttttccctatttgaatactgctgctgtgaacattttgtttgaacatctgttttcagttctttttggtatatactaaggattggaattactgggtcatatggtattttaggtttaaccttttgaggaaccaaaaaaagtttcaaacattaattggtttgccttttaaattgagaaatttaaacattgtatttatttatcgtgtacaatctgatgttttgaaatacatatatgtatgttgtggccgggcacggtggctcacgcctgtagtcccagcactttgggaggtcgaggcgggtggattacctgaggtcagaagtttgagaccagcctggccaatgtggtgaaacctgtctctactaarratacaaaaaattagccgggcttggtggtagcgcctgtagtcccagctact

SEQ ID NO: 12725 - DNA, 263 bp, Homo sapiens
ctttgggaggccaaagctggcggatcatgaggtcaggagtttgagaccagcctgaccaacatgctgaaaccctgttgctactaaaaatacaaaaattgaccgggcatggtggcgcgtgcctgtggtcccagctactcaggaggctgaggcgggagagctgcttgagcctgggaggcagaggttgcagtgagccaagatcgcgccactgcactccagcctgggtgacagagcgagactcttgtcccacaaaaaaaaaaaaaaaa

SEQ ID NO: 12726 - DNA, 322 bp, Homo sapiens
gaaggaatttgggagacaaaaaatggagactcagaaaattagagaagagaaaaatgggaggggggagcctggacaataaaacgggggtcctcaggaggcaggaaattagcgattaaatgggagcagaggtggaggaggccgacactggtgccagagataaaagtggagtcccaaaaaaaggggtgcgctgggccgtttttaaaattgggaaacataaaaaatacccagtggaaaatgaagagagagaacggggcatgctaaagttaacatgggcggcgagaaagggacaggtagccagcggaaaakggggagactgagaaac

SEQ ID NO: 12727 - DNA, 261 bp, Homo sapiens
  misc_feature 56: n=a, g, c or t
gactcacgccttgggaggccgaggcgggtggattacctgaggtcaggagttcaggncagcctggccaacatggtgaaactccgtctttacaaaaaatacaaaaattagccgggcgtggtggcatacgcctgtaatcccagctacttgggaggctgagacaggagaattgcttgaacctgggaggtggaggttgcagtgagccaagatcgcgccactgcactctagcctgggggacatagcaagactttgtctcaaaaaaaa

SEQ ID NO: 12728 - DNA, 138 bp, Homo sapiens
aattagaactttatgttcatcaaaagataccattaagataccccataggccaggatacaataatcacaacacatatatctgaacttatatgcagaatgtatcttaatactcttacaactcaaaaatacagatacttta

SEQ ID NO: 12729 - DNA, 243 bp, Homo sapiens
  misc_feature 48..49: n=a, g, c or t
aatttgtgtgatttctggctgtttctttatgtttcatgkcgtgctksnnsattttggagaaaagacaaaaataggctaacwttgttttacaactagggaaaatgtgcatagaattgttcatatttgcaaaatgaattaatagaactacttaaaattagattttcctgctttaaactcccgttctttatcctctgtttccataactcagctatgtatttttgtttgtttataatcgtttgtttg

SEQ ID NO: 12730 - DNA, 413 bp, Homo sapiens
cagtggctcatgtgtgtaatcccagcactctgggaggctgagacaggtagatcatttgaggtcaggagttcaaaaccaacctggtctacatggtgaaacccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaacctgtctctattaaaaatacaaaaattagctgggcgtggtggcgcatgctgtagtcccaactactagggaggctgaggcaggagaatcacttgaacccaggaggtggaggttgcagtgagccgagatcacgccactgcactccagcctggcgacagagcgagactccctccca

SEQ ID NO: 12731 - DNA, 393 bp, Homo sapiens
aaaaaaaaawtttccaacttcttttgsattsgaastacttactagggacccaagaaagcaatcaagtggaagacgttggagtgggattcctgatatcttgagttcctcctcagagccaagtgagcctcccttgcagctagggtgcaggcatgtgaccttggttcctccaatcatccttgcccacctgagasgccaactgagtgatgagctatgcatgggaahagctgtgtgcagggcatcctttttctgccagcctggtggcatttaaagcagtgtggcctggagtcagtgacagtgggtggcaggtcctccatgagtctgattctgcaatatgcttcttggagaggctcttgaaagctgcatccagatcctgtttctctaacatccctaaat

SEQ ID NO: 12732 - DNA, 119 bp, Homo sapiens
tttaggatcagatctgtgagcacgttggcgaggaaaaacaaaacaaacaaaaaaaagaaccttgtgtctgtctggtgaaaaaaagaaaaacaaattggaagagaggaccatgagaattt

SEQ ID NO: 12733 - DNA, 387 bp, Homo sapiens
taacaaaacggtttttttcttccctttttccttccctgatgctttgacctatgtcatttccttgggctaaagagtgtattgaaagaaagaaaggccaggcgtgatggctcatgcctgtaatcccagcacttggggaggctgagtcaggtggatcacgaggtcaggagatcgagaccatcctggctaacatggtgaaaccccgtctctactaaaaatgcgaaagaattagccgggcttggtggcacgtgcctgtggtcccggctactcgggaggctgaggcgggagaatcgcttgaacccgggaggcggaggttgcagagagccgagatcgtgccactgcactccagcctgggtgacagagggagactccgtttcaaaaaccaagcaa

SEQ ID NO: 12734 - DNA, 173 bp, Homo sapiens
tacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtcgcaaaaaaaaaaaaaaaa

SEQ ID NO: 12735 - DNA, 416 bp, Homo sapiens
cacaaaggatcttaaaaagctgtggactcatgggtcaggacttaataaagttgatttttactgctttttctgatgcaacactggtgtgtgtgtgtgtgtgtgtactgtgtgtgtggtggtgaagactcaattacaacaagaccagcacagtgtggtgccagtcttgagtcagtgcaggccccacagcttgtttccgcactgctcctacaccatcaatgtgaaagccatcacaaacaaaggggcatggtaacaaatcatggccgtgttattattaaaacagttctgatcctagccccccgagtggtctcaggaagcccccaggagactgcagatcacatttcaagaactgctgtgctagaggaacccccactagaagttaaggggtgcgtatcagccaagtgcagggctgggacagg

SEQ ID NO: 12736 - DNA, 400 bp, Homo sapiens
  misc_feature 240,254..255,326: n=a, g, c or t
attgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactnttcctgcatttccnncaagtttgccaacgatggtagcttcttgcagcagtttctgaagttgcagaaggcacagaccagcacagabnccccgaccagtgcgcccagcgccctcccagcacacccacccccagcgctgggaagaggtccctgctcatcagca

SEQ ID NO: 12737 - DNA, 494 bp, Homo sapiens
caaaaagaaatctttttaggctggagtgcagtgatgcagtcttggctcattgcaacctctgccccctgggttcgggcgattctcctgcctcagcctcccaagtagctgagcacccgccagcacgcctggctaatttttgtatttttagtggaggcggggtttcaccatgttggccaggctggtctcgagctcctggcctcaagtgatctgcccacctcggcctcccaaagtgctgggattacaggcgtgasactgtgccaagcctgaaaaaagttcattttaacagagcttatttactgtctgaaggttatcagataggcagatcagatctggcagtgttctccaaactggactgtgttttcaaaaatggatattgaacatgacatgttcttaagagagattctgttccctttcccccaaattctgcactctcagtatcctaacagggttcaaatctcaatgggaataattagacacagggaaacaacatagac

SEQ ID NO: 12738 - DNA, 56 bp, Homo sapiens
caaggtcagaacaggtttttttgtttttgttttttgttctttgtttttttttttga

SEQ ID NO: 12739 - DNA, 54 bp, Homo sapiens
aattgtgttcgcagccgccgccgcgccgccgtcgctctccaacgccagcgccgc

SEQ ID NO: 12740 - DNA, 257 bp, Homo sapiens
aatttactttcgagcatgttttgaagaggtagttagtcaatctttatgtcccttttgaagatatgatgaaatagttacatctctattatggaataamattaagtggtttaaaaaatgagtgatgtatggtctggcatggtggctcacgcctgtaatcccagcactttgggaggccgaggcaggtggattatctgatgtcaggagttcaagaccagcctggccgatgtggtgaamcccatctgtgctaaaaatacaaa

SEQ ID NO: 12741 - DNA, 310 bp, Homo sapiens
tttttctagggttgttacgaagctgcaggaggaaaatgaaatggaggaggaggaggaggaaaaagaaatggaggaggaaaaagaaacaggaggaggaaaaagaaacggaggaggaagaggaggaggaggacaaagaaacagccaggccggacgtggtggctcacccctgtagtcccagctgctcgggaggctgaggcagaagaatcgcttcaacccgggaggcagagtttgcgtgascgagatcgtgccactgcattccagcctggagacagagtgagactccatctcatctcaaaaaaaaaaaaaaaaa

SEQ ID NO: 12742 - DNA, 63 bp, Homo sapiens
acacggcgcgacaagatggcggataaggagaagaagaaaaaggagagcatcttggacttgtca

SEQ ID NO: 12743 - DNA, 155 bp, Homo sapiens
ttcccacacacctgtaatcccagctacttggggggctgaggcaggagaatcacttgaacctgggaggcggagattgcgagcagagatcacaccactgcactccagcctgggtgacagagcaagaccccatcttaaaaaaaaaaaaaaaaaagytt

SEQ ID NO: 12744 - DNA, 290 bp, Homo sapiens
  misc_feature 3: n=a, g, c or t
ccnagctttattgatcgcgtgggtgcgggtagggatctaaatttgtctcccagattttctctgaaatcgagtctcttgggagtgaaggtccatatgattacaccacgtccttagcagtcgcgttgtgttcaaaatgggcatgggtgctcgcggcgsgatactgagttccccagagacgcggagtcttttgccccaggggcttattcttgttttctcaatggaacaggtcttcgaatctccccaggaacatctcagtaagtaggggtgtgcgtgttttgtgtgtgtgtcag

SEQ ID NO: 12745 - DNA, 50 bp, Homo sapiens
caggatgggccaccagccacctcctccaactcaacaacattctataactg

SEQ ID NO: 12746 - DNA, 443 bp, Homo sapiens
tgaattaataatagtaacttattttaataatagtaacttattttataatttctgaattactttatttttcaaaaataaaagtgtgcatattactatttaatcataaacaagttccatcactatgatgtcaaggaggaaaccatttcatagaaaaatagaccaaagttaccctatgcatgagctactactaatctaaagccaacttcactctcagttatttcaataggacataagtttattgattgactctgtggttagttccagaaacccaacccctttgaaagttactgtacacatttgtaaataaatggtatatttagcacctatactatgacaattataaactcatttgtgtcatgtaaattttctttggataatataaccagacttcagatgaaaagacatagatctgcattaatctgtaaggtagcctagccacatgt

SEQ ID NO: 12747 - DNA, 53 bp, Homo sapiens
ctttgcatctgcacgtgttcgcagtcgtttccgcgatgctgcctctgctgcgc

SEQ ID NO: 12748 - DNA, 74 bp, Homo sapiens
aattgtgttcgcagccgccgccgcgccgccgtcgctctccaacgccagcgccgcctctcgctcgccgagctcca

SEQ ID NO: 12749 - DNA, 434 bp, Homo sapiens
atttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacg

SEQ ID NO: 12750 - DNA, 274 bp, Homo sapiens
aaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgcaaaa

SEQ ID NO: 12751 - DNA, 397 bp, Homo sapiens
  misc_feature 250: n=a, g, c or t
cttctcaaatgatttgggatgaaagactagttttttggctggtttatttctaattggttgtaaacagatacttaaaaaaaatgcaatcaacatgaatcgttagaaaagtgttggcagggcgcggtggctcacgcctgtaatcccagcactttgggaggccgaggtgggcggatcacgaggtcaggagatcgagaccatcctggctaacacagtgaaaccctgtctctactaaaaatacaaaaaattagcnggaagtggtggcgggtgcctgtagtcccagckactcgggaggccgaggcaggagaatggcgtgaacccgggaggcggatcttgcagtgagccgagattgcgccactgcsttccagcctgggcdacaaagcgagactccgtctcaaaa

SEQ ID NO: 12752 - DNA, 432 bp, Homo sapiens
cctttttagccggggattccagtgaatgaaaacggtagcaggggctcttttgagcttggtcatggggcagccctccgaggtcagcaatgtgcagaaggggtttggagagaaggcttgagcatgtgagggtggcacggccagcctcatcagcagcggactcctttcccagggcagagtggagggcagcaaacaggagaatgagcaacctacctaggtccttgggatgcccctcaggaggacgagctctagggggaatgctgggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgg

SEQ ID NO: 12753 - DNA, 187 bp, Homo sapiens
acttactcgattcctgaggcctgggcggcggcgagctccgggctccggcaccgcggggaaaccgggactggggctccgggtgctgctgcggcggccggggccscagtagtgggcgcctctgatggccttccgaaatgagaggtgcccagagagaaaacagtaccaaacaatctcgaaataaatcagg

SEQ ID NO: 12754 - DNA, 224 bp, Homo sapiens
tacagaaatacaatgtttgataaaatttcttgatcacaatatcttttttttattgttaaacttaaaggaactttattagtataaatttatggaggccgggcgtggtggctcacgctgtaatcccagctactcgggaggctgagccaggagaattgcttgaatatgggaggcagagtttgtggtgagctgacatcatgccactgcactccagcctgggtgacaag

SEQ ID NO: 12755 - DNA, 412 bp, Homo sapiens
ctagtcctggctccgctcggagcgcgcagacccggcggcggcgtggcgccgcggagaaatggcttccctgaggcaagtgtaacctacattcccagcccaccagcctgacgcccagccagggagagagtaccatggatggcatcattgaacagaagagcatgctggtgcacagtaaaatcagtgatgctggcaagaggaatggtttaattaacaccagaaacttgatggccgagagcagagatggtctggtgtctgtttacccagcgccccagtaccagagccaccgggtgggggccagctcagtgccggccagcctggacagcagcaggagtgagccgatgcagcagctgctggaccccaacaccctgcagcagtcagtggagtcccgctaccggcccaacatcatcctcta

SEQ ID NO: 12756 - DNA, 343 bp, Homo sapiens
gtttgaatcttggaattaaaaagagggcaggggctgggcgcggtggctcactcctgtaatcccagcactttgggaggccgaggcgggcggatcacaaggtcgggagttcaagaccagcctggccagtgtggcgaaaacccgtatctactgaaaatacaaaaaacaaaattagccaggcgtggtggcacgcgcctgtagtcccagctacttgggagactgaggcagaagaatcgcttgaacctgggaggcggaggttgcagtgagccgggatcgcgccactgcactccagcctgggagacagagcgagactccgtctcaaaaagtaaaaaaaaaaaaaaaaaag

SEQ ID NO: 12757 - DNA, 480 bp, Homo sapiens
actggtctcgaactcttgacctcaggkgatcctcccgcctcggcctcccaaagtactaggattacaggcaccatgcccagtggcatatatatttcttctaataaactcagcttgatgatgaggacgtgtcttagacatctttctgtccatggtgcctagtgcgtggctttcaataaatgtcaaatgaatgagttgatattctgagcagcatttaaaaataagagctagtggctgggcacggtggctcatgcctgtaatcccagcactttgggaggccagggcgggcggatcacgaggtcaggagatgagaccattctgggccagcgtggtgaagccctgtctctactaaaggtgcagaggttggccgggagtggtggtgggtgcctttggtcccagctgctcgggaggctgaggcaggagaatggtatgaacccgggaggcggacttgcagtgggctgagattgcgccactgcactccag

SEQ ID NO: 12758 - DNA, 409 bp, Homo sapiens
attgtattttttagtggagatggggtttcaccgtgttggccgggatgatcttgatctcctgacctcgtggtccgcccgcctcagcctcccaaagtactgggattacaggcgtgasaccgtgcccaaccatttgtcattttttattgtgggtacactagtgggtgttaagtcatatctgcttgtggttttgattttgcattttcttgatggcttgtgatgttaggcttttcttcaagcacttattggatgctcttatatcttcttcacaaaaatgtctatttaaatattttgcctatttttatgtattttttctttttgttgttgagttgtaaaagttatttgtgcattttggatacagatttctaatcaaatatataagttgcaaacattttcaaaaaaaaaaaaaaaa

SEQ ID NO: 12759 - DNA, 365 bp, Homo sapiens
tcaagatggcagtcaccttcattggcaatagcacagccatccaggagctcttcaagcgcatctcggagsagttcactgcsatgttccgccggaagscttcctccactggtasacaggcgagggcatggacgagatggagttcaccgaggctgagagcaacatgarcgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagatttgtgtttgctgcctctatcttgttttttgttttt

SEQ ID NO: 12760 - DNA, 376 bp, Homo sapiens
cacaagattaaatgaaggagatagatattaattacataatttcataaataattgattgattaaaactatggtaagtgctggctgggcacggtggctcacgcccataatcccagcactttgggaggctgaggcgggcggatcacggggtcaggagtttcagaccagcctgaccaacatggtgaaatcccatctctactaaaaatacaaaaattagctgggtgtggtggcatgcgcctgtaatcccagctactcaggaggctgaggcaggagaatcacttgaacctggcggggcagaggttgcagtgagccaagattgtgccactgtcctccagcctgggtgacagtgcgagactccatcccaaaaaaaaaaaaaaaa

SEQ ID NO: 12761 - DNA, 308 bp, Homo sapiens
ttctggatgagtgtagtggctcacgcttgtaattccagcagtttgggaggccaaggtgggagaattgcttgagcctaggagtttgagatcagcctgggcaacataactagatgctgtgtctacaaataataaaaaaattagctgagtgtcgtggcctgtgtatctggtcccacctactcgggaggctgggatgggaggattgcttgagcctaggaggtcaaggcagtagtgtgttgtgataatactaccgtactccagcctgggcaacagagtgagaccccatccctccacaaaaaaaaaaaaaaaaa

SEQ ID NO: 12762 - DNA, 199 bp, Homo sapiens; identical to SEQ ID NO: 12707

SEQ ID NO: 12763 - DNA, 411 bp, Homo sapiens
cataaagaggcaggtggaatgagaaggactctgtctagattggcttttttaacattctcattttcccaggagttatcactgtaaaagtatgcatggatatttatgtatttataaatcatgcactctaagatgagttcatcaacattgtaaaagccctcttttctgttttcaggttttttttttycttatcgacaaggtctsactctgtcgcccaggcagaagcacaaaggtgcagtattggctcattgcagcctcgaactcctgggctcatattttcagggtttttggtttttkgtttkgtttttttgagacagagtcttgcyctgttgcccaggcagtagtgcagtggcgcgatatatttycagtttttaaacgtcagaatttttgtttaaaatgccttttkgggctggg

SEQ ID NO: 12764 - DNA, 192 bp, Homo sapiens
ccccatctctcctaaaaatacaaaaaattagccgggcatggtggtgggcgcctgtagtcccagctactcgggaggctgaggaaggagaatggtgtgaacctgggaggtggagattgcagtgagcagagatcgcgccactgcactccagcctgggcgacagagcaagattctatctcaaaaaaaaaaaaaaaa

SEQ ID NO: 12765 - DNA, 141 bp, Homo sapiens
gyttttctacgtggttcggtastgctggctacgcrgcaggsggccctgmagaggaggctcagatggagtctcattctgtcacccaggstggagtgcagtggtrcgatcccggctcactacaacctscgcctccctggttca

SEQ ID NO: 12766 - DNA, 480 bp, Homo sapiens
taacaaaatcaactgttcaaactttgtggccaatactctccagtcaccaggcaagcctattattctgaggccttcacagcccaattctgctggccagccccgactgggactcatcaccccctgcaccgagagaataggagccaggacgccaagagcaagcagctccacggcctccactatttgaccacacactggacacgggaagaagctagtgatgtggttatgtcaaaacagccagctgagccagctgtgatggcagcccacacctgtaaccccagcactgtgggaggccgtggtgggaggatcagctgagaccaggagtttgagaacagcctaggcaacatagggagatgctcatctatacaaacaatttttgaaaattagctggggccaggcgcggtggctcacacctgtggtcccagcactttgggaggccgaggtgactggatcacctgaggtcaggagttcaagaccgcctgg

SEQ ID NO: 12767 - DNA, 85 bp, Homo sapiens
atttttcatagagacatggtttcaccatgttagccatgatggtctcgatctcctgacctcgtgatccacatgccttggcctccyw

SEQ ID NO: 12768 - DNA, 130 bp, Homo sapiens
tctgattaatattggtgtctgggccgggcgtggtggctcacggctgtaatctgagcactttgggaggctgagacgggcagatcacgaggtcaggagatcgagaccatcctggcaaaaaaaaaaaaaaaaa

SEQ ID NO: 12769 - DNA, 393 bp, Homo sapiens
  misc_feature 155: n=a, g, c or t
tatagattccttattttgtttattgtgaggcagagtctgactctgtcacccaggatggagtacagtgcatagctcactgcagtcttgacctcccaggctaaaccaatcattccacttcaccctcccaagtagctgagaccacaggcacacaacancacaaccagctgaktgttgtactgtttgtatagactggatctcactatgttgcccagactggtcttgaattcctgagctcaagcagtcctcccacctcagcctcccaaagtactgggattacaggcgtgaggtacctcgcccagccccagttacagatttctttgttccttctctctcccactgcttaacttgattagcctttaaaaaagaaataaataaaaatttttaaaaataaaa

SEQ ID NO: 12770 - DNA, 393 bp, Homo sapiens
tatagattccttattttgtttattgtgaggcagagtctgactctgtcacccaggatggagtacagtgcatagctcactgcagtcttgacctcccaggctaaaccaatcattccacttcaccctcccaagtagctgagaccacaggcacacaacaycacaaccagctgattgttgtactgtttgtatagactggatctcactatgttgcccagactggtcttgaattcctgagctcaagcagtcctcccacctcagcctcccaaagtactgggattacaggcgtgaggtacctcgcccagccccagttacagatttctttgttccttctctctcccactgcttaacttgattagcctttaaaaaagaaataaataaaaatttttaaaaataaaa

SEQ ID NO: 12771 - DNA, 389 bp, Homo sapiens
  misc_feature 277: n=a, g, c or t
tagtgaagatttaaaagtgggtagtgttataaagagtaaagtatatttgtagttattgacctgcgaggatacgcgattttgattgagtaaaggaagcaaattggccgggcatggcggctcatgcctgtagtcccagcactttgggaggctgaggcgggcagatcagttgaggttagtttgaggccagcctgaccaacatggcgaaaccccgtctctacaaacaaatgcaaaaattagccgggcaaggtggtgcctgcctgtaataccagctacgcgngaggctgaggcaggagaatcgcttgaacccgggaggtggggctgaagtgagctgcaattgcaccactacactccagcctgggcgacagagcaagattcggtctcaaaaaaac

SEQ ID NO: 12772 - DNA, 227 bp, Homo sapiens
gaaaactacaaaacactgctgaaagaaattatagaaaacacaaacaaaatggaaacacatcacatgctcatgggtgggtagaatcagtattgtgaaaatgaccatactgccaaaagcaatctacaaaatgcaatttccatcaaaataccactgtcattcttcacagaactagaaaaaaaactcccaaaattcatatggaaccaaaaaagggcctgcatagctaaagc

SEQ ID NO: 12773 - DNA, 362 bp, Homo sapiens
gaggccctggaaaacagcattccttctgcgtggaacatgccaaccctcgtctgctttgactttgcaaaactgcatgagaccgccgggcgcggtggctcacgcctgtaatcccagcacttcaagaggccgaggcagacagatcacctgaggtcaggagtttgaggccagcctggccagcatggtgaaaccccgtctctactaaaaatacaaaaaatcagccagtaatcctagctactcgggaggctgaggcaggagaatcgcttgaacccaggaagcagaggttgcagtgagccgaggtcatgccattgcactccagcctgggctacaagagtgaaactccgtctcaaaaaagaaataaaaaa

SEQ ID NO: 12774 - DNA, 100 bp, Homo sapiens
taaataaatttgtatgcttttctcctgttaaaaaaaaaaaaaaaaaaaaaaaaaaaaaaaaaaaaaaaaaaaaaaaaaaaaaaaaaaaaaaaaaaaaaaa

SEQ ID NO: 12775 - DNA, 242 bp, Homo sapiens
ttccttctagatattaattcctttcagtttcatttataattagaagccagtttttttttctactgaatgattattataagatactgttatctaagacatggcagccagatttgaaacttctatgtttggaaagtgtgtgtttgtgggtatttgcccctcacctattctttgctctcccacctctgtacttttcctcacttaaagaaaaagggaaaaacctgacaaacccttttttttttttt

SEQ ID NO: 12776 - DNA, 424 bp, Homo sapiens
  misc_feature 71: n=a, g, c or t
accgtcagcatttcgagtcttcagagcagtaggccgcatcccaccctgtcaggttagctgttccgacatgnschtgaatgtgttgggttgcctgtgtgggaatgggagtcaggtgaagtggggagatgggccaacagctttctttgaaacaaccaagtttcaggccatctctgaaagagtaggaaaatattttagacgttctgtttgatttaatatatatttaarattttatggcattactttatatgtatcctgttatctttataacacaattctgtcatagaacttctgccattgggtatcattaggaaattaccagtcattcaggacagaaatttagcattctggacagtagaactttctacctcatggacttggagtttccgacaggtctaaagagatttagtcctttctttaaaaaaaa

SEQ ID NO: 12777 - DNA, 458 bp, Homo sapiens
  misc_feature 439: n=a, g, c or t
taaataaattagccagggacgctgatgcacatccatactcccagctacttgggaaactgaggcaggaggattgcttgagcccaggaatctgaggctgccatgagctgtaatcactgtgctgcactctagcctgggcaagagggcaagacctcatctcaaaaacaacaacaacaaaagaaagtttaaagctcttgataaagcaattagatttgaggtaaagggactaatataatacatatgaaagaatgaacaattaggctgggcatggtggctcacgcttgtaatcccaacactttggaggctgaggcgggcggattacctgaggtcaagagtttgagaccagcctggccaatgtggtgaaacccatctctactaaaaatacaaawattagccaggcatggtggcacgtgcctgtaatcccagctacttgggaggctgnggcaggagaattgcttgaa

SEQ ID NO: 12778 - DNA, 110 bp, Homo sapiens
aaccggtgtatcatgggagcggcccgggctacacgttaaaaacactaaggggagcgcgcgamgtgaacttggcgctcgatgggggccgttagccgccctagagcgcgcgg

SEQ ID NO: 12779 - DNA, 458 bp, Homo sapiens
tttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaa

SEQ ID NO: 12780 - DNA, 55 bp, Homo sapiens
cttttyygaccgctcccccctccccccgagcgccgctccggctgcaccgcgctcg

SEQ ID NO: 12781 - DNA, 174 bp, Homo sapiens
tacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtcgcaaaaaaaaaaaaaaaaa

SEQ ID NO: 12782 - DNA, 340 bp, Homo sapiens
agttttctatgtagatgttttacttacatttcattaaatttattgttaggccgggcatggtggctcacgcctgtaatcccagcactttgggaagccgaggcaggtggatcatgaggtcgagatcgagaccatcctggctaacaaggtgaaacccgtctctactaaaaatacaaaaaattagccgggcgcggtggcgggcgctgtagtcccagctactcgggaggctgaggcaggagaatggcgtgaacccgggaagcggasttgcagtgagccgagattgcgccactgcagtccgcagtccggcctgggcgacagagcgagactccgtctcaaaaaaaaa

SEQ ID NO: 12783 - DNA, 320 bp, Homo sapiens
  misc_feature 224: n=a, g, c or t
ctatttaatcacaaatgtcagcatctctttagttttggcacatggttttcaccttttatcctctctctctctccatgcttcattatattagttccctaggctatcacaacaaattgacacaaactaaatgacttcaacaacagcaatgcattctaaaacagttctagaggctagaagtcctaaatacagtggggccacactcgctctgaggtccctagagagantccattctgtggatcttccagcttctgggggctgccagcattcctttactcatgcgagcattcctttaccccagcttctgggggctgcaccactcc

SEQ ID NO: 12784 - DNA, 351 bp, Homo sapiens
aggatgctcagttaaatttgaatttcaggtaaacaaatactttttaagtatgttggccgggagcaatggctcacgcctgtaatcccagcacttgggaggccaaggcaggcagatcacttgaagccagggattcaagatcagcctggccaacatggtaaaaccccgtctctacccaaaatacaaaaggtagccagttgtggtggcaaacgcctgtagcctcagctattcggaggccgaggcacaagaatcacttgaacccaggaggtagaggttgcagtgagtcaagatggtgccactgaactctagcctgggcaacagagtgagcctttgtcgcaaaaaaaaaaaaaaaaa

SEQ ID NO: 12785 - DNA, 74 bp, Homo sapiens
ggccgggcgcggtggctcacgcctgtaatcccagctctcagggaggctaagaggcgggaggatagcttgagccc

SEQ ID NO: 12786 - DNA, 458 bp, Homo sapiens
tattctatattcgtttaggtggtccgtaacaatggggaagaaaagatgagcaagttatggcccttgtccttaaggagctcaggatctccccagtgggctgcaggaatggcaaatacccacaaaatagccgccacacaaggcagagagtgatacgtgttctactaagaatagcagtaaaatgctgaggaatcagagatatcaaggttaatgccaggtggaagactggggaaaagtacacagctgaattgactctgagttgcatgtgggaaaatggatgagatttcaaaaggcagagattaaagagttactgctacatggaggcattttcctagaatgtccctcagtataggaggcaggggctttcaaaactctgtattcatcattttctatagacatttttccttgtagtatgtcttgtcactgtatccatagctaaagttttggagatttgtatgctt

SEQ ID NO: 12787 - DNA, 274 bp, Homo sapiens
aatcccagcactttgggagttcgaggtgggtggattgcctaaggtcaggagttcgagaccagcctgaccaacatggtgaaatcccgtctctactaaaaataaaaaaactagccgggcgtggtggtgggtgcctctaatcgcagctactcaggaggctgaggcaggagaatcacttgaacccgggaggcggaggctgcagtgagcagagatcacgccattgcactccagcctgggcaataagagtgaaactccagcccaaaaaaaaaaaaaaaaa

SEQ ID NO: 12788 - DNA, 405 bp, Homo sapiens
ttcttgagacagagtctcactgtgtcctccaggctagagtgcaggctcaacctccaggctcaagagagctgccacctcagcctcctgtgtagctgggacaacaggcatgcgccaccacgcttggctaatttttgtgttttttgtagagatcggtttttgccatgttgctggttttgaactggcctcaagaaatccacccacctcggcctcccagagtgctgagattacaggcacgagccaccctgcttagcctaatatgaaaagtatttttgttattttaattttatcaaattgattttctttttatagttatttttattacacaaatatgttaagtacaaagtccttttgaaagattcaaacaggccagacatggtggctcgcgcctgtaatcccagcactctg

SEQ ID NO: 12789 - DNA, 118 bp, Homo sapiens
attccgtcccgccccgccgccggtgcagtgttggaagctccggttctcccggaagtggcccaggtctctctgtcggggtcccctccatctcgctgctgctgaaggccgcgagggcggc

SEQ ID NO: 12790 - DNA, 473 bp, Homo sapiens
aaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacagagagaccctgtctggaggggtggggggagaaaaaaacaccatagaaacaacccaaatgtccaataacaaattgtagtccatccatacaatggactactactcagccatgaaaaggaatacagcactcacatatgctgcatgtgaatgaaccctggaagcattatgctcagtgtaagaacccagacataaaaggtc

SEQ ID NO: 12791 - DNA, 185 bp, Homo sapiens
aasaattagagatactttatttatttatttatttatttgagatggagtcttgctatgtcacccaggctggagtgcagtggsacagtctcagctcactgcagcctmtgactccggggttcaggcgattctcctgcctcagsctcccgagtarctgggattacaggsgcccgtcascacgcccggct

SEQ ID NO: 12792 - DNA, 369 bp, Homo sapiens
cattaaacattctccaggatagaccaaatgttaagccacaaaataagtctcaagtttcaaaagactgaaatcatacaatgtatgttttacaacaatagaatgaaactagaataaacagagaagagaatttaggaaatacatatatgtggaaattaatgcgctccgaaataaccaatggatcaaagaagaaatcacaagggaaattagaaaatattttgagatgatgaaaacaaaaacaaatcatatcaaaatttataggatatgcctaaagcagtgctttattaaaaaagatctcaaatcaatagcttaaacttcaccttaaaaaagtagaaaaagagcaaacaaaaaccaaagccaatagagggaaaa

SEQ ID NO: 12793 - DNA, 152 bp, Homo sapiens
ttcccacacacctgtaatcccagctacttggggggctgaggcaggagaatcacttgaacctgggaggcggagattgcgagcagagatcacaccactgcactccagcctgggtgacagagcaagaccccatcttaaaaaaaaaaaaaaaaaag

SEQ ID NO: 12794 - DNA, 335 bp, Homo sapiens
aatttgcattttaaaaattactagtgtttttttggccaggcatggtggctcatgcctgtaaccccagcactttgggaggccgaggcgggtggatcacttgaggccatgatttcgagaccagcttgggcaacatggtaaaaccctgtctctactaaagtaaattacaagaattagccggatgtagtggtgcatgcctgtgatcccagctgctcgggaggctgaggcacaagaatcacttgacccagggaggcggaggctgcagtaagccaagatcacaccactgcatgccagcttaggcaacagagtaagactctgtctcaaaaaaaaaaaaaaaa

SEQ ID NO: 12795 - DNA, 236 bp, Homo sapiens
agcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgwgccc

SEQ ID NO: 12796 - DNA, 479 bp, Homo sapiens
caattagcaatactatttcaaaaaataaactgatgttaatttataaaagagatttaaattaagaggtaagaaggtagcaggtcagtaaagcaagtcagtcagtaaagtatttattagaaaagttatttatttatttttaacttgatgcggatggtattaagaatggaaatatgaaagagaaattcaaaaatgaaatctgggccaggcacggtggctcacgcctgtaatcccaacactttgggtggccaagacgggcggatcacctgaggtcaggagtttgagacaagcctggccaacatggtgaaaccccatctctactaaaaatataaaaatttgacagccatagtggcgcgtatctatgatcccagctacttgggaggctgaggcaggagaatagcttgaacccgggaggcagagtttgcagtgagctgagatcacaccattgcactccagccttgacaacagagtgcgacgccatc

SEQ ID NO: 12797 - DNA, 288 bp, Homo sapiens
taatgaaatagagactgggaaaaccagtgaaaccaaaagctggttctttggaaagatcaacaaaattgacaaacctttagctaaacatatcagggtaaaaagagaaaacattcaaattactggaattacaaatgtgctgggtgtggtggcacacacctgtaatcccaacacctgggtgtggtggctcacacctgtaatcccaaggtgggaggatcacttgaggctgggagtctgagaccagactgggcaatatgacaagacctcatctatacaaaaaaaaaaaaaaaa

SEQ ID NO: 12798 - DNA, 392 bp, Homo sapiens
tcattgatagtatatgttcataaatgttatatagttgtaaaatagtctgttgggtttgtgatctgtagtttgtgaagtgaaggttcttaactccttgtgggagggaggcacaggcctctggaaatagaatcaaagctgtgaatgctcttcccacaatgtgatcctccccattttgcattcagtttaaggatccctggaccctgaaacccatttttgccccaatgggccttggttttgttttaattttgtaaaagccatttgctaaaagctgactttatccaggggtgattttacaggacgaaatgggctgttttcagtgcctcattcagtgcattctggcagacctgtgttagcactgtgccagatgtcatgttgaaatgagtatagatgca

SEQ ID NO: 12799 - DNA, 253 bp, Homo sapiens
gttaccatttattaaaggtaaactacacctgttgaaggccaagttcagggcagctgttgtgatctgtgtagttaatgtatttattaatgcttgacttttaaaatcctgggcataaatattgcagagcctcgtatgtttgtcagttcatgccgagatgaaataaatcacgcagaaagtgccagtccaaaaaaaaaaaaaaaaaaaaaaaaaaaaaaaaaaaaaaaaaaaaaaaaaaaaaaaaaaaaaaaaaaaa

SEQ ID NO: 12800 - DNA, 445 bp, Homo sapiens
actttatcatctgcctctcttacttccttttctccttcttgctttcattccaacagacattccttaaatactttctttgtgctaagaactctgtcctttcatatttctttttttttttaataggaaatacttctgaaactgtcctttctagtcttcctcgtgtctatctgggagcagggagttgccggggggaggcccccacagactgaaggacgcagtcagggacaggcagagtgaacattaggagccattaggacgggcccagccctggggcatggatgcccagctgcagcatcagtgggagcctgacctggggcttgagatgactggccccgtgcgaacttcagggcttctatgaggaggtggccaacccactgctgacgggtgtggaratggagtaccccgagaacgctatcctggacctcacccagaacacttaccagca

SEQ ID NO: 12801 - DNA, 339 bp, Homo sapiens
aaatcaggctaggcttatgcaatgaaatacccagcagagcgtccagcttcttcgtttagttgcatgcaatttattaaacaaaggagctccactgcctaaggctattggattacactggcagtttattgccatcaggcatgaagcacatttattatcaagatcagccgtcacagacacagttgcaaaagggagaggcaaatgaggacagctctttgggggagaaaccgctcttgggtttgctgcttacctgagttttgagccgccactcgggatttcctggggctcacagagtcattctgctccgcctcatgggttgcagaagcactgatcaccagcacc

SEQ ID NO: 12802 - DNA, 438 bp, Homo sapiens
tatctcaatcctgtccactcttccccacttcctccatctctcttccagtcggggccactgccacctcgccccaggcctatgcagtatagctccttgagactcccctccccacacagcagagatcagtcatggcaccctctgccccaagtacccagaatgcagtttcccaccacagtcctctgtgatgctcagctcttcccattccttgactatgtaatgctcactcctacctgaggcctttatgccacctgctccccacacctggaatatcctcccccggtttctgcatggctgacttcatcttgtcattcaggtctcggctacttgaagaggcggatgtcctaaccacccaatctgacatagatacccagtcaccttcaagcatgtcatctgcttttaattctgtgtagcatttattaattgagggttttttactga

SEQ ID NO: 12803 - DNA, 451 bp, Homo sapiens
tttctttagaaggcaggccctttgaaggtttgcatgaaactccctttctcaaaggaggcggaagagcaataccacataaacgctcaccgctgacctgghgaattggccacttccctttttcttccctgccgctgccccaggctggctgacacgggttagaagatgaagcaagatcaagggctggctgtcaccgacagtctgtgctcttgctggataatgatacaaaggaaaccctgtggcttgggagggttctagcacagacggcaacagcgccggacattcggggaacaacatcctcggttccgaagtggccttatttgcagggattgcttcaggatgcatcatcttcatcgtcatcatcatcacgctggtggtmctcttgctgaagtaccggagagacacaggaagcactcgccgcagcacacgaccacgctgtcgctcagcacactgg

SEQ ID NO: 12804 - DNA, 263 bp, Homo sapiens; identical to SEQ ID NO: 12632

SEQ ID NO: 12805 - DNA, 140 bp, Homo sapiens
cattgtattgttttgtaataatatttttaaaattctggstgcstgttacgtatggtagtctttatgacttctgtgtcataaagctttcgtaaaatttagsatctgtgraaatgtgatgaggcagcattattttagatggt

SEQ ID NO: 12806 - DNA, 185 bp, Homo sapiens
agcctgaccaacatgttgaaaccccgtctctactaaaaatacaaaaattagccgggcatggtgtcacgtgcctgtaatcccagttactcaggaggctgaggcaggagaatcgcttgaatccaggaggcagaggttgcagtgagctgagattgcgccactgcactccggcctggggtgacagagcg

SEQ ID NO: 12807 - DNA, 442 bp, Homo sapiens
gggttacctgcggaccagaaattgagatgcagagatatttgctctttcttctccaggagtccttaggagtagttgaaaagaggaacagaagaaagtccacttctctgctcaaacctttactggaactattaaaatcgctggccgattttgtcttttgaagatcctgaagggtttagaaattctaaattgagtagacatagattaaaaatgctggtgtgaagaaactgataatagttacctcccaggagaggaatgtgtttctggaaaacacgtcgtggtaggaagaccatttaccgtacgcctttgtgtacttttttgtttttgtcctttgaggcagggtcttgctctgtcgcctaggctggagtgtgcagttgcgcgatcttggctcactgcaagcctccacctctcgggctcaggcgatcctcccgtcacagcctcccaa

SEQ ID NO: 12808 - DNA, 338 bp, Homo sapiens
  misc_feature 241: n=a, g, c or t
aaaaaacctaaacgtctcttctggatctccagaaaaaaagtgctgctctaggccgggcgcagtggctcacgcctgtaatcctagcactttggcaggccgaggcgggcggatcatctgaggtgaggacttcgagaccagcctagccaaaatggtcaaagcccgcctctactaaaaatacaaaaattagccgagcgtggtggcacgtgcctgtagtcccagctgcatgggaggctgaggccgnagaatcacttgaaccctggaggcagaggttgcagcgagccaagaccgtgccactgcacttcagcccaggtgacagagggagacgccctctcacaaaa

SEQ ID NO: 12809 - DNA, 236 bp, Homo sapiens
aacactctgcgcgcccgctcttctgctgctgtttgtctacttcctcctgcttccccgccgccgccgscgscatcatgaaggraaatcgtgcacttccaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggs

SEQ ID NO: 12810 - DNA, 455 bp, Homo sapiens
  misc_feature 388: n=a, g, c or t
aaaggcaaaacatgtatatacaaaccatgaatttggataaatatagtatatgcatasaagaaaacagtattcagtcttaaaaattaaaattctgatacacagwtctatgtaaaattctgatacawagsstacaaaacatggatgaactctgaagacattatgctaagtgaaattagccagtcatgaaaagacaaaatactctatggttccacatwtatggggtactagaatagtcaaattcatagagacagtggttcccagggactgtggagagaaggaaatagtagctattgtttaatggatagagtttcggtatgaawgatggagaagttctggagagggatagtggtgatgacggcammtgtgtgaatctacttaatgccactanactgtaccacttaaaaatgttttaaatggtacacttgatgttatgcatattttaccttttttttttt

SEQ ID NO: 12811 - DNA, 97 bp, Homo sapiens
  misc_feature 13: n=a, g, c or t
tttggggggcgangtgggcggatsacggggtcaggagattgaccatcccggctggcacggtgagaccccatctctactaaaaatacaaaaaagttgg

SEQ ID NO: 12812 - DNA, 180 bp, Homo sapiens
atgcccatctagcttgcagtctcttcgcgctttcgctgtctctcttattatgactgtgtttatctgaaacttgaagacaagtctgttaaaatggttcctgagccgtctgtaccactgccccggsccctcgtccgccgggttctaaataaagaggccgaaaaatgctaaaaaaaaaaaaaa

SEQ ID NO: 12813 - DNA, 308 bp, Homo sapiens
  misc_feature 254: n=a, g, c or t
tgtcttaaaaatagggaaatgtggctgggcgcagtgcctctgcccgtaatttgggaggccaaggcgggcggatcgctgaggtcgggagcttgagaccagcctgaccagcatggggaaaccccgtctctactaaaaatacaaaattaactgggcgtggtggtgcgtgcctgtggtcccagctacttgggaggctgaggcaggagaatcacttgaacccaggaggcagaggttgcggtgagccaatatcacgccanttgcactccagcctgggcagcaaaagtgaaacactcaaaaaaaaaaaaaaaaag

SEQ ID NO: 12814 - DNA, 226 bp, Homo sapiens
caagggatcgagactatcttggccaacatggtgaaacccatctctacaaaaaatacaaaaattagctggtcgtggtggcacatgcctgtagtcccagctactcgggaggctgaggcaggagaatcgcttgagcccgggagacagaggttgcagtaagccgagaccacaccactgcactccagcatggcgacagagcaagactccatctcaaaaaaaaaaaaaaaaa

SEQ ID NO: 12815 - DNA, 345 bp, Homo sapiens
tcatttattaatagatggttcataagcacagagatggaatttttaaattgccggggactgtggtgagcttttatttccttctgatgttggagtgcctatgtactacagcacaatacaagttgtcataatgcctacaactacatagacacagaaacatggactgggcaaaagaagtggtaataggcattgaaaatttatgttttaaacacctatgggaactattttaactaaaacactagtataagcaactcaaaggaattgctgcacagatgtgcatcagatggctcaaattaaagaaccatcaaccttttcattgtatctctcccacaaaaaaaaaaaaaaaaa

SEQ ID NO: 12816 - DNA, 500 bp, Homo sapiens
cataagatgaagattttttggatggaaactaattagttgtttctttgggsatcagattatttcccmaatttttatttatttgaaaactgttacaacaaaaacgcaatctgttttagggttaaaaaaatcctctttaactctatcacccttsaattattassttttatbtttttgttcctttggagtctgttgatataaaattcatatttstacastgttataataaataatggcaaaactcagtttttatcactgtttgttctaaaaataaaatagcaaccctgtacccagcatactttacaggttytttaaagttctcacagtttatgaagaagatgccgccatcccaatttcacagatgagaaaactgaggcatgcagacattatgcaactcttttcaaatcacacagttgttaccttgtggggccagcatgagcctgggaggattgcaaggctcgggcstcccctctgctctgtgtctctcacggtggctgaggtag

SEQ ID NO: 12817 - DNA, 115 bp, Homo sapiens
ccgtttttgctgggtaggcgacccggacggagggccggcgaggtgcggggtctggtgatgcgagctgcgcctctcggcaagatttcgcgctgcccatcscgggccctttcatcat

SEQ ID NO: 12818 - DNA, 122 bp, Homo sapiens
tcttaatctccacgttataaggtggaaactgaggcttgaagaggctcacttggccaggcatggtggctcatgcatgtaatcctcttgctttgggaggctgaggtgggcggatcacttgagcc

SEQ ID NO: 12819 - DNA, 67 bp, Homo sapiens
cttttgacaggtctctctcccggcgagggccgtggtcttcaggaaaggcccgagcccctttcccagc

SEQ ID NO: 12820 - DNA, 435 bp, Homo sapiens
acgtatatgtagtttaaaaaataaaaatgagatatcacccagatctctagccccagctcaagaaatgaaacattaatagtgctgtagagatcctttgtgtaccttctttctaccctacctcacagtccccttattacccataggtaaacactagggtgaactttgtgttaatctttctcatctttcattatagtgttaccactatgaatgtgttctttaattatgtaaatgaatccattattcaggcttctgtgatttaattatttcagttaagattgtttgagatttatccacattaacatgtagttttatagtttctgggaaaatatttaarattttcaaacatacagaattttgctagttatattttcgttatttgatttctaactttattgtgttgtagtcagggaatgtggtgtttgaaatttatgtagg

SEQ ID NO: 12821 - DNA, 472 bp, Homo sapiens
cattacagagcaaattgaccatgcctgcaggaagatttaatacagcagagcagcaagacttttatgcctaaaaattctaaagttattattaaaaagatgtgtatttaatttagctcatgtctttaagacaaagccatctagtggatatttaataaatacttgaaggaaggaaataaaataccaataccaatattacagatgtctgtaaatcccaaataattgaaatcttgcaggtcaaaggaatagtgattgcttctaagaaagaggcaagttcaaagaagttctcttgctaattaagagaactaacttactccaggcaaaccaaggaagacgatggaaaggaggaaaactatacaaatattttcagggtgtggatatgggtgtttcagaaatcaaatggggaaagaaaacaaaaggagaacagaaagagttacgatatcagcaatgggaaatggaagagacaaattcctga

SEQ ID NO: 12822 - DNA, 169 bp, Homo sapiens
agtgaggcctagtggaaagccatggagagcgctctccccgccgccggcttcctgtactgggtcggcgcgggcacgtggcctacctagccctgcgtatttcgtactcgctcttcacggccctccgggtctggggagtggggaatgaggcgggggtcggcccggggctcgg

SEQ ID NO: 12823 - DNA, 530 bp, Homo sapiens
  misc_feature 170: n=a, g, c or t
atttatttatttattttgaggcggggttttgttcttgttgcccaggctggagtgcaatggcgcgatctcagctcactgcaacctcctcctcccgagttcaagcgattctcctgcctcatcctcccaagtagctgggattacaggtgcgcaccaccacacccggctaattnttgsatttttagtagagacggggtttcactatgttggccagaggtcttgaactcctgacctcagatgatctgcccgcctcagcctcacaaagtgttgggattacaggcatgagccaccgcgcccagckaggawcctcccaatttaaaagatkagagagaagggtgataactatcagtctctcattccaagagtccctgggggtaaagatcagtggcttttattaactcaggggtaatctttgccatttatagtcacctggagcaattgtattttccacattcttttatagtaacattttgtgcttgtttttttttaatttggagccttttgaatacattgaattttacttctacattcat

SEQ ID NO: 12824 - DNA, 101 bp, Homo sapiens
aaaaatacaaaaaattagccgggcatggtggcgggtgcctgtagtcccagctacttgggaggctgaggcaggagaatggcgtgaacctaggaggcggastt

SEQ ID NO: 12825 - DNA, 154 bp, Homo sapiens
agttgggagtttccctagcgactcagttcgggtgggcgttgggcgctgagtcagccaaacagcctactcggggttcttgggtagcctttggggtgaggggacttgggcggccttggtctgtaagctctgcgttcccgggcgtggaagagactgg

SEQ ID NO: 12826 - DNA, 373 bp, Homo sapiens
aaaccattattagaaacatgccaggttggttgtcttggtatcgtttagtaagaaacaaagattgaaaatgagtcctggtgggccgggcacgtggctcacgcctgtaatcccagcactttgggaggccgaagcgggtggatcacaaggtcaggagattaagaccatcctggctaacatggtgaaacccgtctctactaaaatacaaaaaaactagctgggcgtggtggtgcacactgtagtcccagctacttgagaggctgaggcaggggaatcgcttgaacccgggagttggaggttgcagtgagccaagatcatcccgctgcactccagcctggtgacagcgagactctcttaaaaaaaaaaraaaaaaags

SEQ ID NO: 12827 - DNA, 147 bp, Homo sapiens
tactaaggacgccgtcgargtccggggcgcctcaactctatagctctaactggctagaagtgcccaacgtggaatgtttcttttttaaaggcggctcttgaagcgacccggaagcggaagtggaagaaagttctagtggcttgagat

SEQ ID NO: 12828 - DNA, 505 bp, Homo sapiens
tttccagaaagtgaaaggatcttctctctctaaactcacccacattctcagtttagtttaggaaccaatactacagagtatattggtttacaaagtaaattagaaagtatagccatatatttctgccattgtttaggcagatatgtttttgctactctgacttggcttctgtcctttcccttgtttcactgccactggaagggttgttgctggctaaggaaatattgagccttgagacaaaaaattttgcaacaaaagaaatttacctaaactagcttgcttcaagaaaaactgattcatggtgtttaatgtgtaatctgtatacccaggcatgaagtttcactcattctagccctgattatgtcttaaagagtttaaagccagccaggcacggtggctcctgcctgtaatcccagcactttgggaggccgaggcaggcagatcacaaggtcaggagttcgagacctgcctggccaatatggtgaacccgtctctactagaggtg

SEQ ID NO: 12829 - DNA, 116 bp, Homo sapiens
atttttattgatgtttaataccttctgaaacaggagggtaagatcagatgggaagcccctctgttgaaggatcttgggaaccttggtggttttttttttttttggttttttttttt

SEQ ID NO: 12830 - DNA, 111 bp, Homo sapiens
tacaaaattagccgggcgtggtggcatgcgcctataatctcagctacttgggaggctgaggcaggagaattgcttgaacccaggaggcggaggttgcggtgagttgagatc

SEQ ID NO: 12831 - DNA, 398 bp, Homo sapiens
tagtgaagatttaaaagtgggtagtgttataaagagtaaagtatatttgtagttattgacctgcgaggatacgcgattttgattgagtaaaggaagcaaattggccgggcatggcggctcatgcctgtagtcccagcactttgggaggctgaggcgggcagatcagttgaggttagtttgaggccagcctgaccaacatggcgaaaccccgtctctacaaacaaatgcaaaaattagccgggcaaggtggtgcctgcctgtaataccagctacgcgggaggctgaggcaggagaatcgcttgaacccgggaggtggggctgaagtgagctgcaattgcaccactacactccagcctgggcgacagagcaagattcggtctcaaaaaaacaaaacaaaa

SEQ ID NO: 12832 - DNA, 475 bp, Homo sapiens
caaatatggcaaacaaaataatctgttggtttttttctatattaaatatatattcaaaagtaagacactttaaattcttttaagaaatgaaagccaggcacagttgctcacacctgtaatcccgcactttgggaggctgagacgggcggattgcttgagctcaggagtttaagaccagcctgcacaacatagcaaaaccccatctctataaaaaaaaaatacggaaaaattagccaggtgtggtgacacatacctgtggtctcagctactcgggagactgggttaggaatgagcctgggaagttgagattgcaccactgtacttcagcstggtacttctgaactgtacttttgacctgtctgaaagaacatatcttaaaattgatcatagaaaatagaaacttataaggtgagtagatcattatgtattttaatgacttaatatattctcatctaatgtttattttgaaacaggc

SEQ ID NO: 12833 - DNA, 227 bp, Homo sapiens
cattttagggttattctgttacttagggtttttgttttctgttttttttttctctttttttgkattaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgccc

SEQ ID NO: 12834 - DNA, 429 bp, Homo sapiens
aaatgaaggagaaatacataggtaaaaaattaaaactgggaaaaaaaagtttggcagaaaagatctaatatagatatataataggatcttcccaccccgcccccagaaagaaaaccaaaataaaggaatagcttaaatactgacaagtggccgggtacgtggctcacacctgtaatcccagcagtttgggaggccgaggggggcagatcacgaggtcaggagatcgagaccatcctgactaacatgttgaaaccctgtctctactaaaaatacaaaaaattagccaggcatggtggcgggcgcctgtagtcctagctactcgggaggctgtgaggcaggagaatggcgtgaacccgggaggtggagcttgcagtgagctgagatcgcgccactgcactccagcctggggacagagtgagactccgtccc

SEQ ID NO: 12835 - DNA, 552 bp, Homo sapiens
tacacaactactaactagctcggcctggtaccacggatttgtgctacggcaccaggagagcaaaatcaacacagaaaaaagcaagaaaactcagagaaaaaataaaacaaatctacaatgaacacatcagtatgtatatttctacaaacttgtgtgagaagttctgtaagatcaagtcctaaaagcagaattgctggctcaaaggatatgagtaacatcagctgactcgaagttaagaagaytggcctccacaatcagggtgggcctcatccaatcagtaaaaggccctaagtgcaaaactaaggcttccctgaagaagaaatgtccacctaacagacagcctccctgtggatttcagacttgcctagccagccccagcaattatgtaaaccagttccttgcaaaaaaaatctctttatatgtatataaacctgttgaaaattttatatagcatatatatatgtataatacatacatgtgtatacatgcatacatatgtgtctgtatatttatacacatacataatctccatttggttctctttctcgggta

SEQ ID NO: 12836 - DNA, 358 bp, Homo sapiens
agaacagcctaggtaactttgcaagactccatctctgctaactttttttttttttaaactgggctgggtgtggtggctcamactgtaatcccagcactttgggaggstgaggcaggcggatsatgaggtaaggagattgagacsatcctggctaacacaatgaaaccccatcgctactaaaaatacaaaaaaatagccaggcgtagtggsaggcgcstgtagtccsagstastcagtaggstgaggcaggagaatagcatgaacccaggaggcggasttgsagtgagctgagattacgccastgcactcmagcstggatgacagagtgagactccgtctaaaaaaaaaaaaaaaaagg

SEQ ID NO: 12837 - DNA, 363 bp, Homo sapiens
tatacgtgtagatagaaatacagatacagcatacaaacatactatatgtatttagaaaacacatatgtttacatatgtaattaagaaaaaataggccgggtgcggtggctcatgcctgtaatcccagcactttgggaggccaaggtgggcggatcacctgagatcgggagttcaaaacccgcctggccaacatggtgaaacctgtctctactaaaaaatacagtaattagctgggcgtggtggtgcatgtctgtaatcccagctactccggagctgaggcaggagaatcacttgaacctgggaggtggaggttgcagtaagccaagattgcgccattgcactccagcctgggcaacaagagcg

SEQ ID NO: 12838 - DNA, 421 bp, Homo sapiens
tagactctgtttctttgcatatgcctatttattaacaaaggaatgtaaatgtacttattgctgtccttttgataaaatttgctgtggatgtatggctaatcccacagaatcaaggatccttatctggccagatgcaccaattttgacctctgtcctagtttttaacttaagctgatataccaacagggcagcaaatatataagcagttgcaagaactgcactgcaatggtttattgaatctcaataaatgatactttcttttaagaaaaccctctttattcgcttcatcacttgaagtgctttttaaaaatacttggatttggcaggctttttctgatactgaggtgctcacagtaaactgaatgtggttaaacagcttggaacactggagttgaatagtttctgggcacatgtgccaaaa

SEQ ID NO: 12839 - DNA, 267 bp, Homo sapiens
  misc_feature 19,258: n=a, g, c or t
caccgcgcctggcccccknactgtatttaaagttgagggatgtgatcttgccctggctccttcaggatacttatttgcggtcccacctggtttttccccgcaagaatctgctctgaaaggtcacttctctacctctgtgctcctaggactttacctatgaacttgttgaaagttcattttaagtataatatttaccaattgtttttgtaaaaaagttatttaaattttaaggaaatttgaacgtcctttttctcaaanaaaaaaaar

SEQ ID NO: 12840 - DNA, 454 bp, Homo sapiens
ttccctagggcattgctctcctattcccacgccttaacacagctctatacctagaagcagccagcccaggcatgcagtcacatttaatcacatcccccttswagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgcca

SEQ ID NO: 12841 - DNA, 316 bp, Homo sapiens
ctttaaaaagagctttcatggccaggcgcggtggctcacgcttgtaatcccagcactttgggaggccgaggcgggcggatcacaaggtcaggagatcaagaccatcctggctaacacggtgaaaccccgtctctactaaaaatacaaaaaaattggctgggcgtggtggcgggcgcctgtagtcctagctactcaggaggaggcaggagaatggcgtgaacctgggaggtggagcttgcagtgagcsgagatcgtgcsactccccttcagctagggckracagagggagactctgtctcaaaaaaaaaaaaaaaaa

SEQ ID NO: 12842 - DNA, 434 bp, Homo sapiens
ttcttgagacagagtctcactgtgtcctccaggctagagtgcaggctcaacctccaggctcaagagagcctgccacctcagcctcctgtgtagctgggacaacaggcatgcgccaccacgcttggctaatttttgtgttttttgtagagatcggtttttgccatgttgctggttttgaactggcctcaagaaatccacccacctcggcctcccagagtgctgagattacaggcacgagccaccctgcttagcctaatatgaaaagtatttttgttattttaattttatcaaattgattttctttttatagttatttttattacacaaatatgttaagtacaaagtccttttgaaagattcaaacaggccagacatggtggctcgcgcctgtaatcccagcactctgggaggcccgcggcgagcagatcgcttga

SEQ ID NO: 12843 - DNA, 515 bp, Homo sapiens
tttaagtgttgggtggaattcaccagtgaggacatcaggaccagggcttttctttgttgggatattttctttttttttagacgaagtttcgctcttgttacccaggctggagtgcaatggcgtgatcttggctcaccgcaacctccgcctctcaggtttaagtgattctcctgcctcagcctcccgagtagctgggattacaggcatgcaccaccatgccagctaattttttatttttggtagacacagggtttctccatgtctctactaaaggtcagggtggtcttgaactcccgacctcagctgatccacctgcctcggctgccaaagtgctgggattacaggcatgagccaccgcgcccagcctggtattcgttaatttaagtgttgggtggaattcaccagtgtggccatcaggaccagggcttttctttgttggggatattttttttttagacagagtctcgctctgtcacctcggctggagtgcagtggcatgatctcggctcacggca

SEQ ID NO: 12844 - DNA, 500 bp, Homo sapiens
caatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttg

SEQ ID NO: 12845 - DNA, 327 bp, Homo sapiens
csttaaagtgcctctgaggccaaagcctttgtggcaattgtsaaatgagtcsatatgcagtgagtamcgtgttgagggaggacaaggtcaccaagagctgagaatgtttctccgactgatgagacctagatattgggtasatggaggtccccggtccctttgtgattcctgcagcctgttgcctccttgcctggaccccgcctcagctcagaaagccaattccctagattccaaaggcsttcccagaccaattagcatgtsstgsagstgtsagstccctgtgcctagcstggacctcagctcatgtctagcacccagtctcccaac

SEQ ID NO: 12846 - DNA, 442 bp, Homo sapiens
cattagtggcaggtttattttctgtaattttgccgaagttttctgaaacagttgtttaaagccaataataatcctcttttagaaggcaaaaatgaataagtacagtagtgtaaataccataaatgaatgttctacgtttacaatgttctgatactgtgaaaaggttgtttatagcaaatctgtttccagctaggtgggcttaaaaacagactaaaccattatattatgaagatatttggtacttcttcacagtgaagtatgtataccttgttgaataaaatcatacattaaaattttggacaaataggctgggcacggtggctcatgcctgtaatcctagcactttgggaggtcgaagcggatagatcactgttggccaggctggctggaactcctgacctcaggtgatcacaccattgcactccagcctgggtgacagagc

SEQ ID NO: 12847 - DNA, 285 bp, Homo sapiens
aaaaaatctagaggcagttgagcatgggagccgtctgtatgttgaattagggctcgcactcttgcgcaacacgtcaccagtcggaaactgggggtttgcttctgtgatttatttcattattgtgctggtaaaagctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagc

SEQ ID NO: 12848 - DNA, 451 bp, Homo sapiens
aaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacagagagaccctgtctggaggggtggggggagaaaaaaacaccatagaaacaacccaaatgtccaataacaaattgtagtccatccatacaatggactactactcagccatgaaaaggaatacagcactcacatatgctgcatgtgaatgaaccctggaagcattatgctcagtgt

SEQ ID NO: 12849 - DNA, 441 bp, Homo sapiens
ccccaggctggagtgcagtggtgctatctcggctcactgcaagctctgcctcccgggttcatgccattctcctgcctcagcctcctgagtagctgagattacaggcgccasaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgcttttt

SEQ ID NO: 12850 - DNA, 415 bp, Homo sapiens
agtttggaggtttctcaaagaacacagaactatcattcaatccagcaatcttgttactaggtgtatatccaaaggaaawgaaattgttataacaaaaagacacatgcactcatatattcattgcagtactatttgctatagcaaagagatgaagtcaacctaggtgcgcatcagtggtggatttggtaaagaaaatggtacatatacaccatggaataatgtacagccataaaagagaccaaaacaggccgggcacagtggctcacatctgtaatttcagcactttgggaggctgaggcaggtggatcacctgaggtcaggagttcaagacaagcctggccaacatggcaaaagccccgtctctactaagaatacaaraaacattagctgggcatggtggtgcgcacctgtactc

SEQ ID NO: 12851 - DNA, 497 bp, Homo sapiens
agtttggaggtttctcaaagaacacagaactatcattcaatccagcaatcttgttactaggtgtatatccaaaggaaaagaaattgttataacaaaaagacacatgcactcatatattcattgcagtactatttgctatagcaaagagatgaagtcaacctaggtgcgcatcagtggtggatttggtaaagaaaatggtacatatacaccatggaataatgtacagccataaaagagaacaaaacaggccgggcacagtggctcacatctgtaatttcagcactttgggaggctgaggcaggtggatcacctgaggtcaggagttcaagacaagcctggccaacatggcaaaagccccgtctctactaagaatacaaaaaacattagctgggcatggtggtgcgcacctgtactcccaactactcgggaggcaggcatgagaatcacttgaacccaggaggcagaggttgcagtgagccgaatcattccactgcact

SEQ ID NO: 12852 - DNA, 397 bp, Homo sapiens
ctgaaagtgcagaagttggccgggcgtggtggcgggcgcctgtagtcccggctactcgggaggctgaggcaggagaattgcttgaatctgtgaggtggaggttgcggtgagtggagatcgcgccactgcactccagcctgggcaacagaatgagactccgtctcaaaaataaaaaataaaaaaaaaaaagaaagatttttgttacacggttgggctcggtggctcamacctgtagtcctagcactttgggaggccgaggcgggcggatcacgaggtcaagaggttgagaccatcctggccaacgtggtgaagccctgtgtctgctgaaatttcaaaaattagctgggcgtggtggcgcatsctgtggtcccggctcctcgggaggctgaggcagaag

SEQ ID NO: 12853 - DNA, 476 bp, Homo sapiens
gtatcttgttttttccgccctcggaattttatccaaagcagttttctacgttgccactaatcgtcataattgttcatttcagtggttgtgtacaatgccattgatgagaacagcagttctcaaacgtttctgtctcagaactcctttaaattgaaaattgaggcgtgagcaccacgcctggtcagttgtctttttttgagaatgtcaaataaaatgggatcatatggtatgtaaccttttgaaactggcttcttctcactcagcatcatgtctttgagattgattcaggctgttgcatatattgacagtttgttcctttttgttgctgagaagtattctgttgtatggctgtgctacagttggtattagctcccccactgaaggacatttgaatagtttccagtgtttggcaattatgaatagaactcctggtacaggtttttctgtgaacataagtttttaattttctctaggag

SEQ ID NO: 12854 - DNA, 513 bp, Homo sapiens
agaatgtaaacatttgaagacagcagggcagatactcagctcacatacgttactgcaaacccatctctcatgactgccttgaagaaaactaagtttggagggcaaactgccatacgaaaatgtggaaagacagatgaatctgcagagtcaaagacaagatctgcttacctggagcagaagccataaactgagaaactggacttcaacagaaagggagaaataaagactatcccaggctctgaaagacatacgaaagtaacttcttcagggagaaggaaaatcatataggagtaattcaatccagattgtgaagaagtcttagtgccaattgctctggcagccatgttatgaccatgagacaatcagccatagaaagaaatattctgcatgatagtttagaaagaagcaggacagaaacttctagagttacactgattaatgactgaatctgtgaatcctgatgtctgtcctaactttggatacatacttatataagtaaattattttccttat

SEQ ID NO: 12855 - DNA, 115 bp, Homo sapiens
ggccgggcgcggtggctcacgcctgtaatcccagctctcagggaggctaagaggcgggaggatagcttgagcccaggagttcgagacctgcctgggcaatatagcgagaccccgt

SEQ ID NO: 12856 - DNA, 97 bp, Homo sapiens
caaaatattaaaaataaaaggttgggacaaaagaatagcatgagaacacatggaagtaaaaagcagggatcacaatattgcttttctgttaaaaaaa

SEQ ID NO: 12857 - DNA, 267 bp, Homo sapiens
gggtgcattggctcacgccagtaatcccagcactttgagcggctgaggtgggaggattgcttgggcccgggagttcaagaccagcctggacagcaaggtgaggccccatttctacaaaaaattagccacatgtggtggcatttgcctgtagtcccagctgcatgggagagtgaggtgagagggtcgcttgggcccagagggtagagactgcagtgagccgtgtttgcacccctgcactccagcctgtgtgacagagtgagactgtgt

SEQ ID NO: 12858 - DNA, 397 bp, Homo sapiens
atttctggaccaaggggctgccataaggagtctgtgactagagatgggaggtggtggccacggcctctcgctgtatgctgtgtggaaggtcgaatcatcatcatcataaaacttaatattgcccttatgtgccaggaactactatctcagcaatggagatgtggtgcttggccgcaatcgtgaatcggccctggaggggacacaggaaggggctgcctgctactcatgacctcctgcgtgcctgcctgctgacctatgacccttcaagttcccacccctcagccacgcctgtgaggaggtatgaagaagacctgaggtgtgaagaagatcgagagggtcttgttttgtcgcctacgctggagtgcagtggtgtgatcacagctcactgcagcctcaa

SEQ ID NO: 12859 - DNA, 313 bp, Homo sapiens
tgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaggctgaggccgtatcacttgaggtcaggtgtttgagattagcctggccaacaagctgaaactccatctctactaaaaatgcaaaaaaaa

SEQ ID NO: 12860 - DNA, 492 bp, Homo sapiens
gtttttggtggagacggggtttcgccatgttgcccaggctggtctcaaactactgagctcaggcgatccacctgcctcggccatctaaagtgctgggattataggtgtatgccactgtgcccagcctgagtaattatttttaacttcactgatttttttaattggaatttaattttttataaattttgaagatctctgagaagtatttcaaattgatattacagtttttttttcttctttggttttatcatagtcatttgtttatgaacagatcttgttgaactgctttgttttcctaaagaaataaaggtcttcgaggctgggcatagtggctcacgtctgtaatcccagcactttgggagcctgaggtgggtggatcacctgagtgcaagaccagcctggtcaacatggcaaagcccgtctttactaaaaaacacaaaaattagccgggcatggtggcacatgcctgtgatcccagctacttggggaggc

SEQ ID NO: 12861 - DNA, 326 bp, Homo sapiens
ctggcgggaaagtggaaaactatcggcggtggcccaggctcggtggctcactcctggaatcccagcactttgggaggccaaggtggggggatcacgaggtcaggggatcgagaccatcctggctaacaggtgaaaccctgtctctactaaaaatacaaaaaaattagccaggcgtggtggaggcgcctgtagtcgcagctactcgggaggctgaggcaggagaatggcgtgaacccaggaggcggastgcagtgagccgagattgctgcactgcactccagcctgggcgacagaggaagactccgtctcaaaaaaaaaaaaaaaaa

SEQ ID NO: 12862 - DNA, 303 bp, Homo sapiens
  misc_feature 29,172..173,230: n=a, g, c or t
acatacgttactgcaaasssrkctctcangactgccttgaagaaaactaagtttggagggcaaactgccatacgaaaatgtggaaagacagatgaatctgcagagtcaaagacaagatctgcttacctggagcagaagccataaactgagaaactggacttcaacagaaaknnagaaataaagactatcccaggctctgaaagacatacgaaagtaacttcttcaggganaaggaaaatcatatagaattttatttaccatgtggttctggattagaatctaatgatagaaatgcttttgtag

SEQ ID NO: 12863 - DNA, 536 bp, Homo sapiens
ggattacaaaaattggctgggcatggtggcgtgtggctgtggtcccagctacttgggaggctgaggcaggagagtcacttgaactcgggagccagagactgcagtgagctgagatcgcgccactgcattccagcctgggcgacagagtgagactctgtctcaatcagtcaatcaatcaatcaatcaaattggaatatgagcactaaccttggtaagttaaaattttgggaaaattgtacctgcagaatatgatggatgaaaacaacagccaggtgcggtggctcgcgcgtgtaatcccagcactttgggaggccgagacaggcacatcatctgaggtcaggacttccagaccagcctgtccaacatggtgaaactccgtctctactaaaaatgcaaacaattggccaggcatggtggtgtgtgcctgtggtcccagctgcttgggagggtgaggcgggagagttgcttggacctgggagacagagattgcagtgggccgagatggcgccattgcacccccagcctggcgacaagag

SEQ ID NO: 12864 - DNA, 238 bp, Homo sapiens
aatttttaaaatttctatttctattttttctgcagcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcc

SEQ ID NO: 12865 - DNA, 475 bp, Homo sapiens
caaaataaaaataatgactaacttttattgaataacccctacttgccaagcactgagcctgagtaatttagatatattatttcatttaatcttcaagataaccccctgaggtaagtactgttgaaatccccattttcaaatgagaaaattgaggctgatagaagttagctaactcacccatggttacacagctaggaagtggtacaaagtcggatgtaaagccaagtagcttgactccaaagcacatatgcttaaacacagacttactatctccctaatttttagacctgagttaacttttgaggtgacgacaggtcattcaagtgaaaataatccactaagtaatgcaactataagataagatatgtcatttcataggagcaatagttgacattattgggggaggtgttgattaataggaggaatgtaattggcatctgtcagaaaaatcttcccttagtggaaatcccacctg

SEQ ID NO: 12866 - DNA, 356 bp, Homo sapiens
  misc_feature 208,211,312,316: n=a, g, c or t
agccgcgcggccacgacggccgstgccccggagcgccggggtctttcctgggctccaaagtcaagagctcacgttccgggaggatctgtccgcggaaattcggttctgagcgtcgccggactccgccgcggggaggcggaaaagcggacgtaagtgctgccgaggagatggaggcgttggaccccctcgcgcattgtcggggcgggtncanccgcggtgcaaaaggaccttcctcagaaagttgagcacgaagttcccacaggcccggaatttcccctcccgggcgctccccagagagctgaagactgggcncgtnccggcggcaaatgttcacagcaaagggcggcccagtgcgc

SEQ ID NO: 12867 - DNA, 208 bp, Homo sapiens
tgtttaatgccatttattttttaagatgggatatatattttaattagctgggcgtcgtggcgggtgcctgtggtcccagctactcaggaggctgaggcaggggaatgccgtgaacccggaggcagagcttgcagtgaaccgagatcacaccactgcactccagcctgggcgaccgagtgagactccatcgcaaaaaaaaaaaaaaaaa

SEQ ID NO: 12868 - DNA, 319 bp, Homo sapiens
tatcgtcgggcacggtgactcacgcctgtggtcccggcatcttgggaggctgaggcgggtggatcatgaggtcggatcgggaccatcctggccagcatggtgaaacctgtctctgataaaggtgcaagggttatccgggtgtggtggtgtgtgcctgtggtcccggctgctcggggggctgaggcgggagagtcgcttgggcccggaaatcggaggttgcagtgagtgagctgggatcgcgccactgcactccagcctggcgacggagtgagactctgtctcaataaaaaaaacaaaaaacaaaaacaacaacaacaaa

SEQ ID NO: 12869 - DNA, 443 bp, Homo sapiens
gaggaacaaaaatgatctctagcaaatgatgccaactggcaccaaattctttttgaatcttaaacatatatgcacacgtgcacacacacacacacacagagcttcggcataatttagtaaatgcataaagatgccgtaagaaggactcgctatcatttggagtaattgcaggtctttgctcttggaccttgtagcacacttgattcctggcatacacatcctagcataacatataacagtgtggcttcttcacctagtgtaggcataaatcctttgcttttcatggttttgtaaaaaggtagtaacatacctattatgctttgaaatttgattcgttatgctctgcataagtggtaaaggctgtattgctttgcactgttaattatgaacaagaaataaaacaaatttgaagatagtattctgggcatactacatgttatatt

SEQ ID NO: 12870 - DNA, 118 bp, Homo sapiens
ctttttttttctgttttgggtgtactctaggggccaggttgggagggggaaggtgagggcttcgggtggtgctataatgtggcactggatcttgagtaatcaaatttgctgtggtttg

SEQ ID NO: 12871 - DNA, 320 bp, Homo sapiens
aatttgcattttaaaaattactagtgtttttttggccaggcatggtggctcatgcctgtaaccccagcactttgggaggccgaggcgggtggatcacttgaggccatgatttcgagaccagcttgggcaacatggtaaaaccctgtctctactaaagtaaattacaagaaktagccggatgtagtggtgcatgcctgtgatcccagctgctcgggaggctgaggcacaagaatcacttgacccagggaggcggaggctgcagtaagccaagatcacaccactgcatgccagcttaggsaacagagtaagactctgtctca

SEQ ID NO: 12872 - DNA, 440 bp, Homo sapiens
cctgcgcacaggtgggaggaaagggcctggccagtcctggtcctggctgcactcttgaactgggcgaatgtcttatttaattaccgtgagtgacatagcctcatgttctgtgggggtcatcaggaagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaa

SEQ ID NO: 12873 - DNA, 359 bp, Homo sapiens
  misc_feature 284: n=a, g, c or t
ttttataagaagtcttgtaatcaggtaatgctggtcctccaactttgtattttaacattttctatatttgggccgggcgcggtggctcatgcctgtggtcccaccactttgggaggccgagatgggtggatcacgaggtcagggtttcgggaccaggctggccaacatggtgaagccccgtctctagctagaagtacaaagattggctgggtgtggtggcgggcggctgtaaccccagctgctcgggaggctgaggcaggagaatcttttgagccccggagcgnatgttgcagtgagccgagatcgcaccattgcactccagcctgggcaacagggtgagactctatatcaaaraaaaa

SEQ ID NO: 12874 - DNA, 400 bp, Homo sapiens
tagtgaagatttaaaagtgggtagtgttataaagagtaaagtatatttgtagttattgacctgcgaggatacgcgattttgattgagtaaaggaagcaaattggccgggcatggcggctcatgcctgtagtcccagcactttgggaggctgaggcgggcagatcagttgaggttagtttgaggccagcctgaccaacatggcgaaaccccgtctctacaaacaaatgcaaaaattagccgggcaaggtggtgcctgcctgtaataccagctacgcgggaggctgaggcaggagaatcgcttgaacccgggaggtggggctgaagtgagctgcaattgcaccactacactccagcctgggcgacagagcaagattcggtctcaaaaaaacaaaacaaaaaa

SEQ ID NO: 12875 - DNA, 443 bp, Homo sapiens
catacagcaccctctaccstccgtggccatggcaacgtccagggcccagaaccctgaggagtgagcggccgagacgctgctcsssascccccacctccatgcctsagcctttgcctacsccaggaatgagcttggcctccaacatcccttgsctgctgccattagtagagggggmccstwctgmatctgagcsccccatccctgtgccacctgggtgtggagcccatggaacactctggtccgcctcattttaaaccaaaaaactgctccttcaccctcascctgaggccccaggggagaggacccgtgggatggtgcccaggggttgccttgggacctcggatctcctctggggggcttggctgctgctgttgctgctctgtatttgcctctcgtgattctgttttttacacatgttcacttcccccaggagaggccttggt

SEQ ID NO: 12876 - DNA, 129 bp, Homo sapiens
ttatgttctgatacgcaactgtcttcctgtgcctccttagataagaaatcaccccccaggtcgggtgcggtggctcacgtcctgtaatcccagcactttgggaggatccctcaaccccaggagtttgag

SEQ ID NO: 12877 - DNA, 484 bp, Homo sapiens
tttctctcttgaatagccagcgtggccatttttaaatttctcttgctctccaatctagtctaatttattctgtcagctgtcacatctactaactaggtagtccataggtgcatattatatgcatgtaatggacccattgttgtgtgaagggtggtgaagatttaggagcacagatttatcctgcagaccatttcccacatgaatgtgttcctgggaggatacattttggatttttaatacccatgcttcgtattttatacacatattttaataaaatgattttaagctgctgtttatataggaaattatatttacagcctccaaacgcaatataacattttagtgaaaagtcttgagttacatttcaagtacagttgatagaatgtgggaatcacttgtgggtgttggtgtagagcccgtcgagtgtcaataaakggggacttgctttgggggatgtgtctgggccccaggaccacattcgagg

SEQ ID NO: 12878 - DNA, 357 bp, Homo sapiens
agaacagcctaggtaactttgcaagactccatctctgctaactttttttttttttaaactgggctgggtgtggtggctsamacctgtaatcccagsactttgggaggstgaggsaggcggatsatgaggtaaggagattgagaccatcstggstaacacaatgaaaccccatcgstastaaaaatacaaaaaaatagccaggcgtagtggcaggcgcstgtagtcccagstastcagtaggctgaggcaggagaatagcatgaacccaggaggcggasttgcagtgagstgagattacgccactgcactccagcctggatgacagagtgagactccgtctaaaaaaaaaaaaaaaaa

SEQ ID NO: 12879 - DNA, 611 bp, Homo sapiens
ttaagggctgtagtgtgaggattgggaggaactcgacctactccgctaacccagtggcctgagccaatcacaaagaggattggagcctcactcgagcgctccttcccttctcctctctctgtgacagcctcttggaaagagggacactggaggggtgtgtttgcaatttaaatcactggatttttgcccaccctctttccaaataagaaggcaggagctgcttgctgaggtgtaaagggtcttctgagctgcagtggcaattagaccagaagatccccgctcctgtctctaaagaggggaaagggcaasgatggtggaggctttctgtgctacctggaagctgaccaacagtcagaactttgatgagtacatkaaggctctaggcgtgggctttgcactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctkgatggagacaaacttgttcacatacagaaatggggatggca

SEQ ID NO: 12880 - DNA, 425 bp, Homo sapiens
actgctgcygccgccgccgccgcagcaggtcacagcccctcgaggcgacagggccccgccgacccagagcagtggtacaggcatggatgggaagaaatgcagcgtatggatgttcctacctcttgtatttactttgtttacttcagctggattgtggatagtatacttcatagctgtggaagatgdacaaaattttaccattaaattcagctgaaaggaaacctggtgtgaagcatgcaccatatataagcattgcaggtgatgatcctcctgcaagctgtgtgtttagtcaagttatgaacatggcagccttcctagcccttgtggtagctgttctgcgcttcatacaactgaaaccgaaktttttaaacccgtggctgaatattagtggattggtggctctgtgtckgggctttccttcggaa

SEQ ID NO: 12881 - DNA, 106 bp, Homo sapiens
caaaatattaaaaataaaaggttgggacaaaagaatagcatgagaacacatggaagtaaaaagcagggatcacaatattgcttttctgttaaaaaaaaaaaaaaaa

SEQ ID NO: 12882 - DNA, 473 bp, Homo sapiens
acattgtctgcgacttacctttctaggttcctttctcccatgtgcatccccttccttccaaagcactcattgattctagcctgcagtgtatagtttcctgatcaagccaagctctcccacacctctgtaacttttgcgtatattgttcagtctccctgtaagtcttccctaccttcaccttttatagaaactgcagggtacctacttgccccttgagatagctattcctgaatttctcccgaatttaagcattcctcctctatactttcataaatctttcacacacctctttcatcctacaatgtcataatattagttggttttatctgtcttccttaatgtatccttaactcctgagagtggacgctacatcttagtcatctatgaaaccccagaaaatgtaatcaagctaaaatggctcactcatttcctagcaaatattggttaaatgactgaatggatgatacaggggg

SEQ ID NO: 12883 - DNA, 397 bp, Homo sapiens
tcgtcctctagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaasctggagggtggtgcaggccttgggcacaggaaggcgcctgtggaatagggggagttcatgcaccccttttttccccagagggctggactcaggttagtttgggggtgggggctcctgcactttgccacaggcacgggggagggttttctcctcrccccctctgccctcccaacttgggttgtactttctaagaaggtg

SEQ ID NO: 12884 - DNA, 496 bp, Homo sapiens
ctttctaactgttaagtctgagtgtttcacattcactgttgactgcaggctatcatcaaaacattacatttccttttacaaaggttctggtaactcaaaatgttttctaaaagacactccctaattggggaggggtcttttgagacaattttgtatgtacttaatccgtgtttaagaaaactgtcctttaactcttacctttgtttacagtatatgttgtttatgtaatgtcctgatgtacattgatatacaggaagtacattaatatattaatcaggccaaggccgggcgccgtggctcgcgcctgtagtcccggcactttgggaggccgaggtgggtggatcgcctgagatcaggagttcgagaccggcctggccaacatggtgaagccctgtctctactaaaaatacaaaarattagccaggcatggtggcgcggacttgtagtcctagctgctacttgggaggctgaggtgggaggattgcttgagctggtg

SEQ ID NO: 12885 - DNA, 101 bp, Homo sapiens
ggccgggcgcggtggctcacgcctgtaatcccagctctcagggaggctaagaggcgggaggatagcttgagcccaggagttcgagacctgcctgggcaata

SEQ ID NO: 12886 - DNA, 439 bp, Homo sapiens
  misc_feature 167: n=a, g, c or t
aaatttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacgnaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggtaccttgcaaaatactgtcataagtgctaaaggacgaaagtgggaaaaaacagaatgataacatggttcacattttaaagaattaaagtgctggttttaatagtaaaaaaaaaaaaaaaaaggc

SEQ ID NO: 12887 - DNA, 307 bp, Homo sapiens
  misc_feature 305: n=a, g, c or t
ttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccattgcaaaaaaaaaaaaaaaaangy

SEQ ID NO: 12888 - DNA, 297 bp, Homo sapiens
ttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccattgcaaaaaaaaaa

SEQ ID NO: 12889 - DNA, 68 bp, Homo sapiens
ttccgccactgcactccagccttggtgacagagcaagactctgtctcaaaaaaaaaaaaaaaaaaaaa

SEQ ID NO: 12890 - DNA, 211 bp, Homo sapiens
  misc_feature 98: n=a, g, c or t
sgaaaaaaagggtsttstgagctgmagtggcaattagacmagaagatccccgctcctgtstctaaagaggggaaagggmaaggatggtggaggctttntgtgctacctggaagctgaccaacagtcagaactttgatgagtacatgaaggctctaggcgtgggctttgcactaggcaggtgggaaatgtgaccaaccaacggtaattatca

SEQ ID NO: 12891 - DNA, 454 bp, Homo sapiens
tttaccatgttgcttaggctggtcttgaactcctgagctcgggcaatctgcctcccttggcctcccaaagtgctgaggttacagatgtgagccactgtgcccagcctattctttagcttttataaatagattcataaagtatatactgtttggttttggtttctttcattcaacataatgttttttagatttatacatgatggtgagtttattcttttttattgctgtatagcatttcattgtgtaactatattatgctttatttttaccatttgttcgtgatcatttgggttgttccctagtttttggttataaatacattcttgtacatgtcttttggtagacatatacatgcatttactttgaagagcatacttaggagtataattgagtaacagatttattatatgtttaactttgatactgccaaatggtttttctaattgcagttgaa

SEQ ID NO: 12892 - DNA, 130 bp, Homo sapiens
atatataaaataaaaggagacatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12893 - DNA, 184 bp, Homo sapiens
agaagggattggcctccctgaaacctcccagctcaatgaccagatctccaggcacaggaacgggggcaggggatggtgaatgacggggtattgcctaaggctggtgcacttttatttaaataaacttgtgtggtaaaaaaaaaaaaaaaaaaaaaaaaaaaaaaaaaaaaaaaaaaaaaaaaaa

SEQ ID NO: 12894 - DNA, 289 bp, Homo sapiens
gggtgcattggctcacgccagtaatcccagcactttgagcggctgaggtgggaggattgcttgggcccgggagttcaagaccagcctggacagcaaggtgaggccccatttctacaaaaaattagccacatgtggtggcatttgcctgtagtcccagctgcatgggagagtgaggtgagagggtcgcttgggcccagagggtagagactgcagtgagccgtgtttgcacccctgcactccagcctgtgtgacagagtgagactgtgtctccaaaaaaaaaaaaaaaaag

SEQ ID NO: 12895 - DNA, 335 bp, Homo sapiens
atagctggtgtctctatttaaaaaaggatcttttggccaggcacagtggctcacacctgtaatcccagcactttgggaggccaaagtggatgaatcacttaatttcaggagtttgagaccagcctggccaacatagtgaagccccatctctactaaaaatgcacaaaaaattagccaggtgtggtggcggatgctgtaattccagctactccagaagctgaggcaggagaatcactggagcctgggagagtgaggttgcagtgagctgagattgcatcattgtactccaacctgggtgacaagagcaagactctaatctcaaaaaaaaaaaaaaa

SEQ ID NO: 12896 - DNA, 323 bp, Homo sapiens
atagctggtgtctctatttaaaaaaggatcttttggccaggcacagtggctcacacctgtaatcccagcactttgggaggccaaagtggatgaatcacttaatttcaggagtttgagaccagcctggccaacatagtgaagccccatctctactaaaaatgcacaaaaaattagccaggtgtggtggcggatgctgtaattccagctactccagaagctgaggcaggagaatcactggagcctgggagagtgaggttgcagtgagctgagattgcatcattgtactccaacctgggtgacaagagcaagactctatctcaaaa

SEQ ID NO: 12897 - DNA, 397 bp, Homo sapiens
atttttaagttttggttttggagttttgctattctgggaaggtaccttttactacaacaagtaaacatgcataataaagtaggattcatccaatgtctgacctttctttgcatcaaaagaacatttccggccaggcacggtggctcacgcctgtaatcccagcactttgggaggccgagccaggtggatcacgaggtcaggagatcgagaccagcctggcctaacatggtgaaacctgtctctactaaaaatacaaaaatgagccgggcatggtgggggggcacgtagtcccagctacttgagaggctgagacaggagaatggcgtgaacccggggggcggasttgtagtgagccgagatcgcgccactgcactccagcctgggtgacagagtgaga

SEQ ID NO: 12898 - DNA, 440 bp, Homo sapiens
  misc_feature 409: n=a, g, c or t
tttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgcctcaacaatttcaggggtggtgtgattctggtgtcccacgatgagcgctttatcaggctggtgtgccgggagttgtgggtatgcgaaggaggcggcgtcacccgtgtggaaggargatttgaccagtacngcgccctcctccaggaacagttccgccgcga

SEQ ID NO: 12899 - DNA, 345 bp, Homo sapiens
  misc_feature 272: n=a, g, c or t
atttattcctttgtcttgactactgctccgattatgctcatgccctattctgaacccctcagatgagttccgtgtttgttttgcttgtcctagtgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaancaaagtgccccaacccggcagtgtgggcaacctgtacagctggcagatcctgaacatgcctgagctgcacctt

SEQ ID NO: 12900 - DNA, 459 bp, Homo sapiens
agattctcrggctcagaaccagaatttcttcatctgaggctattatcttgctctggaggakggagtgagaactggatcactggttacggtggtgactgggacaacagcacagccacagacaggaacacagaaggcagaggcagccttgatctgcaagggctccagttaaccccaatgggkaccctcgatggacaaaggcactctcctaggcttggtgatgaaagtattcctcttacagccaggcaaggcactcagggctctgcagcagagaagttagagctgtagcttttttgcttggtgttttcactaaaacttaatttcttgttgcacttgttggatgggcatgtcccataggggaagtttccactactgtgttctaaactttggactgcttgtaccatcttacttgttccctcattaataatgaactaaataaaacctttagtatatgccaaaaaa

SEQ ID NO: 12901 - DNA, 352 bp, Homo sapiens
tgcaatccaatcctagaatatagattagtagaattgtatagtgggattgtagctggagaagattctgggaaagttctttcttactagaccttataatcattcaattaaaatatttctaatattaaatcatctttgcatttctggattaatgcttacccttttttttttccttaaatgaaacaaacaccttcagatgaaaaagagcagtactgatctaaaataacaggtaggaccaggcacaatggctcatgcctgtaatcccagcattttgggaagccaagacaagagaattgcttgagcctaaggagttcaggaccagcctcggcaacatagttaggcctcgtctctcaaa

SEQ ID NO: 12902 - DNA, 318 bp, Homo sapiens
gaaggtcaaagtgatgtgtcttttagaggctttgggacactttttagtaagtatgagcagacaaatgcaatgaaatatgctatgaaaaaacccttctgaactgagagagggcttatcactatatccagctaagatttgtatttgaatcatctgtaaagtcgcactcttacaacaagcttctgggttttaaatacctccgtacagcaagtaaacgttccccgctttctgttctcagtgtcctcggtcatggtgcttttcgttgcattaaaagtgccggtcaaactttgatagtatttttttatagttggttgcagagtg

SEQ ID NO: 12903 - DNA, 124 bp, Homo sapiens
caggagggaggattgcctgagcccaggagtttgaagccaggcatggtggctcataccataatcccagcactttgggtgggaagattgcttgagactgtctctacaaaaaaaaaaaaaaaaaagc

SEQ ID NO: 12904 - DNA, 468 bp, Homo sapiens
caaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaacaaacaaacaaacaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctat

SEQ ID NO: 12905 - DNA, 479 bp, Homo sapiens
ctttaatccaagaaaaatattctctatatcctttgtttttaaatcttttaaacatatagagcatattttatgttgttaaatttttgagaaactacttactagcaagtaaaatgttggcagattttctttgcccctattaaatgaaaacatttacaagatgctgcatgttactggacaggaacagttgttgcacataggtaatcttaagattttttaaagtattttcaaaaagctataagactacttatatggtaggatcacaatagtttcaaaactcagggtttggcttttaaaattttcatactttggtagaatgttaaagaacacaagatgtttcacagtcttttagcagaagagaatctgaacattccaattagaactttattccaaagaagggtaattttattttgtcttttaagtaatttgacccatttatatctgtatgctatatattttactgtaggttgcctgttagtctg

SEQ ID NO: 12906 - DNA, 288 bp, Homo sapiens
aaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagctccaaaaaaaaaaaaaaaag

SEQ ID NO: 12907 - DNA, 357 bp, Homo sapiens
tggctagagtgtacctagagagggaaaatttcaatagacagtaggccagttcaagactggatagaggccgggcgcggggcctgtggtcctagcactttgggaggtcgaggcgggtggatcacctgagctcaggagttcgagagcaacctgaccaacatggtgaaacaccgtctctgctaagaatacagaaattagctaggtgtggtggtgggctcctgtagtcccaggtactcgggaggctgaggcaggaggatcgcttgaacccggaaggcgaaggttgcaatgagccgagatcgtgccattgcactccagcctgggcgacttagcgaaactccgtctcaaaaaaaaaaaaaaaaa

SEQ ID NO: 12908 - DNA, 380 bp, Homo sapiens
atatataaaatataaaaaatatgtggcaccaccattccctatttatattttagttgtgatttaaaaatgagatttgactaaagcatttagcatacatgatcatccataatatgtgccctactccttaattcttactggttaccttagaaattttaagtttgactgacttctttagaaaaatgtacgtaaatcacagatgccccaatgtggtattgaaagcaaattaaaaattttaaattagggccaggcacagtggctcatgcctgtaatcccaagtgctttgggaggcagaggtgggaggattgcttgaggccaggagtttgagaccagcctgagcaatatagtgagactcctccatctacaaaaaaaaaaaaaaaaag

SEQ ID NO: 12909 - DNA, 300 bp, Homo sapiens
ttgtcttgactactcaaagcccctgaattgttgtcaactttcccctttgtgttgtgtagccctaacgtcatttagcttgttgtctgatgcctccagtaggacacctccgatggagctttgatttctgagcagcgaaastcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcaaaaaaaaaaaaaaaaag

SEQ ID NO: 12910 - DNA, 476 bp, Homo sapiens
aaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttgaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgaga

SEQ ID NO: 12911 - DNA, 431 bp, Homo sapiens
  misc_feature 417: n=a, g, c or t
ttttttgtattttttgtagagacagggtttcgccatgcttccctggctggtctcgaactcctaagctcaagcaatccacctgccttggcctcccagagtgctgggattataggcacgagccactgtgcctggccggaagctccttaatttggccccggtgtctcattgacatacctccatcattgtgctttttgttttgttttgtttttagcacttccttacctttgggcactacaacatgctccagactcatcatttgtatttcttgcctaattttagaattaaccattccttcaaggagccctggttccttctataactattttttttaattgcgatataactcacatactatataatccacctatttaaaatgtgcaactcagtagcttttgatatattcacagatgtgcagcnattgccgcaatcaa

SEQ ID NO: 12912 - DNA, 257 bp, Homo sapiens
gactcacgccttgggaggccgaggcgggtggattacctgaggtcaggagttcaggaccagcctggccaacatggtgaaactccgtctttacaaaaaatacaaaaattagccgggcgtggtggcatacgctgtaatcccagctacttgggaggctgagacaggagaattgcttgaacctgggaggtggaggttgcagtgagccaagatcgcgccactgcactctagcctgggggacatagcaagactttgtctcaaaa

SEQ ID NO: 12913 - DNA, 271 bp, Homo sapiens
gactcacgccttgggaggccgaggcgggtggattacctgaggtcaggagttcaggaccagcctggccaacatggtgaaactccgtctttacaaaaaatacaaaaattagccgggcgtggtggcatacgcctgtaatcccagctacttgggaggctgagacaggagaattgcttgaacctgggaggtggaggttgcagtgagccaagatcgcgccactgcactctagcctgggggacatagcaagactttgtctcaaaaaaaaaaaaaaaaa

SEQ ID NO: 12914 - DNA, 283 bp, Homo sapiens
atttttagtagagacggggtttcaccgtgttagccaggaaggtctcaatctcctgacctcgtgaatcgcccccctcggtctcccaaagtgstggattacaggcgtgagcaccatgcccggcccaaatattttttattcaggatggtataacctaactgataataggtaataaggttaaatttttttatgasgtattttatttacaaatatcatacactgctggtgttaccatatgaaaggaaataaagtcaattgataattgcctcaaaaaaaaaaaaaaaaa

SEQ ID NO: 12915 - DNA, 297 bp, Homo sapiens
tacaaataaaatatcaaaaacatggccaggcgcggtggctcacgcctgtaatcccagcactttgggaggccgaagccggcggatcacgaggtcaggagatcgaaaccgtcctggctaacacagtgaaaccccgtctctactaaaaatacaaaaaattagcctggcttggtgctactcgggaggctgcggcaggagaatggcgtgaacccgggaggcggasttgcagtgagccgagatctcgccactgcactccagcctgggtgacagggcaagactccatctcaaaaaacaaaaaca

SEQ ID NO: 12916 - DNA, 307 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctc

SEQ ID NO: 12917 - DNA, 203 bp, Homo sapiens
tgaactatcaaacttaggagccatctagcttacacgtgttccttaaaaagtttgctgtaggccgggcacagtggctcgtacctgtagtcccagcabttttgggagcccagggtgggggatcacttgagctcaggagttcaagaccagcctgggcaacatggcaaaacgbcatctctacaaaaatacaaaaaaaaaaaaaaaaa

SEQ ID NO: 12918 - DNA, 61 bp, Homo sapiens
acatatattcttttgtcttttgcttctctcagtcgactaacattgtaagagtcagcttcaa

SEQ ID NO: 12919 - DNA, 274 bp, Homo sapiens; identical to SEQ ID NO: 12787

SEQ ID NO: 12920 - DNA, 209 bp, Homo sapiens
ttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaaaaaaaaaaaaaaaaaaaaaaaaaaaaaaaaaaaaaaaaaaaa

SEQ ID NO: 12921 - DNA, 338 bp, Homo sapiens
agttttctatgtagatgttttacttacatttcattaaatttattgttaggccgggcatggtggctcacgcctgataatcccagcactttgggaagccgaggcaggtggatcatgaggtcgagatcgagaccatcctggctaacaaggtgaaacccgtctctactaaaaatacaaaaaattagccgggcgcggtggcgggcgcctgtagtcccagctactcgggaggctgaggcaggagaatggcgtgaacccgggaakcggastttcagtgagccgagattgcgccactgyagtccgcagtccggcctgggcgacagagcgagactccgtctcaaaaa

SEQ ID NO: 12922 - DNA, 68 bp, Homo sapiens
attctgstttccaactgcctkmttgcttgttcgtctcastggtgtgagctccagcatcscctttgctc

SEQ ID NO: 12923 - DNA, 184 bp, Homo sapiens
ttttggggggataaatasctagatagatagggactgctaggtcatgtggtcagtgcasgstcaaccttttacaaaactgsscagttgctttscacatggstgcaccattttgsattcccatcaacamyggataagaactccggctgggtgcmgtggctcacgcctataatcccagsactttggg

SEQ ID NO: 12924 - DNA, 502 bp, Homo sapiens
taaataaattagccagggacgctgatgcacatccatactcccagctacttgggaaactgaggcaggaggattgcttgagcccaggaatctgaggctgccatgagctgtaatcactgtgctgcactctagcctgggcaagagggcaagacctcatctcaaaaacaacaacaacaaaagaaagtttaaagctcttgataaagcaattagatttgaggtaaagggactaatataatacatatgaaagaatgaacaattaggctgggcatggtggctcacgcttgtaatcccaacactttggaggctgaggcgggcggattacctgaggtcaagagtttgagaccagcctggccaatgtggtgaaacccatctctactaaaaatacaaaaattagccaggcatggtggcacgtgcctgtaatcccagctacttgggaggctgaggcaggagaattgcttgaacctgggaggcggagatgcagtgagccaagattgcgcccactaca

SEQ ID NO: 12925 - DNA, 421 bp, Homo sapiens
cacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcgagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaat

SEQ ID NO: 12926 - DNA, 491 bp, Homo sapiens
tattaagtgcccaaatgtcggcatcatgcagtatacctatgtgacaaatctgcacgcataccctcaaatgtaaaataaaaagaataaaatgctttgggctataacaacatcacatttttstagctcttggttaatagctgaaattaggggtgaaagacaaggaattatatcccctttggcatggggtgaatgtttctattccaggtcaccccaaattttatgagbtaacatctataaaagctcttggcctatagcccaaggttttcttctcaagtatgcagttaaaataaatgactctacatstttattttttattaakstgtacgttagastatagagttaatttgtcastctgstctttggggaataaatattagtatasaacctgtattastttaataaagaaattatttstttagttttgattsttcaggatgattcaattccctggtgagagaataacttactttattaaggtaatagatgtaggg

SEQ ID NO: 12927 - DNA, 414 bp, Homo sapiens
ctaagaattgggcacaacaaatttgcactctaagaaatgttaaaggaggttcttcaggctagaagaaaataataccagatagaaacgttaaatgtccgctttaaaaacgaggagcatggccgggcacgtggcttacacctctaatcccagcactttgggaggctgaggcaggcagatcacctgaggtggggagtttgagactagcctgaccaacatggagaaaccccgtctctactaaaaatacaaaaaattagctgagagtggtggcgcatgctgtggtcccagctactctggaggctgaggcaggagaatcgcttgaacctgggaggtggaggttgtggtgagctgaggtcacgccactgcactccagcctgggcaacaagagtgaaactctgtcaaaaaaaaaaaaaaaaa

SEQ ID NO: 12928 - DNA, 259 bp, Homo sapiens
taaattagtaggctgggcacggtggctcacgcctgtaatcccagcactttgggaggccgaggcgggtggatcacgaggtcaggagatcgagaccacggtgaaacccgtctctactaaaaaaaaaaaattagccgggcgcggtggcgggcgcctgtagtcccagctactcaggaggctgaggcaggagaatggcgtgaacccgggaggcggasttgcagtgggctgagattgcgccactgcactccagcctgggtgacag

SEQ ID NO: 12929 - DNA, 222 bp, Homo sapiens
  misc_feature 17: n=a, g, c or t
tacagaaatasaatgtntgataaaatttcttgatcacaatatcttttttttattgttaaacttaaaggaactttattagtataaatttatggaggccgggcgtggtggctcacgcctgtaatcccagctactcgggaggctgagccaggagaattgcttgaatatgggaggcagagtttgtggtgagctgacatcatgccactgcactccagcctgggtgac

SEQ ID NO: 12930 - DNA, 71 bp, Homo sapiens
ctttttttttttttcttttttcsggcgttcaagwtgtcaaagcgaggacgtggtgggtcctctggtgcgaa

SEQ ID NO: 12931 - DNA, 53 bp, Homo sapiens
atccgggggtcgtttccaggagctgcagccctccagcctggggtctggccagg

SEQ ID NO: 12932 - DNA, 339 bp, Homo sapiens
aaaaaggcaggagctgagctctgggaacggctctatccctcctgcagcgtcccgggacaggccctcggattttgggggacccttccctggytttcagagtttcttgaacgttctctccctggtgctgcctccgccacccttcggtagccactcgctctcggctgttmgcactaaaggcggcccctcgtattaacaacgggccctacttctgctgtccctccaaggggcggactcggagaagakcacggtggtggaaggcggtgaagtgcgcttcaatggcaagggaaaaaagatccgtaaacccaggacgatttattccagtttgcagttgcaggcttt

SEQ ID NO: 12933 - DNA, 493 bp, Homo sapiens
gacagggtttcctcatgttgcccaggctggtcttgaactcctgagttcaagcaatccacctgcctcggcttcccaaagtggtggtattacaggtgtgagccagtgcacctggcccatatttatcttaaaaaaaaaatagatgtttatcattttttatatagactcattgaaaaaatgactttgtgttcttccagtacataccatcatgtctgagagggcagagatctagacaagtgtgggaaagatgactttggatcaaaattttcttgtgaatataatgtgcttatgcgtaatttaaagctgactgtattaaagatacattttttgtcaaccagatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaa

SEQ ID NO: 12934 - DNA, 276 bp, Homo sapiens
ctcacgcctgtaattccagcactttgggagcccgaggtgggtggatcacctgaggttgggagttcaagaccagcctgaccaacatggagaaaccccgtctctactaaaaatacagggttggccgggatggtggtgcatgcctgtaatcccagctactcaggaggctgaggcaggaaagtcgcttgaacccgggaggcagaggttgtggtgagccgagattgcgccattgcactccagtctaggcaacaagagtgaaactctgtctcaaaaaaaaaa

SEQ ID NO: 12935 - DNA, 233 bp, Homo sapiens
atttgtgttgttcgccagctaggcctggcctcgtcccgsttckhtcggtasggtstcgcgcgcccccatagswsttgstagagggttagmgttagcttaagtgtgsgaatccgaggagcagcgagakactcgagaccacgctccttcctcgggaaggaggcggcacctcgcgtttgaggcccgcctgcgtttgaggcccgcctgcgcttgcggcccgcctgcgcttgaggcct

SEQ ID NO: 12936 - DNA, 350 bp, Homo sapiens
gaaaaaggccgctcgctcgagattacgcgcgctggagtgcaatggcgcaatctcagttcgctgcaacctccacctcccagggattgtgctgcctcagcctcccaagttgttgggattgtagacacccaccaccacgcccggctaattttttgtatttttagtagagacggggtttccccatgttggccatgcgatctccaactctggacctcaggcgggcagatcacttgaggtcgggagtttgagaccagcctggccaatgtggcgaaaccccatctttattaaaaatacaaaaaatgagctaggtgtggaggtgcgsacstgtggttctcagctactcaggagactga

SEQ ID NO: 12937 - DNA, 256 bp, Homo sapiens
ctttctttcccagccacagccagggtagggctgataaggcgctgatgcgttgatggcagccttgcagagctagacctgcacttaacttgcagctgcctcccgagcctcccaagatgtccacgccctgggtgacaggcggcagggcgctgcccgtgctcccccggctctgctcgacagcagcacgcagtagagcctcgccgccgccgaggagcaacttcatgtaacggcacagcaacaagatgaacgggagcttttg

SEQ ID NO: 12938 - DNA, 340 bp, Homo sapiens
ttggggattgatgtaagatcatctgtttttcatgttgcaaagtaaggatgttttaaaacaaggtagctgggcgcagtggctcatgcccgtaaccccagcactttgggaggccaaggcaggtggatcatctgaggtcgggaattgagaccagcctggccatcatggtggaaccccatctctactggaattacaaaattagctgggcgtggtggcgattgcctatgatcgtagctactcgggaggctgaggcaggagaatcgcttgaacctgggaggcggaggttgcagtgagctgagatcgtgccactgcactccagcctggatgaaagagcaaaactctg

SEQ ID NO: 12939 - DNA, 62 bp, Homo sapiens
aaaaaaacaaaaaaaaaaasggagsgagsgaktggagagagggttasggagagtgtgasaaa

SEQ ID NO: 12940 - DNA, 372 bp, Homo sapiens
catctgaggttctaaatagggcaggagcgcccctgccagtcccctttggcacagttctgcgtgcacagcctgtctcctctgagctgttcaaggtggtgactgatgccatatgtttttgcgcmmcttcccaacacgtgtggtgaaggaccaggattttggttttttgttttgtttcgaattttctaatccactgcacgttgatacgtctgtaaaagacaatacaaatgaattactaggaaaatgatcacacatttggttgtcactgcagtgttgaattgcaggtttctaaatgcttcttttcaatttctgcacttatttcctggcctggtaacagtttgcagtctgtcactggggasacactttgagcagctg

SEQ ID NO: 12941 - DNA, 330 bp, Homo sapiens
  misc_feature 73: n=a, g, c or t
tattctggattttctctaacaaataatasttgatagggccaggcatggtggctcacgcctacaatcccagcanttttggaggctgacaggggtggatcactttagctcaggagtttgagaccaacctgggcaacatggtgaaacccatgtctaccaaaaatacaaaaaattaaccgggcctggtggtgtgtggtcccagbtactaaggaggctgagatggaaggatgacttgaacccgggaggcggaagttgcagcaagccaagatcacgctactgcactccagcctgggtgacccagtgagaccacatctcaaaaaaaaaaaaaaaaag

SEQ ID NO: 12942 - DNA, 413 bp, Homo sapiens
gaaaaaggccgctcgctcgagattacgcgcgctggagtgcaatggcgcaatctcagttcgctgcaacctccacctcccagggattgtgctgcctcagcctcccaagttgttgggattgtagacacccaccaccacgcccggctaattttttgtatttttagtagagacggggtttccccatgttggccatgccgatctccaactctggacctcaggcgggcagatcacttgaggtcgggagtttgagaccagcctggccaatgtggcgaaaccccatctttattaaaaatacaaaaaatgagctaggtgtggaggtgcgcccctgtggttctcagctactcaggagactgaggcaggagaatcacttgaacctgggacgtggaggttgcagtgagccccaaatagcaccactg

SEQ ID NO: 12943 - DNA, 417 bp, Homo sapiens
cataggaataaccttgaaacagatcttctataatatgccaaccaagtaaatgtttgcaaacacaggaaattttatgattagtgactattggttgtaaaaaaaaaaaaattctcactcaaatacaataagtaccaatgtcttaatgcttatctggcatggccaaggtcactattttaggaagtttgaataccaggattgtcagcagtgttgccaaattctttcatggctttactctggaatatggtgtgcttgttatcccaaggcttgcttttctagagacagctgattgaatcaaagagagaaatccatatccaaattaatgattacmtactttgacctctactgctgacagctactgatttattacattaccatataccaagtagtatgacacttttacaaatattattttattta

SEQ ID NO: 12944 - DNA, 514 bp, Homo sapiens
gcacttccggtctcgtgccgccttcccaggaccctcagggagagcgggcagccttccaggtggacaggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccgctaatgctgcctaccttgggggccaagaaatgatggaggtggtgaagagagatgacgaaaccataaaggagcatttatgtaagcttacattttattatggtactatagatccttggtgtccaaaagagtacta

SEQ ID NO: 12945 - DNA, 482 bp, Homo sapiens
atttcagcttttgggtgaagacggaggcggttctggacagacstacgctgtcagggagtgtttacttcgcctccacttctgttcctccccgccctggtgctgctccrggtcacatactcktcctgagccggcttcagcctctcygcgcagaagtstcccggagccatggcckagtawtcttatgygaagtctaccaagcttgtgctcaagggaacgagatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagagctaagaagtgacagaatcgggatttaaaatctggcggtgtggctctacaatctgctttgaactttaaacataatatgtac

SEQ ID NO: 12946 - DNA, 324 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctcaaaaaaaaaaaaaaaaa

SEQ ID NO: 12947 - DNA, 399 bp, Homo sapiens
tcttataaaagttgttaattttgccatgagcttttcattaaaaatttatgatttgatcaacttcatttgatttcaaattatcactaaaatgtgtgctttttgcattaaataggcatgtaattcttccttttattcagttccaatccacgttgacctgtgattataaacccccattgtgttatagaacttgacaaatgtctgcttgttctggatattaggcaaagtatgagaatctgactttatttcagatctttttatacgtctgaaagaagcctaggttggatagttttcaaacatttgcaaatcataatagtattttatttttaaaagagtctaatggtaataataaatacgaatttattgataaataataataaaaataaataagttaatatttat

SEQ ID NO: 12948 - DNA, 281 bp, Homo sapiens
atgttgtgaaccgggtcgcggcggccgaggctcgggcctccaggaccactggctgcccatgagagacgaaggatggcatccaagggggccggcgtgtctttctcccgcaagagctgtaggctgacctcagatgctgagaaatccagggtcacagttactcgggaggctgaggcaggagaatcgcttgaaccggagaggcggacgttgcagtgagccgaggtcaaaccagtgcactccagcctgggcaacagagcgagactccatctgaaaaagaagcaaaa

SEQ ID NO: 12949 - DNA, 365 bp, Homo sapiens
catttatatacaaggttgtccaggatgtataatccaggctttgttgagtggatgagggtatcctgactggggcctggcaaccccccgacatccacagaggaaaacaagtgtttgtgagagaagtgatagaatttgtcaaaagtatatgaaattagttacataaaatctgaaacatacattgtggttctgtttgtcctgtgactatgtaaaattgccattgaaaaaacccagaaagccgggcgtggtgactcatgcccgtaatcccagcactttgagaggctgaagcgggtggattgcttgcgcccaggagtttgagaccagtctgggcaatatagagaccctatctccaaaaaaaaaaaaaaaaa

SEQ ID NO: 12950 - DNA, 513 bp, Homo sapiens
aaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacagagagaccctgtctggaggggtggggggagaaaaaaacaccatagaaacaacccaaatgtccaataacaaattgtagtccatccatacaatggactactactcagccatgaaaaggaatacagcactcacatatgctgcatgtgaatgaaccctggaagcattatgctcagtgtaagaacccagacataaaaggtcacacattttatgattccacctatatgaaatatccagaaga

SEQ ID NO: 12951 - DNA, 308 bp, Homo sapiens
  misc_feature 150: n=a, g, c or t
cgcgttgcccaggctggtctsaaactcctaggctggaagaatccccmagcactttgggaggcsaaggcgggcggatcacgaggtcaggagatcgagagcatcctggctaacacggtgaaaccsgtstytactaaaaatacaaaaaattancsgggtgtggtggtggatgcctgtactccsagctactcgggaggctgaggcaggagaatggcgtgaacccgggaggcggacttgcagtgagccgagatcgcacagctgcactccagcctgggcgggcaacagagtgagactccgtcccaaaaaaaaaa

SEQ ID NO: 12952 - DNA, 82 bp, Homo sapiens
aaaagaaagaaagagagagaaaaaaagaaagaaagaaggaaggaaaaaagaaagaaagaaagaaaagaaagagagagaaagg

SEQ ID NO: 12953 - DNA, 315 bp, Homo sapiens
cgcgttgcccaggctggtctcaaactcctaggctggaagaatcccccagcactttgggaggccaaggcgggcggatcacgaggtcaggagatcgagagcatcctggctaacacggtgaaacccgtctctactaaaaatacaaaaaattagccgggtgtggtggtggatgcctgtagtcccagctactcgggaggctgaggcaggagaatggcgtgaacccgggaggcggasttgcagtgagccgagatcgcacagctgcactccagcctgggcgggcaacagagtgagactccgtcccaaaaaaaaaaaaaaaaa

SEQ ID NO: 12954 - DNA, 509 bp, Homo sapiens
tctctttggatgatctgttcagtgctgaaagtagggtgttgaagtctcctattattgaaatgcagtctgtctctccctttagatctaatatttgctctggtgttgggatttctaatgtgaagtctattttatctgataaaactacaactactcctgctttcttttgctttccatttgcatggaatatcttcatgtgtccttacgggtgaggtctaccagcaacaaattgcctcaatttttgttttctacaaaagtctctgccaggcacggtagctcacagctgtaatcccagcactttgggaggccaaggcaggtggatcacttggtcagcagttcaagaccggcctggccaacatggtgaaaacccacctctactaaaaatacaaaaattagctgggcgtggtggtgtgtgcctgtaatcccagctactcgggaggctgaggcagaagaatcacttgaacctgggaggcggaggttgcagtgagccaagatcacgccattgcactctg

SEQ ID NO: 12955 - DNA, 175 bp, Homo sapiens
caaaaattagccatgcgtggtggcagacgcctgtaatcccagctactcgggaggctgaggcagagagttgcttgaacccaggaggcggagtttgcagtgagctgagattgtaccactgcactccagcttgggtgacagagtgagactctgtcacacacaaaaaaaaaaaaaaaaa

SEQ ID NO: 12956 - DNA, 473 bp, Homo sapiens
  misc_feature 28..29: n=a, g, c or t
ttccccatcttctcctctattctggtcnnccctksscccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcagagatcctagtatggaggaacatctgtctgtcatgtatgagagactgagacaagaggtaagtcagtgcaaaagtggccttcgtctacagtgggaaggatgtgggtaatccttggacgtacagggatagtcaactggattcttttttggaaccatgaggcaggcatagaaatatattataaacattttcct

SEQ ID NO: 12957 - DNA, 452 bp, Homo sapiens
  misc_feature 20: n=a, g, c or t
attattattattgttattantattttgtagaaacggggttttgccatgttgtccaagctagtctcaatctcctgagctcaggcaagtcgcctgtctcagcctcccaaagtgctgggattacaggcgtgascaccatgcccgtccccagactctcttaaataaccagatctcctgtgaactaactgagtgggaactcactcatcaacaaggggatggtgctaacccattcatgagtggttgacccccttgatccaatacctcccaccaggctctaccccgtctctactaaaaatacaaaaaattacgccgggtatggtggcgggcgcttgtagtcccagctacttgggaggctgaggtgggagaatggcgtggacccgggaggcagagcttgtagtgagccgagatcgcgccactgcactccagcttgggggacagagtgagactctgtctca

SEQ ID NO: 12958 - DNA, 324 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatttactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctcaaaaaaaaaaaaaaaaa

SEQ ID NO: 12959 - DNA, 311 bp, Homo sapiens
ttctggatgagtgtagtggctcacgcttgtaattccagcagtttgggaggccaaggtgggagaattgcttgagcctaggagtttgagatcagcctgggcaacataactagatgctgtgtctacaaataataaaaaaattagctgagtgtcgtggcctgtgtatctggtcccacctactcgggaggctgggatgggaggattgcttgagcctaggaggtcaaggcagtagtgtgttgtgataatactaccgtactccagcctgggcaacagagtgagaccccatccctccacaaaaaaaaaaaaaaaaaggs

SEQ ID NO: 12960 - DNA, 372 bp, Homo sapiens
aacaattagagatactttatttatttatttatttatttgagatggagtcttgctatgtcacccaggctggagtgcagtggcacagtctcagctcactgcagcctctgactccggggttcaggcgattctcctgcctcagcctcccgagtagctgggattacaggcgcccgtcaccacgcccggctgatttttttgtattttttggtagagatggagtttcaccatgttggccgggctggtctcgaactcctgaccttaagtgatctgcccgcctcggcctctgaaagtactgggattacagcataagccactgcacccagccagacaattagagatattttagaggagagtacaagggaaactttcagagtg

SEQ ID NO: 12961 - DNA, 458 bp, Homo sapiens
  misc_feature 451: n=a, g, c or t
aggtagaattggtagtttcgtgaacacttaaaaggtgagggatgaggcccagcactttgagaggccaaggtaggtggatcacttgaggtcaggagttcgagaccagtctgggcaacatggcaaaaccccatctctactaaaaatacaaaaagttagctgggcatggtggcgcgtgcctataattccagctactcgggaggctgaggcacaaacattgcttgaacgggggacacagaagctgcagtgagccgagattgtgccactgcactccagcctgggggacagagtgagactctgtctcaaaaaaaaaaagtgaaggatgagaatggtgcggtggcattatcaaagaccggggtttccagtgtggttrattaggcaatgatgttaatggaaatagggaatccaggaggagaatgagggggaaagatagtaagtttaggttttagtcttntcgtggt

SEQ ID NO: 12962 - DNA, 494 bp, Homo sapiens
catttataggaaacaagactttgaggaaatagaccaaaatggtgtcagaggttgtgtgagggagataagaatatggagatattctttccctttctctcattttcacgtttttttctaatgtgattatgttacttttattgtaagaaaaccttcccttctccccttcttttttcctctccactaagagtctcctcttcttttcttctcttctgttgcctaggttggagtgctgtggtgtgatcacagctcactgcagcctcgacctctctggctcaggtgatcctcctgcctcagcgtcccgagcggctgggaccacaggtgcatgccactacatctgattaattttttaattatttgtagagatggggtctccctatgttacccaggctagtctagaacttctgagcggaaacagtcctcccgccttggcttcccaaagtgctggaattacagatgtgagccactgagcttggcctcttttcttcttctctaag

SEQ ID NO: 12963 - DNA, 287 bp, Homo sapiens
aaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgcaaaaaaaaaaaaaaaaa

SEQ ID NO: 12964 - DNA, 366 bp, Homo sapiens
  misc_feature 13: n=a, g, c or t
ttttataagaagncttgtaatcaggtaatgctggtcctccaactttgtattttaacattttctatatttgggccgggcgcggtggctcatgcctgtggtcccaccactttgggaggccgagatgggtggatcacgaggtcagggtttcgggaccaggctggccaacatggtgaagccccgtctctgctagaagtacaaagattggctgggtgtggtggcgggcggctgtaaccccagctgctcgggaggctgaggcaggagaatcttttgagccccggagcggatgttgcagtgagccgagatcgcaccattgcactccagcctgggcaacagggtgagactctatatcaaaaaaaaaaaaaaaaa

SEQ ID NO: 12965 - DNA, 288 bp, Homo sapiens
  misc_feature 286: n=a, g, c or t
gtagtttatccttagtcagaaaggtttcaggatgttggggttcaatttggtagtgctaatcaaaaattttaatttgcatataatttgaccctgcagtttcacttctaggaatctatgcaacagaaatgctcaaacaaatatacagtgcaggccgggcatggtggctcatgcctgtgatcctagcactttgggaggctgaggcaggtggattccttgaggtcaggagttcgagaccagcctggcaacatagtgagacccccatctctacaaaaaaaaaaaaaaaaangs

SEQ ID NO: 12966 - DNA, 509 bp, Homo sapiens
atttaaaaaacaagtaaataactaaagaaaagataactactggccaggtgcagtggctcacacatgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctg

SEQ ID NO: 12967 - DNA, 497 bp, Homo sapiens
cgaaattggacagcgaggctgtgccagggccacctgctgcccggacgtccagcctgaggaagccgaggaccatctctgaccaccctggcaccttaaataaggaagaggcccagattgtgaagacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggtdatgagatccttggggtccaccctagtctctgacacctgggacagggtgcttttgctactttggttgtggtcactcccccacacctgcctgcctccttaacggactcgaagtgaccttcctggaggaggt

SEQ ID NO: 12968 - DNA, 540 bp, Homo sapiens
cagaaacatctcggggggacttctaaaatttagtgaagacaaggccttgcaactccaaagaaactttttttcccccccttgaaacagggtcttgctctgttgcccagcctggagtgcagtggtgcagtcacggctcactgcagcctcaagctcctgggctcaagcactatccccacctcaacctccttagtagctgggactacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggct

SEQ ID NO: 12969 - DNA, 313 bp, Homo sapiens
ctttaaaaagagctttcatggccaggcgcggtggctcacgcttgtaatcccagcactttgggaggccgaggcgggcggatcacaaggtcaggagatcaagaccatcctggctaacacggtgaaaccccgtctctactaaaaatacaaaaaaattggctgggcgtggtggcgggcgcctgtagtcctagctactcaggaggaggcaggagaatggcgtgaacctgggaggtggagcttgcagtgagccgagatcgtgccactccccttcagctagggcgacagagggagactctgtctcaaaaaaaaaaaaaaa

SEQ ID NO: 12970 - DNA, 345 bp, Homo sapiens
agaacagcctaggtaactttgcaagactccatctctgctaactttttttttttttaaactgggctgggtgtggtggctcacacytgtaatcccagsactttgggaggctgaggcaggcggatcatgaggtaaggagattgagaccatcctggctaacacaatgaaaccccatcgctactaaaaatacaaaaaaatagccaggcgtagtggcaggcgcctgtagtcccagctastcagtaggctgaggcaggagaatagcatgaacccaggaggcggasttgcagtgagctgagattacgccactgcactcsagcctggatgacagagtgagactccgtctaaaaa

SEQ ID NO: 12971 - DNA, 486 bp, Homo sapiens
aaaggcaaaacatgtatatacaaaccatgaatttggataaatatagtatatgcatacaagaaaacagtattcagtcttaaaaattaaaattctgatacacagatctatgtaaaattctgatacatagctacaaaacatggatgaactctgaagacattatgctaagtgaaattagccagtcatgaaaagacaaaatactctatggttccacatatatggggtacctagaatagtcaaattcatagagacagtggttcccagggactgtggagagaaggaaatagtagctattgtttaatggatagagtttcggtatgaaatgatggagaagttctggagagggatagtggtgatgacggcacagtgtgaatctacttaatgccactaaactgtaccacttaaaaatgttttaaatggtacacttgatgttatgcatattttaccttttttttttttctttttgagacagagtctcactctgttgcc

SEQ ID NO: 12972 - DNA, 188 bp, Homo sapiens
catcacttgtaaacattttcacatggtttcaggaaatccccagcccttttattaggcctttttaggtactgaaacctttagctgatgttctctgttatttgcttgctttctgctgtcattccagctctctcagtttttattttccccatagcctcactttgaatattgactcctaaataaaagtggtc

SEQ ID NO: 12973 - DNA, 254 bp, Homo sapiens
aatcccagcactttgggagttcgaggtgggtggattgcctaaggtcaggagttcgagaccagcctgaccaacatggtgaaatcccgtctctactaaaaataaaaaaactagccgggcgtggtggtgggtgcctctaatcgcagctactcaggaggctgaggcaggagaatcacttgaacccgggaggcggaggctgcagtgagcagagatcacgccattgcactccagcctgggcaataagagtgaaactccag

SEQ ID NO: 12974 - DNA, 526 bp, Homo sapiens
agtttggaggtttctcaaagaacacagaactatcattcaatccagcaatcttgttactaggtgtatatccaaaggaaaagaaattgttataacaaaaagacacatgcactcatatattcattgcagtactatttgctatagcaaagagatgaagtcaacctaggtgcgcatcagtggtggatttggtaaagaaaatggtacatatacaccatggaataatgtacagccataaaagagaacaaaacaggccgggcacagtggctcacatctgtaatttcagcactttgggaggctgaggcaggtggatcacctgaggtcaggagttcaagacaagcctggccaacatggcaaaagccccgtctctactaagaatacaaaaaacattagctgggcatggtggtgcgcacctgtactcccaactactcgggaggcaggcatgagaatcacttgaacccaggaggcagaggttgcagtgagccggaaatcattccactgcactccagcctgggtgacagagtgagactcc

SEQ ID NO: 12975 - DNA, 477 bp, Homo sapiens
atttaaaatacatcagtgcgggccgggtgtggtggctcacacttataatcccaacacwttggaaggccgaggcgggaggatcacttgaagccacaaatttaagaccagcctggataatatagcgagaccctgtctctacaaaaaaaataaataaagaaaaaaataaaatatgtcagtgtgttttgggaacaggttgagagcatagcatgctcatattatatattcattttaccacttagatttgaattgaggcatctcttagaataggttttattttgtgcataccctcagaggacattgtccctctcatagaaacagatattcaaacatgtaatctgctattttattttaaggtaatagatttttatgattactgtttggaaaaaaaaaaagcacctataggttagcagttgctccagawtctccaaaacaagcttaggagatttttattctttaccagaatgagatggcttggga

SEQ ID NO: 12976 - DNA, 471 bp, Homo sapiens
taacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttttgtttctggcccctctaccaatagggcagtagcctcctgccctggatgggtataaggtgggcttggtccaacaggttcccagagggtacatactcctttctggggagagaatgctccctaccatatatttgacagtggttaggaactctccctttcccta

SEQ ID NO: 12977 - DNA, 161 bp, Homo sapiens
asaagcgattstcctgsctcagcctcccaagtagctgggattacaggctctggcaccatgcccggataatttatggtttctttccaatttgaggtctctctcctgaagtggctgacacaattkgagaaactggttatttaccaaggctttgacttggaatc

SEQ ID NO: 12978 - DNA, 397 bp, Homo sapiens
tctctttggatgatctgttcagtgctgaaagtagggtgttgaagtctcctattattgaaatgcagtctgtctctccctttagatctaatatttgctctggtgttgggatttctaatgtgaagtctattttatctgataaaactacaactactcctgctttcttttgctttccatttgcatggaatatcttcatgtgtccttacgggtgaggtctaccagcaacaaattgcctcaatttttgttttctacaaaagtctctgccaggcacggtagctcacagctgtaatcccagcactttgggaggccaaggcaggtggatcacttggtcagcagttcaagaccggcctggccaacatggtgaaaacccacctctactaaaaatacaaaaattagctgg

SEQ ID NO: 12979 - DNA, 361 bp, Homo sapiens
ctcattattcatctaccagttgtttattcggcactttttgtctgtccaagattgtgctggatgctggtgtataaagaaaaggtaaaggccgggtgcggtggctcacgcctgtaatcccagcactttgggaggccgaggcaggcagatcacgagggcaagagatcgagaccatcctggccaatatggtgaaaccgtctctcctaaaaatacaaaaattagctgggcgtggtagtgcgtgcctgtaatcccagctacttgggaggycgaggcaggagaatctcttcaacctgggaagcggaggttgcagtgagcsgagatcgtgccactgcactccagcctggcgacagagtgagactccatc

SEQ ID NO: 12980 - DNA, 404 bp, Homo sapiens
  misc_feature 219,239: n=a, g, c or t
ctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgangtggggagttggcagaatcnccatacctcgcagatttgctgagtctgtcttgtgcagagggccagagaatggcttatgggggcccaggttggatggggaaaggctaatggggtcagaccccaccccgtctacccctccagtcagcccagcgcccattcctgcagctcagctggggascatcattc

SEQ ID NO: 12981 - DNA, 450 bp, Homo sapiens
caggatattacccacttggtttaagttgtgatttcaaatcccattttctatgggagatacactggtggaacaaatctgcagagggccctgcacctgcgctggtggatcaacggtgtcttctcacctccagggctagctgccttgccttccctcgtggggcttaagtggctgggaagcagatagacagtgtagatgaagtcctgggccactggctgctggactgaggcagtgagatgactgggctggcatttgttctttctctgcctgtgtgtgacctctaactatgtgcctggaaactgaattacatgtaattaatgctgcaaacaggattttcttattgcctaagcatgaacttggtatgaaaataatagttaataatttactatgtaacttggattcttataacctggactgtaagtttgttttagctccagtgggagtttccttttc

SEQ ID NO: 12982 - DNA, 309 bp, Homo sapiens
tgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaggctgaggccgtatcacttgaggtcaggtgtttgagattagcctggccaacaagctgaaactccatctctactaaaaatgcaaaa

SEQ ID NO: 12983 - DNA, 356 bp, Homo sapiens
caaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatcccaaaa

SEQ ID NO: 12984 - DNA, 351 bp, Homo sapiens; identical to SEQ ID NO: 12784

SEQ ID NO: 12985 - DNA, 465 bp, Homo sapiens
acgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctatttgcctgtatcgtcaggtgggataatccttacctgttcctcctccggaggcagattagaacatgatgattggagatgcatgaaacgtgattaacgtctctgcgtaatcaggtcttgcaacaccctgattgctcctatctgattctttctgacgatcacttacatttgtgttatgctgattagcagatatccacaaacatagctatgaagttctgactgggataaccttgctgtttgtctattttgcagtcttgctattgct

SEQ ID NO: 12986 - DNA, 188 bp, Homo sapiens
tccattatgggaggctcattaaaagttggaagaaggccgggcgcggtggctcacgcctgtggtcccagctactcgggaggctgaggcgggagaatggcgtgaacccgggaagcggasttgtcagtgagccgagattgcgccactgcagtccgcagtccggcctgggcgacagagcgagactccgtcsc

SEQ ID NO: 12987 - DNA, 439 bp, Homo sapiens
agcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgagggttgggagagggggaggaaagagagagaggagagaggacgggcttggatgaagaagggaaagaaagagaaagagactgaagcagagaagagccgcagaggaagaaagtgaatgagcactcaagaaggacaaa

SEQ ID NO: 12988 - DNA, 103 bp, Homo sapiens
atcgccttcgccgccgcccgcccgcaaaccttcgtgcccggcccgtggcctgcgcggagtgttgtccaataaagttcttggatgtgaaaaaaaaaaaaaaaaa

SEQ ID NO: 12989 - DNA, 294 bp, Homo sapiens
cagatgatatgtccttgaagctggcaggggattcscagtccagggaatatccctacatgatttttgtcattcatgggtsctcsctgggcctgacaacgggagtggtgggtgggtgagaacagsttctgagagggggcttctaggaaggccccagccctagtcctaggcgactttgaataaagtggggaggtcaaacatgggssttcggsattkggtttctagggaatatggctcagtagggsstgssscttcaagggcagcaagaacgaagcaggatgttgtsactcscgtctg

SEQ ID NO: 12990 - DNA, 299 bp, Homo sapiens
aaccatccgggcgtggtggctcacgctgtaatcccagcactttgggaggctaaggtgggtggatcacgaggtcaggagttaaagaccagcctggccaagatagtgaaaccccgtctctactaaaaatacaaaaattagctgggcatggtggcaggtgcctgtaatcccagctactcaggagggtgaggaggagaattgcttgaacctgggaggcggaggttgcagtgagcccagattgcgccactgtactccagcctcggcgacagagcgagactctgtctcaaaaaaaaaaaaaaaaa

SEQ ID NO: 12991 - DNA, 440 bp, Homo sapiens
atagaacaaagtttctcatgctgtttctgtttaagtgaaaatttccctgagattgcaaagcaaaccgttaccactgtagccacttatttgtgtgcatcaagatttttttcagtattatgcaattaagttaaaatagagacataggtgttgaggtaaatgttaagactataccttgccgggcgcggtggctcacacctgtaatcccagcactttgtgaggctgaggcgggcagatcacgaggtcaggagatcgagactatcctggccaacacggtgaagccccctctctactaaaaatataaaaaattagccgtgcatggttgcgggcgcctgtggtcccggctgctcaggaggctgaggcaggagaatgatgtgaacccgggaggcggaccttgccgtgagccgagatcgcgtcactgcactccagcctgggtgacagag

SEQ ID NO: 12992 - DNA, 307 bp, Homo sapiens
tatatgtttggctgggtgtggtggttcacgcctgtaatcccagcactttgggaggccgaggcaggcggatcacaaggtcaggagatcgagaccatcctggctaacacggtgaaacccatctctactaaaaatacaaaaaattagccgggcatggtggtgggcgcctgtagtcccagctactcgggaggctgaggcagaagaatggtgtgaacctgggaggcggasttgcagtgagccgagatcgagccagtgcactccagcctgggagacagagcgagactctgtctcaaaaaaaaaaaaaaaaagg

SEQ ID NO: 12993 - DNA, 348 bp, Homo sapiens
actcttaacaacagacaagatttggaaacaacctaactgtccatcaacagatgaatggataaaggaaatgtggtacatatacactgtggagtactattctgccataaaaagaatgagatcctgtcatttgcaacaacatggatggaaccggagtcattatgttaggtgaaataagccagacacagaaagacaaacatcacatgttctcacttatttgtgggaactaaaaatcaaaacaattgaatacagggaaatagagagtagaaggatgggtaccagaggctgggaagggtagtgggaggtgggtggaggtggggacagttaatggttacaaaaaaaaaaaaaaaa

SEQ ID NO: 12994 - DNA, 324 bp, Homo sapiens; identical to SEQ ID NO: 12946

SEQ ID NO: 12995 - DNA, 441 bp, Homo sapiens
atcacattctgtgttattgccatgttaactccacatgcagcttgagcattcagtcttctgacctgttccacctctacagggcattttatggcttaaggatgacggcctagaagggaagggagagacttactttggattaaatttacaatgggaaagtgcttaagctgctgcaaagaggaccagagcttyccaacgatgttctccagaagatcaagttagtacagacgcccagcatcgtggagcctcttctatttcacaaccaagtatatctcttggtcataaaacatcttattcccctgtaacacataaagtcaatgcagccaaagcaagtagaaggttattatctgtatcaagtccatctttctctgaaagaagatattctttatttgttggatttcaaaaaagaaatgcttccccttactggcaacaaagtagagctaa

SEQ ID NO: 12996 - DNA, 354 bp, Homo sapiens
tgtatgttacctatttcaagatttaagagtcattgctgggcacggtggctcacacctctaatcctagcactttgggaggcgaaggtgggtggatcacctgaggttgggagtttgagaccagcctgaccaacacggagaaactccgtgtctactaaaaatacaaaatgagccaggcgtggtggcgcatgctatgatcccagctactcgggaggctgaggcaggagaactgcttgaacccgggaggtggaggttgcggtgagtggagatcacaccattgcactccagcctgggcaacaagagtgaaactccatctcaaaaaaaaagaaaaacaaaaacaaaaaaraaaaaaaaaag

SEQ ID NO: 12997 - DNA, 155 bp, Homo sapiens
attagctaggsatggtggcgtggcacgtgcctgtagtcccagctactcgggaagctgaggcaagagaatcacttgaaccagggaggcggaggttgcagtgagccgaggtcgcaccgttgtactccagcctggtgatagaacgagactccacacaa

SEQ ID NO: 12998 - DNA, 156 bp, Homo sapiens
aaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctkgtgtc

SEQ ID NO: 12999 - DNA, 419 bp, Homo sapiens
  misc_feature 137,285: n=a, g, c or t
attcctggtagccgactcgtcgtctgascagggccgtgccgcaatcttcctaaggcactggtttccggccctggggagactggaattgagacgacagggcctccgctgaccagtccttggacacaacgcggasgggnctgaggggccgccctgccaggcctgcgctgccgtgcttttagtgttccctgaagaatactaggaagaaatggaaatcagtgttctgaagaacggcacggactcttaggcagttccatcagcaagaacctgagtttgaagtgacaackngctgttgagaggcaaggttacagaattacagtacatcgtttgacttctgtgacaccggcattattttctggcgtgtgtgtgtgtgtgtgtggctaaggtcgtaggtaatgctaattttttaaattttyccaact

SEQ ID NO: 13000 - DNA, 359 bp, Homo sapiens
atgaggatggtcaggtgggcgatgcaacattaatactcaggaccccaagatacagaaggaaatcatgcgtgtgatcggaactcaggtttacacaaactgagggggccccagcctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatgcaaaa

SEQ ID NO: 13001 - DNA, 325 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctcaaaaaaaaaaaaaaaaag

SEQ ID NO: 13002 - DNA, 293 bp, Homo sapiens
gactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaa

SEQ ID NO: 13003 - DNA, 119 bp, Homo sapiens
aaacagcctgaatgtatcctttgtggtcctggcaggaaatagatggcacatctcaaggatttgactgaaaatagttgaagagtaaagctaagggggccaaaaagaaaaaaaaaaaaaaa

SEQ ID NO: 13004 - DNA, 471 bp, Homo sapiens
tacaattcatgggacttttgcagaccttcagaaatgcagataagcattgctctgctcactttgaatatcggatacatcctccttgcactttgaaaagcaaatagaatacatacatttatcaatgctgacattgatacctttctacatagctcagcaaagaatcatccaaataatacaaaattgaaaaactggaaggctaaacaaaataagccgtcttatattttacagttgaaatacttagatgtaagtgaattaagtaattctacccctatataaagtgatattttttcctcctcttaattctttctttcaggaagaagcacagataaacagaaggctaacacaatatgatttatttatttatttatttattttatttcatttttttaagaaaaggtctcactctgccacccagactggagtacagtggtgcaatcatggctcactgcaacctcaacctccagggctgaa

SEQ ID NO: 13005 - DNA, 291 bp, Homo sapiens
tatcgtcgggcacggtgactcacgcctgtggtcccggcatcttgggaggctgaggcgggtggatcatgaggtcggatcgggaccatcctggccagcatggtgaaacctgtctctgataaaggtgcaagggttatccgggtgtggtggtgtgtgcctgtggtcccggctgctcggggggctgaggcgggagagtcgcttgggcccggaaatcggaggttgcagtgagtgagctgggatcgcgccactgcactccagcctggcgacggagtgagactctgtctcaataaaaaa

SEQ ID NO: 13006 - DNA, 99 bp, Homo sapiens
gtttgatatttattttaaattgtggactagatgcataaattcacatttctgcctttcctttgcatcttctcatatattgtgtttttttttttttttccc

SEQ ID NO: 13007 - DNA, 94 bp, Homo sapiens
aaatcccagcactttgggaggccgaggtgggtggatcatgaggtcaggagatcaagaccatcctggctaacacgatgaaaccccgtctctacta

SEQ ID NO: 13008 - DNA, 346 bp, Homo sapiens
gagtaatttcagcggactctgggctggaggagtssgaattagctagtcctgtgagggcagtctctcaaggatcaaggccccagatgccagagcatcaagaatatggaaaatcagagaacatgatcaatataccagctcatccctggatgaagctccctgcctttcctcatacagacaaaaaagtgcaatcctcaattttccggcctaccttgtagctgggagctataaaatgaagttcatcaggcatkagcgggtctgctggtactgcttcttcccgcttccccttcttcttgctttagggatgggatgcgatgttttgctgctctaacagccattttgcagccat

SEQ ID NO: 13009 - DNA, 329 bp, Homo sapiens
tctactgaaattatcagacagaaaactggacgggcgtgatggcttaggtctgtaatcccagcacttttggaggctgatgtaggtggatcacttgaggtcaggagttcaagaccagcctcgccaacatggtgaatccccatctctgttgaaaatacaagaaaaattagccagccttggtggtgggcacctgtatcccaactactcaggaggctgaggcacgagaattgcttggactcaggagtcggaggttgcagtgagccatccctgcactccagcctggacgacagagcaaaactgtctcacaaaaaaagaagaaaacttagtggctg

SEQ ID NO: 13010 - DNA, 498 bp, Homo sapiens
aatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaaggggcaagtgatgtgtaactgctcaagagatgcttaaacctccatagagaggagc

SEQ ID NO: 13011 - DNA, 91 bp, Homo sapiens
tattttttatagagacaaagtctcgctgtgttgcccaggttggtcttgaactcttaggctgaaacgatcctgctgtctcagcctcccaaaa

SEQ ID NO: 13012 - DNA, 364 bp, Homo sapiens
aaaatataaattacttctacaaagtttagtgaaactgatttatggtgggtaagaaaagcaaaaatgggccgggcacagcggttcatgcctgtaatcccagcactttgggaggccaaggtgggcggatcacgaggtcagcaattcaagaccagcctggccaacatggtgaaaccccatctctactaaaaatacaaaaattagccaggcatgatggcgggcccctgtaatcccagctactccggaggctgaggcaggagaatcgcttgaacctggaaggcggaggttgcagtgagccgagaccgcaccattgcactccagcctgggcgacagagcgagactccgtctcaaaaaaaaaaaaaaaaag

SEQ ID NO: 13013 - DNA, 284 bp, Homo sapiens
aaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgcaaaaaaaaaaaaaa

SEQ ID NO: 13014 - DNA, 309 bp, Homo sapiens
ttctggatgagtgtagtggctcacgcttgtaattccagcagtttgggaggccaaggtgggagaattgbttgagcctaggagtttgagatcagcctgggcaacataactagatgctgtgtctacaaataataaaaaaattagctgagtgtcgtggcctgtgtatctggtcccacctactcgggaggctgggatgggaggattgcttgagcctaggaggtcaaggcagtagtgtgttgtgataatactaccgtactccagcctgggcaacagagtgagaccccatccctccacaaaaaaaaaaaaaaaaag

SEQ ID NO: 13015 - DNA, 443 bp, Homo sapiens
tttagtttaactaagtgaaggtctcactgctcacaagtagcagagccagaatttagaatacaggcagtatagctctctagtgtccatgttttttttcttttgagagggagtctcgctctgtcacccaggctggagtgcagcgcttgatctcagctccctgcaagctccgcctcctgagttcatgccattctcctgcctcagcctcccgcgtmstgggactacgggcgcccgccacaacgcctggctaattttttgtgtttttagtagagacgggatttcaccctgttagccaggatggtctcgatctcctgacctcgggtggatcacctgaggtcagagttcaagaccagcttggacaacatggtgaaacctgtctctactaaaaatacaaaaattagttgggtgtggcggcacatgctatagtccagctactcggggggctg

SEQ ID NO: 13016 - DNA, 508 bp, Homo sapiens
  misc_feature 436: n=a, g, c or t
cagtctagctagttttgtcagttttattgatgttatcaaagaatcaactttggttttcttgatttttctccactgtttttcgattctctatttcatttgtcttcactctaatcttgattatatccttccttctgtgagctttgggtttagtttgctcttcaagctctctggtctttactttttccttttctcattccttaaggtgtaatgttaggttactgatttaagatttttttaatatatgcatttgcaactataattttccctctcagcattgtttttgctgcatcccttaggttttagcgcggtgtaaggtgtgtgtgtgtgtgtgcacgcgcgtgtgtgtgtgcgtgtgtgtgtgtgtgtgtttctgcctttctcatgttacctcctaatttacctcatgatttctcttttgacccattggttttgtgtntgtttgtgtgagacagagtcttgctctgtcacccatgctggagtgcggtggcmaaatttcggctcactgcaa

SEQ ID NO: 13017 - DNA, 420 bp, Homo sapiens
ttttggggggataaatacctagatagatagggactgctaggtcatgtggtcagtgcacgctcaascttttasaaaactgcccagttgctttccacatggctgcaccattttgsattcccatcaacaatggataagaactccggctgggtgcagtggctcacgcctataatcccagcactttgggaggccgaggcagttggatcaactgaggtcaggagtttgagacaaggcggactaacatggtgaaacctgtctctactaaaaatacaaaaattagctgggcatggtagcatgggcctgtagtcccacctgsttgggatgctgaggcaggaggcaggagaatcacttgaacccaggaggcaaaggttgcagtgagccaagatcacaccactgcactccagcctgggagacagagcaaga

SEQ ID NO: 13018 - DNA, 487 bp, Homo sapiens
gaaaaaaatataactttcatttctgtttatatattttctagttattataaaagtacttaggtacatgaatattggtaaagttcttaaaaattgtatagaagatactcgggagcatagaagactactttaagagagcttagctttacaaatacacctaacattctcattttccttgagggatattatgcttcctgtttaaaaaacaaagttcccagccagcctcagtggctcatgctgtaatcccagcactttgagaggccaaggcggtaggatcacttgaggccaggagtttgaggccagcctgggcaacatagaccctgcctttacaaaaaaaatttttttaaaaaacatgccaccacacgcccatggccacacttattcaggaggctaaggtggcaggatcgtttgagcccaggaggtcaaggccagtgagccaagattgtgccactacaccacagctaggtgacagaggaagacctatctttaa

SEQ ID NO: 13019 - DNA, 347 bp, Homo sapiens
ctgaaagtgcagaagttggccgggcgtggtggcgggcgctgtagtcccggctactcgggaggctgaggcaggagaattgcttgaatctgtgaggtggaggttgcggtgagtggagatcgcgccactgcactccagcctgggcaacagaatgagactccgtctcaaaaataaaaaataaaaaaaaaaaagaaagatttttgttacacggttgggctcggtggctcamacctgtagtcctagcastttgggaggccgaggcgggcggatcacgaggtcaagaggttgagaccatcctggccaacgtggtgaagccctgtgtctgctgaawtttcaaaaattagctgggc

SEQ ID NO: 13020 - DNA, 435 bp, Homo sapiens
cctggcataactgataggcatgtatgggaggaccacattcctggggacagcctgggtatgtgacatggcaggtgaccaggttcccatgaatgcccgaggctgtgccatcccatgagctggggcttccctggaggtaaagagctagggtggggtggcagtgggtagaaccccagctggacagctccttccttagctctgtgattgctacagctggttctggaagccacaggcgccctcaggacaaatggggcttcttcagcacagggtagtgagtgctgagctaagcaaggacactgtcccttctctgcccaggctcgagctgtgcacctttaccctggcaattgcctgggtgctgtcctgctcctgcccttctccatcatcagcaatgaggtgctgctctccctgcctcggaactactacatccagtggstcaac

SEQ ID NO: 13021 - DNA, 250 bp, Homo sapiens
ccatttgtaaggtagatgacactttgctcctaagtagacctgcaaacaaagacaatggggtctttcctgattcctttagtttggagatgcagagaaccccacgtttctctaagtgaaatggcaagaagttatttgttagaatatggaactggtaacaaattcatgtttgcaccttgaatttgctttcacagacctggctgtattgttggacaggaataaagtaaattggagacaaaaaaaaaaaaaaaaa

SEQ ID NO: 13022 - DNA, 311 bp, Homo sapiens
tttttctagggttgttacgaagctgcaggaggaaaatgaaatggaggaggaggaggaggaaaaagaaatggaggaggaaaaagaaacaggaggaggaaaaagaaacggaggaggaagaggaggaggaggacaaagaaacagccaggccggacgtggtggctcacccctgtagtcccagctgctcgggaggctgaggcagaagaatcgcttcaacccgggaggcagagtttgcgtgagccgagatcgtgccactgcattccagcctggagacagagtgagactccatctcatctcaaaaaaaaaaaaaaaaa

SEQ ID NO: 13023 - DNA, 528 bp, Homo sapiens
cttcactccagccccccgcgtccgagagacttagcagggcgtcaaactggagagcggaaggatggaaccttttattctcaggtggagaggattaagctttgcgtgttagcagaaaatgatcgagctccagaaaatgatttggagtctgcaggtgtacccagcagctccgaagagacagcgaccatcgagaacaagccatgatgatgatggtggtttgtcgaaaaggaaatggggaaatgtggggaaaagagagatcagactgttactgtgtctgtgtagaaagaagtagacataagagactccattttgttctgtactaagaaaaattattctgccttgagatgctgttaatctgtaaccctacccccaaccctgtgctccctgaaacacgtgctgtgtcaactcagggttaaatggattaagggctgtgcaggatgtgctttgttaaacaaatgcttgaaggcagcatgcttgttaagagtcatcatcactccctaatctcaagtaccagagacaatacgctgcgga

SEQ ID NO: 13024 - DNA, 304 bp, Homo sapiens
taaaaatacaaaaattagccaggcatggtggcgtgtgccagtaatcccagctacttgggaggctgaggcgcgagaatcgcttgaaccctggagatggaggttgcagtgagcagagatcgcaccactgcactccagcctgggcaagagtgagactgtgtctcaaaaggaaaaaaaaaaaattaaaaatgttgctggtattacatcaaacctactctggataaattttccagtagggcatctgaaattgctttggcaaaagcaaaacaggttatcaatacaccaaggacatcaagtagttttaatg

SEQ ID NO: 13025 - DNA, 435 bp, Homo sapiens
catcttctccattctcctttgttttattcacacttagcagcttctagccaacctgtgtaggaaccgttcgttatctatttactgtgatataaggagcttgtgccagaatgtaaaccagtgccccctgcttcctgcattaagatagccttgcaagacaaaaagtgcgagctgagtcgaacggcacgcttggtgcatagttgatctacattgtggtgctgcgtccttattttgtcaccaactggtcacaaagtgtggattgtcagtgtctcataggccacatgtcaagtggcatggtctaaacacactctaaaatttacttattttgggctgggtgcggtggcttgtgcctgtaatcccagccctttggagtccaaggtgggtagatcacttgaggccaggagctcgagaccagcctggccaacctggtgaaacctg

SEQ ID NO: 13026 - DNA, 268 bp, Homo sapiens
cattttagaaggatctatttggaaggatccatttggaaggattgcttgagcccaggagttcgagactagcctgggcgatgtgatgagacactgtatttacaaaaatacaaaaaaattaaccaggtgtggtgacatgtgcctgtagtcccagctattcgagagcctgaggtaggaggatcacttaagcctagggaggccaaggctgcagtgagccgagattgcaccattgctctgcagccagcctgggtgacagagtgagaccgtgtaa

SEQ ID NO: 13027 - DNA, 484 bp, Homo sapiens
aatactgggctgagtttgtggcgcgcttagtgatgggatggccctgtgcaggacgccgacacgaaaagatgaagagttcaatccgtgctgtctgaactcacagtgtagcaggcgagatagacgggaagatcggtagggtgggagatgccggaaaggcttcccgtgagactggataagaaatcaaaaatctggtgaaattgccggcaagagggagttaaggacattccaggcagaggcaagttggtccttgctggctgatccagcttccccgtcagcatatggtgagcagttcggtgagaggaccacacttccaatactggcagatgaagccagatactcctctatgaagttaaatgactggttcagtgttaacactgctagtgagcgacagagatggaatttgaacgcacacctgtctgactccacctcgtgttccttccacatggccagcaagctctgctgtcccacctcgcacttcttggga

SEQ ID NO: 13028 - DNA, 498 bp, Homo sapiens
aaatacaaccctcccatcacagtcagacgggcacaaaacttcaaccagccgtttctctgcctggaagcggcgaacatgtaacctggacgggaggctggatggggacacataccatgagtgacatcttaccagagggtggccatgaacttcatcatgttccacaactgttaatgaccactggcgctggccctgctgctctctgaactcctctctatggaactgtgccccttctctgggaagagtccttgaagctctactgagaatgaaacctcttctttcagctcatgtcaatcttgaatcttgctctgttgcccaggctggagtgcagtggtgtgatctcggctcactacaacctccatctccaggattcaagcgattctcctgcctctcagcctcctgagtagctgggattacaggtgtgtgccaccatgcccggctaatttttttgtacttttagtagagacggggtttcacatgttggtcagcctggtttcaact

SEQ ID NO: 13029 - DNA, 386 bp, Homo sapiens
  misc_feature 311: n=a, g, c or t
caacactatttcattaagttcttgataatatgtagtcttctgtgtgcaaggaaagaaataaataacacatttatttgctgaatgagttttaaggtgtgcaagttgtagtgatgtttttcccacacaggattctatacacttataccatcttaaatctggcattttttttttcagatagcttctactgacaaacacaaagcttgtttgtgtgcaaatataaggctaawtaaatggtgcyaaagtgtattatgactgtcagataaaatcaggcaaaattttgtggtgctyaaatgaatttttbcattgatttnattgawcagtgcattgaacagtgtttattatycacaagttgtctttwattagtaaatcaaggcctcatagcacat

SEQ ID NO: 13030 - DNA, 445 bp, Homo sapiens
ctttttttctcctgctctaggcccagcgccttggacgtgcacagtagatccctcccggcttcccggcttcccgtctcgtcaccctctgctcagaacctgaggacgcagccatggagctggtcttgaactcttgaccttgagtgatcccctcacctcagcctcccaaagcctcagcctcttacagtgttgggattacaggcatgagacactgtggcccgggatgattttcagtcacagttttttgttacgagtggaaaatgcgtatttataaaaatgaaatagtacagacatgaacgtgtagaagtctctataatcctgccatccaaggatggcacctgttaacgtgtatatcagggatgtccaatcttttggcctccctgcaccacactggaagaagaagaatcgccttgggccacacataaaatacactaatgctagcaatagc

SEQ ID NO: 13031 - DNA, 433 bp, Homo sapiens
gagttccctgttgcccttggtctcggggtcgctgtcggcgctgaggctgcagagatgtgaccgagtgaccgcccgctaaccggactggagagaagaccggcccggatcccacgcctggcctgaagcagggaagacgctgcctcccctccgcgagcagcttacattcgtccaagttccagccttctgtcttctcgctaacctcgctcttttccaaatcgcaaatcctcttgagccgacaccgttgcgcctaaatgatgcgcttacccttttactttgcttttttatttttgagacagagattcactcttgtcacccaggctggagtgcaatggtgcaatctcggctcactccaacctccgcctcccgggttcaagcgattctcccgtcccggctactcgggaggctgaggcaggagaatggcgtgaacccggga

SEQ ID NO: 13032 - DNA, 64 bp, Homo sapiens
gagtaatmcmggaaggacagggagagaggggtggmmgtgggtggggtggggtggggtggaaggg

SEQ ID NO: 13033 - DNA, 336 bp, Homo sapiens
tttatatttttaaaatgttctttgaattatgtttttattgtacatttcttcagactgaaaagtatgtacatatctttgttatttttgcacaattttgtcttgttcggtttcagaggtctgttgttttttataatttattttgagttgtaaaacttgcaggagtaaaaacaaaaaacaaaatctccacaacaaaataaccctctgatttataaactcttatagtcaaagagggaaaacaaaggttgagagattaagtggctgcttctgagaaataatgtctcaaggactaaaggagcaattcaataggtttagacattgtagctctctacatcttga

SEQ ID NO: 13034 - DNA, 524 bp, Homo sapiens
aaccttaaatagatgtaatttctatttgtcaatgatgcctcagcaaagctagggagaaaataaaaaggatccttctgtgcaacagcccgcatgtccattaccgatgactggataaagaaaacgtgctccacccatgcagtggaatactacgcagccataaaacggaatgaagctcggatccaagctagaacgtaggtgagccttggaaacgtggcgctgagtgagagaagctggacacaaaataaggccaggaatggtggctcacagccgtaatcccagcactttacgaggccaagatgggcagatcacttgagtccaggagtttgaggccagcctgggcaacatgacgaaatcctgcctctacaaaaaatacaaaagttagccaggagttcatttagaggagtcatgtgactatagtcccagctactcaggaggctgagatgggagaatcacttgagcctgggaggtggaggttacagtgagccgagattgggccacggcactccagcctgggcaacagagtg

SEQ ID NO: 13035 - DNA, 330 bp, Homo sapiens
gatcaataaagaactgtaagtgtgttatgatctagaaaagtgtttctttttttttttagatggagcstgggcaasaagrgsgaaactcsgtgtcaaaaaaaagaagagagagaaaavcagacactggggactactagaagcaggagagaggaaggaggacaggggctgaaacactacctattgggtactatgctcagtacccaataggcagtggaattaataagagtagaagttaaagatcctgggtgatggggtctttcatacctcaarcctcagtgtcatgtaataaactcatgtaaacaaacctgcacacataccccttaaatctaa

SEQ ID NO: 13036 - DNA, 315 bp, Homo sapiens
  misc_feature 31: n=a, g, c or t
acactcgcacaaacacacactcgtacactcnygctcttctctctytccggcttgctctsccacgcaagcggaatgcagcagcgcctggagagcgtgtctcggaccgccgcctgaatgtacctcgctcccgggagccggacgsccataggcgcactggaggacgctccgctgcgggacctggacagttttttgasggtgcagtcttgctatatggtgtgagaaatggctgtaggraacaacactcaacgaattattccatcatcccgtgttttatatttgttgagcttgtcatcatggctggggacattgctgctt

SEQ ID NO: 13037 - DNA, 483 bp, Homo sapiens
agtttggaggtttctcaaagaacacagaactatcattcaatccagcaatcttgttactaggtgtatatcyaaaggaaaagaaattgttataacaaaaagacacatgcactcatatattcattgcagtactatttgctatagcaaagagatgaagtcaacctaggtgcgcatcagtggtggatttggtaaagaaaatggtacatatacaccatggaataatgtacagccataaaagagaacaaaacaggccgggcacagtggctcacatctgtaatttcagcactttgggaggctgaggcaggtggatcacctgaggtcaggagttcaagacaagcctggccaacatggcaaaagccccgtctctactaagaatacaaaaaacattagctgggcatggtggtgmgcacctgtactcccaactactcgggaggcaggcatgagaatcacttgaacccaggaggcagaggttgcagtgagcgaaat

SEQ ID NO: 13038 - DNA, 462 bp, Homo sapiens
acaatgcagttcgcggcgscggacatggcggtggagtcctgagctagtcgtgtcccggcctccagcggcggcasggcgacggcggcggcagcagggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaccaaagaagaatgttatttgtgaagaaagcaaagcagttcaagttataggtaatcaaacattgaaaactagaaatgataaatccgtaaaagaaaattggagaacagctctccaaataggaatagtagtaaaaaaaaataagcaaaatgatatttgtatagaaaa

SEQ ID NO: 13039 - DNA, 456 bp, Homo sapiens
aaggatacatcttgtaattataactgggggtatttcttttttcttcgtgatttcattaaaaagatggggggtcttaaaattgatggcttcttaaattgtacaaaataagagtgttagctaccattagctgtcaggctgatgtttttcaagaaaagatacaaatttgaagctgagctctgtgttgcatgcgtgtagtcccagctacttgttagactgaggtgggaaaattgcttgagctcaggagttcaaggatatagtgagctatgaatagtgccactgcactccagcctgtacagcagagcaagaagatcctggctctaaaaaaagaacagtgaagaaaacatagaaatctggatttttaaatgctggcttaaaatttattttaaatgctgtatgagtcaaatagatttttcaaataatatagtaaatataatacattattattattattattat

SEQ ID NO: 13040 - DNA, 468 bp, Homo sapiens
  misc_feature 444: n=a, g, c or t
cattcaaaatgtgttttgtgttatgatcttaccatttctttcaaatgttcctagcagcctgcattatttataatgttctgtattcctggtttaggtaagtccagaggtgagagctggtattaggraaatgacatagtaaggcatttgttttcagtaatggcagcatccgtttgacctcctttcccatttggaagggctttctccatcctaaagctcctgtagacttggtgctcttttttttttwaggattcatacsagttgaagastttcaaagcsttsagtgtaactggttatgttcttactagaaaagtatttagggccaggcgcagtggctcgtgcctgcaatcccagcaccttgggaggccgaggcaagtggatcacttgaggtcaggagttcgagatcagcctggctaacatggtgaaacactgtctctacgaaaagtncaaaaattagccagtcggggtggt

SEQ ID NO: 13041 - DNA, 442 bp, Homo sapiens
cacactttgttctaccatattaatcaaatgtgaatatgtaatttgtgttttgagttaacccttaaataaaaaggaatgtgccccccgtccaacactgacatcatctgagtgttacattcgtgtcagattatcagtggcagtgtaatgtgttaaaacacagacttgagctccaggaatgcctagatttcaattcctggccctgtctcttaataattatgtgatcttgtgcaagtcctgagcctcagtttccttaacttgaaaattgggataatagtatctatcttggagttggtatgaaaattaaacacaatttggctgggcacggtggcccacgcctgtaatcacagcactttgggaggccaaggcgggtggatcatctgaggtcaagagttcgagaccagcctggccaacatggtgaaacctgcctctattaagatacaaa

SEQ ID NO: 13042 - DNA, 486 bp, Homo sapiens
tccgatatatgggagagtgtcttgtcttctatctgattctgctttcaacttgactccttctgattgatcctgcacaggggtcatgcataattaaaaggtcactttagcttcagaatgcagttagtccagggaggtacctgtaggcttgagctttctttgaatctgataagagaactctttggcctcatgctcgtagtaggatctgcagaggcctgtgaagtgtccaatgatgagtcattccatggttatacagtcaagccctgactgttgttctttatcatgatttttatgcctgagaataccttctaaaaatatcacatgataataggtaacatatacgcctgtagtcccgacactttgagaggccaaggagggtggatcgcttgagcccaggggtttgagaccagcctgggcaatatggtgaaaccccatttttacaaaaaatacaaaaattggctgggcatggtggcacacacttgcaatccc

SEQ ID NO: 13043 - DNA, 127 bp, Homo sapiens
ttatttgagcgtggtggtggatgcatgtaatcccagctactcgggaggctgaggcaggagaatcgcttgaacttgggaggcagagattacagtggagccaagattgtgccactgcactgcattccag

SEQ ID NO: 13044 - DNA, 306 bp, Homo sapiens
tttcagtttagtaagttctaactataaattcatcttgcaatacttaacacattcaaaagagaaaaaatgataagccagtagtaattaattttatcacaaccaaatcctcaaaatgatgacagggcaaataaaacagtggctaatgatagaccacctttcaaatacaggaaatataaaccccaagaaaagaaaaagttcaatttctccactttaaacaactaacttcagatatacttgaactggtaccttttaaakacagagggattagtttcattacttactgctactttcatctccatacttgta

SEQ ID NO: 13045 - DNA, 413 bp, Homo sapiens
  misc_feature 382: n=a, g, c or t
attgtattttttagtggagatggggtttcaccgtgttggccgggatgatcttgatctcctgacctcgtggtccgcccgcctcagcctcccaaagtactgggattacaggcgtgagcaccgtgcccaaccatttgtcattttttattgtgggtacactagtgggtgttaagtcatatctgcttgtggttttgattttgcattttcttgatggcttgtgatgttaggcttttcttcaagcacttattggatgctcttatatcttcttcacaaaaatgtctatttaaatattttgcctatttttatgtattttttctttttgttgttgagttgtaaaagttatttgtgcattttggatacagatttctaatcaaatatataagtngcaaacattttcaaaaaaaaaaaaaaaaagg

SEQ ID NO: 13046 - DNA, 309 bp, Homo sapiens
atgggacatagtcttaaaaatgtctgaaacaggctgggcatggtggctcacacctgtattcccagcagtttgggaggctgaggtgggtggatcacgaggtcaggagaccgagaccatcctgaccaacacggtgaaacctcgtctctactaaaaatgcaaaaattggctgggcatggtggtgtgcacctgtagtctcagctacttgggaggctgaggcaggagagtcatttgaacccgggaggcggaggttgcagtgagccgagataggccactgcactccagcctggcagcagagtggagactccatct

SEQ ID NO: 13047 - DNA, 109 bp, Homo sapiens
agttaagtcacttgcaatcatttggatccgtctgcgctttgcttttcagctttgtgagggtgggtccggagaagcctttggtttcgggataactttctcccctcgtaac

SEQ ID NO: 13048 - DNA, 152 bp, Homo sapiens
caaaaatgtaacaggtacacaaagaggaagtggggaaaaaggcaaaatgagagtctgattcccaggcatgtgcagcgcccattgggacataacggcagtgcggcgcgasagaggaatgggctggaaccggatctgtttccagacgcagaagc

SEQ ID NO: 13049 - DNA, 396 bp, Homo sapiens
  misc_feature 254: n=a, g, c or t
aaaatggcgatgctaccacctagaactggattgtgcgctccatttctttcacctcaaagctggccgccaccgctgccacctgctcagagtgaaataatgaaggtggtcaacctgaagcaagccattttgcaagcctggaagagcgctggagtgactaccaatgggcaatcaacatgaagaaattctttcctaaaggdgccacctgggatattctcaacctggcagakgcgttactagagcwggccatgattggncatcccccaatcctctcatcttgtmctacctgaagtatgccattagttcccaggtaagcttcccgcaaacccccaccaagaagtgagagttctgggggtaaaaaacttggagtgcatttgggcmccggtggttcatggctgt

SEQ ID NO: 13050 - DNA, 438 bp, Homo sapiens
tttatatcggtcccggaagacatagatgctcccgttacagctggcaatcttccagagggatggggcagagctccaggcctcaggaaggcaaagcggtgaagctgtctagcgagggattgtagcacacagggagtccccttcagccacgatgaacaccagatctttatgcacagctgcgtgcatgcggcctgcaaaggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggcaaaaaaaaaaaaaaaa

SEQ ID NO: 13051 - DNA, 179 bp, Homo sapiens
aaaaatacaaaaaattagccgggcatggtggcgggtgcctgtagtcccagctacttgggaggstgaggcaggagaatggcgtgaacctaggaggcggasttgcagtgagctgagattgcgccactgcactctagcctaggtgacacagcgagactccgtcaaaacaaaaaaaaaaaaaa

SEQ ID NO: 13052 - DNA, 425 bp, Homo sapiens
ttgaaggagttaaggtctgtggaatcaaagcatgagacaacatgcaaggaccaggttggtttccatttaacagccaacctaatctaactgaaaggattgagaggtttgtcttttttggaaagtgttaaggttcttccaagtaaccagcaatgtgactttaccacactgttcattaacggggctttggatggccaccatgtctgctgctggctgagtccaaaactgcggtcactctctccagcaagctcatggagggttacgtcatcttcactcagccagcccaacgctttttccatctgctaaaatgtagaacatggttgttgattctactctttctacaaagaaagagagggaacatggatgagttgctgcttttaaagattatatgttaattgctgttttaaaaatctgctcagctaagcacg

SEQ ID NO: 13053 - DNA, 204 bp, Homo sapiens
  misc_feature 52: n=a, g, c or t
tgtttaatgccatttattttttaagatgggatatatattttaattagctggnmgtcgtggcgggtgcctgtggtcccagctactcaggaggctgaggcaggggaatgccgtgaacccggaggcagagcttgcagtgaaccgagatcacaccactgcactccagcctgggcgaccgagtgagactccatcgcaaaaaaaaaaaaa

SEQ ID NO: 13054 - DNA, 381 bp, Homo sapiens
tatacgtgtagatagaaatacagatacagcatacaaacatactatatgtatttagaaaacacatatgtttacatatgtaattaagaaaaaataggccgggtgcggtggctcatgcctgtaatcccagcactttgggaggccaaggtgggcggatcacctgagatcgggagttcaaaacccgcctggcccaacatggtgaaaccctgtctctactaaaaaatacagtaattagctgggcgtggtggtgcatgtctgtaatcccagctactccggaggctgaggcaggagaatcacttgaacctgggaggtggaggttgcagtaagccaagattgcgccattgtcactccagcctgggcaacaagagcgaaactccatcccat

SEQ ID NO: 13055 - DNA, 178 bp, Homo sapiens
tacctaaagtcatcattagaaagtcagagcaacggctgggcgtggtggcgcaggcctgtaatcccaacactttgggaggccaaggcgggcggatcacctgaggtcaggagttcaagaccagcccggccaacatggtgaaaccccgtctctactaaaaatacaaaaaaaaaaaaawtta

SEQ ID NO: 13056 - DNA, 542 bp, Homo sapiens
atctctttaagataggatactgttacagttctgacttaaaatgtgaggcttggctccagactccatgatgatccttataaaataaagtggagaggctttgtggatttataaatgcatcttttccataaagtatagcatttcacgtgcataacttaaaatagtctgaaatgatattagtatcattgctaagggatttaagaatcgaaaatattttaaagtaaattaggtagcctaccaaataggattttcttgtcctcattttgattattaaatctcaaagaaactcaaagcaaaaaaataagttacttttttatatttgaagatggggattttcctctgtttgtgtggagtcttttttaggatctgccaaatgttgatgctctcttctctggactatttctttttataaccatgggaaggctattttagaccaccgagagacagagcctgtctaaagattttagttgccctttcttcatatcaaatgaaatgtccatcaatattcttatctcaacccactctgcttcagcgttctacctgaa

SEQ ID NO: 13057 - DNA, 448 bp, Homo sapiens
  misc_feature 432,443: n=a, g, c or t
aagggtggctttagaggctcagtccccgcgacgccgcgctggttggtgctcctgcgccggagagttctgcgtctcggggtggtgactgggtccagaatggcttcggattcggggaacaggggaccctctgcacgttggagttcgcggtgcagatgacctgtcagagctgtgtggacgcggtgcgcaaatccctgcaaggtggcaggtgtccaggatgtggaggtgcacttggaggaccagatggtcttggtacacaccactctacccagccaggaggtgcaggctctcctggaagcacggggcggcaggcggtactcaagggcatgggcagcggccagttgcgtgagtgaccactgtggccttggccctctcggagggaggtggctcagagctggtacaaatctaatcataggattctcaggctctgggttngagtggctttnaggaa

SEQ ID NO: 13058 - DNA, 219 bp, Homo sapiens; identical to SEQ ID NO: 12704

SEQ ID NO: 13059 - DNA, 192 bp, Homo sapiens
ccagatttagctttcaaggtgcgtgcatgttgaatgatccagaagcaacgaaaactctggggtgagggattgaaaaaatctgaaatcacagttggatttttaaattcaaccatcaaaaatatgtactatcagtttttttttacattgatgtgaaataagcaaattttcatgataattaatgckgcaaaattt

SEQ ID NO: 13060 - DNA, 294 bp, Homo sapiens; identical to SEQ ID NO: 11407

SEQ ID NO: 13061 - DNA, 430 bp, Homo sapiens
aaatgaaggagaaatacataggtaaaaaattaaaactgggaaaaaaaagtttggcagaaaagatctaatatagatatataataggatcttcccaccccgcccccagaaagaaaaccaaaataaaggaatagcttaaatactgacaagtggccgggtacgtggctcacacctgtaatcccagcagtttgggaggccgaggggggcagatcacgaggtcaggagatcgagaccatcctgactaacatgttgaaaccctgtctctactaaaaatacaaaaaattagccaggcatggtggcgggcgcctgtagtcctagctactcgggaggctgtgaggcaggagaatggcgtgaacccgggaggtggagcttgcagtgagctgagatcgcgccactgcactccagcctggggacagagtgagactccgtccca

SEQ ID NO: 13062 - DNA, 341 bp, Homo sapiens
gtttgaatcttggaattaaaaagagggcaggggctgggcgcggtggctcactcctgtaatcccagcactttgggaggccgaggcgggcggatcacaaggtcgggagttcaagaccagcctggccagtgtggcgaaaacccgtatctactgaaaatacaaaaaacaaaattagccaggcgtggtggcacgcgcctgtagtcccagctacttgggagactgaggcagaagaatcgcttgaacctgggaggcggaggttgcagtgagccgggatcgcgccactgcactccagcctgggagacagagcgagactccgtctcaaaaagtaaaaaaaaaaaaaaaaa

SEQ ID NO: 13063 - DNA, 381 bp, Homo sapiens
tcttatttttgccttttcttttgcttttaaaaaaaacttttgagtcaaagttcatatactttaatattaagaattttcttttggctgggtatggtggcttgcgcctgtggtcccagcactttgggaggctgaagcaggcagattgcttgagcccgggggttcgaggtcagcctgggcagcgtggtgagactccgtctctaaaaaaaaaagttaaaaaattggctgggtgtggtggcggacgctgtggtcccggctgctcggggggctggggtggggattgcttgagtctgggaggtcgagtctgcggtgggccgtggtcgtgccgctgcactccagcttgggtgacaagctggartctctttgggtctcaaaaaaaaaaaa

SEQ ID NO: 13064 - DNA, 442 bp, Homo sapiens
ttgaaaaaaaaaataggaaaatgaacatgttctcctcagtttttctttgtcttaatttggccaacttacattagtagtaactttgtcctttatggtagccgatatcaacactaaaaaaggactgtgccctccatagcgtcatgactacctttgcccaaccttttcaccaacctctggacctattgagagacatggtccaaggtacaacacattctaaatagagaattttctcagcagtcaggtatgttctataaataaatctggacgatgaatcttctgctttgagactttaaagcagccctggaggccgggcttggtggctcatgcccgtaatcccagcactttgcgaggccaaggcgggcggatcgctgaggttgggagttcgagaccagcctggccaacatgatgaaaccccatctctactaaaaatacaaaattagcc

SEQ ID NO: 13065 - DNA, 295 bp, Homo sapiens
tgtctactcactgggcacggtggctcacacctgtaatcccagcactttgggaggctgaggcaggtggatcacctgaggtcaggagtttgagaccagcctgaccaacatggtgaaacccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctcaaaaaaaaaaaaaaaaa

SEQ ID NO: 13066 - DNA, 492 bp, Homo sapiens
  misc_feature 26: n=a, g, c or t
tttttattggtcttgtggtctttttnssccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaagtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtct

SEQ ID NO: 13067 - DNA, 500 bp, Homo sapiens
aaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacagagagaccctgtctggaggggtggggggagaaaaaaacaccatagaaacaacccaaatgtccaataacaaattgtagtccatccatacaatggactactactcagccatgaaaaggaatacagcactcacatatgctgcatgtgaatgaaccctggaagcattatgctcagtgtaagaacccagacataaaaggtcacacattttatgattccacctatatga

SEQ ID NO: 13068 - DNA, 353 bp, Homo sapiens
atttatggattttttctcttgttcaggggcttctttcctgtcgttgttggctttattagaagagtgccagtccttggatccctcctaaatttacctggaattagatcagtaagtaatcatgtatattttaggccaacaaaatacgtattttgatgctttttacttctagaaatttgagtaattgatacttggttaattgctgagttttgtattatgatatagttacttcacatagatcatgagtaccatgaagaccaaaaaataattattgctaaacctataaaatgtgaaattttgttttaccgtatccatttctggatccatattctctattttttaaatgttactcagat

SEQ ID NO: 13069 - DNA, 53 bp, Homo sapiens
ctttcygstcscaggggcgttgggaacgkttgtaggasgtggctctytattcg

SEQ ID NO: 13070 - DNA, 292 bp, Homo sapiens
cttttttaagactttctggctgggtgctgtggctcatgactgtaatcccagcactttgagaggccaaggagggcagatcaaggtcaggagtttgagaccggcctggccaacatggtgaaaccccgtctctactgaaaatgcaaaggttggccgggcatggtggcaggtgcctgtagtcacagctgctcgaggctgaggcaggagaattgcttgaacctggggggcggaggttgcagtgagctgagatcgcgggcaacagagcgagactttgtcacaaaaaaaaaaaaaaaaa

SEQ ID NO: 13071 - DNA, 434 bp, Homo sapiens
cataggaaaaacttgtaatctgagtgccagcatgactatccccctaaatataccccccagacatgatacatgtagtaagtggataaacacctccacgatggtgctattagctgaaaatataaacaaaccagcagatcctcactttaagtagcacaatgactcttgaaggcgtcataaaactatgacagtaaacgtagtaaaagaattgtgtataacattttacatgtaacattacctcacatcattctcccattatttctattgtaatttaaaagagtactttggtttcagagaataaaaatcatgcttaatgattttgactgtttaaggaaagattttaaaaaggttattaacagagctgagtgcatcacattttctcccgaagactacagtgaaaattttcctcaataaaatattgactagctgtggccaaa

SEQ ID NO: 13072 - DNA, 361 bp, Homo sapiens
agaggaatagcaaaaacaaatttttaaggtaaaactataaattttcttttgaaattgtacatattcgttggactcaatagtcatcttctcttactggaactaactaagagttagtccctgtgactgcttacaaggcagagccaggtaattgatgcgtcagaaacctagctgttgaaccactgtgtgaatctttaggccatgaggcttaattctaattttaagcagatttggctcttataaatcctaaagagttataaagccttgagttattttcttgaaaatatctgataattcaatttataatttattcttaacactctctttaaaaaaaaaagaaagaaaacttaaagtataataataa

SEQ ID NO: 13073 - DNA, 469 bp, Homo sapiens
  misc_feature 341: n=a, g, c or t
tcaagtttgggaacagaaaatgggattgcttggtacaagaggcattttacaggcagaaccatcaggcttgtggaatgcttccatccagctggaccattgattctcattagaatcgcctgtgctgagaggcctaggcccaccctggccacaccgattcagggagtagggctggggttccataggtaatctcattgtgcagcaagggtggggaatcattgagccaggtactaggccagccagtggggatgaaacaacggttagctgtgtgagactcagccctttggaggctcacaatgtacaggggaagaaaagagaagggaagatcgctataaaggcactgntattattgtagtgacgaagaaaatggttaggcccatgtatgtattcctcatagttttaggatttcccatgtaaaatgagaaatctttgagttggaatcctgacacaggaggcagcaggctctgaagta

SEQ ID NO: 13074 - DNA, 295 bp, Homo sapiens
cattttagaaggatctatttggaaggatccatttggaaggattgcttgagcccaggagttcgagactagcctgggcgatgtgatgagacactgtatttacaaaaatacaaaaaaattaaccaggtgtggtgacatgtgcctgtagtcccagctattcgagagcctgaggtaggaggatcacttaagcctagggaggccaaggctgcagtgagccgagattgcaccattgctctgcagccagcctgggtgacagagtgagaccgtgtaacaaaaaacaacaaaaaaaaaaaaaaaa

SEQ ID NO: 13075 - DNA, 134 bp, Homo sapiens
ctttttttttctgttttgggtgtactctaggggccaggttgggagggggaaggtgagggcttcgggtggtgctataatgtggcactggatcttgagtaataaatttgctgtggtttgcaaaaaaaaaaaaaaaa

SEQ ID NO: 13076 - DNA, 390 bp, Homo sapiens
  misc_feature 382: n=a, g, c or t
gcagtttgttcgaaataataataccagcaatgtattcagtgattaccttatgaataagtgaaatacatgacaacaatgttataaagaatgaggctgggcgtggtggcttatgcctgtgatcccagcactttgggaggctgaggtgggcagatcataaggtcaagagttcaaggccatcctggcaacatggtgaaacccgtctctactaaaaatacaaaaattggctggacatggtgtcatgcgcctgtaatcccagctactcaggaggctgaggcaggagaatcgcttgaacccaggaagcagaggttgcagtgagccaaaatcacaccattgcactccagcctgggtgacctcttgtcaaaaacaaaaacaaaaaaraaangawtggga

SEQ ID NO: 13077 - DNA, 82 bp, Homo sapiens
ctcttstgaggatccggyaakatggcagaagtagagcagcagaagawgcggaccttccgmaagttcacstatcgcggmgtgg

SEQ ID NO: 13078 - DNA, 506 bp, Homo sapiens
taggcatagttcccggagccttgcttaaccagcctgtctcttacatattcctccctgaccttactgcttagagttaagcaatttcttctgctctctgttcccctgggatctcctgaatgcccctgttccagcacttgtcacatttcggtgaattttttattcatttaacagtatttcccaatagagtattacctcaggaaggcagaaacgtggctttcttcatgtctttatcctcggggcctggcacagagtaaggtcttaatacatttctgtgaaatgaatgaataaaatttgcttggaagcattaaaaatacccacagaatttgaagaagagaaggaaaaaaaagtactgtatttaaatatattttaagtaaaatttcggtgatgagtggaaaggaattagaaagctgtgtttctttaaatgatgtgagcaatggccaaagagaatgacagtcatttaattttctaacaacttaagaaaatgtttttcattcattgaaattaat

SEQ ID NO: 13079 - DNA, 72 bp, Homo sapiens
ttatttaatattttgaagcaagtgaactgattctctagggtctcactccatcaccctgtctggagtacagtg

SEQ ID NO: 13080 - DNA, 438 bp, Homo sapiens
  misc_feature 130: n=a, g, c or t
attattattattgttattactattttgtagaaacggggttttgccatgttgtccaagctagtctcaatctcctgagctcaggcaagtcgcctgtctcagcctcccaaagtgctgggattacaggcgtganaccatgcccgtccccagactctcttaaataaccagatctcctgtgaactaactgagtgggaactcactcatcaacaaggggatggtgctaaccattcatgagtggttgacccccttgatccaatacstcccaccaggctctaccccgtctctactaaaaatacaaaaaattagccgggtatggtggcgggcgcttgtagtcccagctacttgggaggctgaggtgggagaatggcgtggacccgggaggcagagcttgtagtgagccgagatcgcgccactgcactccagcttgggggacagagtgag

SEQ ID NO: 13081 - DNA, 190 bp, Homo sapiens
tgaactatcaaacttaggagccatctagcttacacgtgttccttaaaaagtttgctgtaggccgggcacagtggctcgtacctgtagtcccagcacttttgggagcccagggtgggggatcacttgagctcaggagttcaagaccagcctgggcaacatggcaaaacgccatctctacaaaaatacaaaa

SEQ ID NO: 13082 - DNA, 320 bp, Homo sapiens
cataaaacttcagtcagtgttagcttctagtagtactttctgcttctccaatagaagtgggtaagaataggtaaccttgccacattggtatttcttagccttaattttcagtcttctagtgtttattcctctttccttaaacccgtccctgatcacactcctctctctgccctgatagsttgactgtagtagactctgatggagctaccaactctactactgcaaacctgacagtgaacaaagctgtggattacccccctgtggccaacgcaggccccaaccaagtgatcaccctgccccaaaactccatcaccctcttt

SEQ ID NO: 13083 - DNA, 400 bp, Homo sapiens; identical to SEQ ID NO: 12874

SEQ ID NO: 13084 - DNA, 59 bp, Homo sapiens
aaaaaaaaaaaaaaaaaaaaaaaaaaaaaaaaaaaaaaaaaaaaaaaaaaaaaaaaaaa

SEQ ID NO: 13085 - DNA, 458 bp, Homo sapiens
attttctgtttttaaattgtatttcatctgcttcctccccattctctcactttaagtgacattgaggaaggtattctgtcccacaggtttctgtgacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcasttgccggaggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtcttt

SEQ ID NO: 13086 - DNA, 207 bp, Homo sapiens
  misc_feature 64: n=a, g, c or t
cagggaaacctcatctctactaaaaatacaaaaaattagctgggcatggtggcgggtgcctgtngtcccagctacaggctggamtgaggcaggaggctcaggaggctgaggcgggagaatggcgtgaacctgggaggcagagcttgcagtgagctgtgattgcgccactgcactccagcctgggcaacagagtgagactccgtctca

SEQ ID NO: 13087 - DNA, 461 bp, Homo sapiens
aaaaaatgtccctggaacagaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaagaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcacagcatcaatgg

SEQ ID NO: 13088 - DNA, 416 bp, Homo sapiens
ttttggggggataaatacctagatagatagggactgctaggtcatgtggtcagtgcacgctcaaccttttacaaaactgcccagttgctttccacatggctgcaccattttgcattcccatcaacaatggataagaactccggctgggtgcagtggctcacgcctataatcccagcactttgggaggccgaggcagttggatcaactgaggtcaggagtttgagacaaggcggactaacatggtgaaacctgtctctactaaaaatacaaaaattagctgggcatggtagcatgggcctgtagtcccacctgcttgggatgctgaggcaggaggcaggagaatcacttgaacccaggaggcaaawgttgcagtgagccaagatcacaccactgcactccagcctgggagacagagc

SEQ ID NO: 13089 - DNA, 319 bp, Homo sapiens
ttgtcaaagatggttgtaggctgggcacagtggcttacgcctgtaatcccagcactttgggaggccgaggcaggcggatcacctgaggttgagagtttgagaccagcctgacgaacatggagaaacccctgttgggagaaatctctactaaaaatgcaaaaaaattagccgggcgtggtggcacatgcctgtaatcccagctactagggaggctgaggcaggagaatcacttgaatctgggaggcggaggttgtggtgarccaagatcacaccattgcactccagcctgggcaacaaaagtgaaactccgtcccaaaaa

SEQ ID NO: 13090 - DNA, 266 bp, Homo sapiens
agagtcagtcagcaagagacgctggggagagagcagggatcgcgagcccggcgatgcggcacggcggaaggcggctggggagacgctactccaactgttgaattgaattttcacctttcctttcatccgctgctttgcttgcggagatggatttatttgctttgaaatccgcatatctttctcagactgtggggtgatcccggcagacaccagactgaaagagaccacccgtgacagaaaaggaggaattaaaaaaaaaaaaaccc

SEQ ID NO: 13091 - DNA, 311 bp, Homo sapiens
ttttaaagctcagsattctcaaagctatttaaagaaccccttcatcaccaccactttggaccaatgttaaaagcaattcagtagagasattctccttcsataaccccccaaataattattgctgacctagaggcaattctgaaaggatgtatasgttagcccttctaaaaatcttatgtaggccgggggcggtggctcacgtctgtaatcccagcabtttgggaggccgaggcaggcggatcacgaggtcaggagatcgagaccatcctggctaacacggtgaaacctgtctctaccaaaaaaaaaaaaaa

SEQ ID NO: 13092 - DNA, 426 bp, Homo sapiens
  misc_feature 389..390: n=a, g, c or t
ccgtgttcatttttgtcctcgtgctacagttagctccctgccgcctcttgcaggtcttacttcagctcttgcctgtgacccacacagcttctgggctctgctctgctctaagaagtgctgtgggggtagagaaccaggaaggacatgctgttgggaatgtacacctgggcagaggtggccctgttaagatgtgactgtagccacagccagggatgggatccctcggtctctggaatctgaaacctcaacaaataccagtcttgacccctagcagcagagataagaataaaggggttggtttghtattaagtcagatgggggctctctccttgtcatgctgtccctgtggtaacagacagggattgaccatcttactgttgtacatgtanntggtggtgttggattattsccattgaagctgggaca

SEQ ID NO: 13093 - DNA, 219 bp, Homo sapiens; identical to SEQ ID NO: 12704

SEQ ID NO: 13094 - DNA, 320 bp, Homo sapiens
agtattagcatgatacatstttttttcataattttattttaacacattatgttctttaaatttaaatttcttgggaggctgaggtggctggatcacaaggtcaggagtttgagaccatcctggcyagcatggtgaaacccatctctactaaaatacaaaaaaattagctgggtgtggtggcgagcgcctgtggtcccggctgctctggaggctgaggcaggagaacggcatgaacctgggaggcggacttgcagtgagccgagatggggccactgcattccagcctgggcgacagagggagactccgtctcaaaaaaaaa

SEQ ID NO: 13095 - DNA, 97 bp, Homo sapiens
  misc_feature 12..13: n=a, g, c or t
asacagcccgcnnccccttccgcccggcccggavwrgcattcatgacggaggccggcgcagatgggaacaacaggcttttagtgtcgcsmcccgtaa

SEQ ID NO: 13096 - DNA, 179 bp, Homo sapiens
aaaaatacaaaaaattagccgggcatggtggcgggtgcctgtagtcccagctacttgggaggctgaggcaggagaatggcgtgaacctaggaggcggasttgcagtgagctgagattgcgccactgcactctagcctaggtgacacagcgagactccgtcaaaacaaaaaaaaaaaaaa

SEQ ID NO: 13097 - DNA, 289 bp, Homo sapiens
  misc_feature 109: n=a, g, c or t
tagctgttatggtggccgggagcagtcatcacgtctgttctcccggsattttgggggactgaagcgggcggatcacctgaggtaggaakttcgagakcagtctggccancatggggaaaccccgtctctactaaaaatacaaaaattagcakggcatgctggcacaagcctgtaatcccagctactccggaggctgaggcaggagaatctgttgaacccgggaggcaggggttgcagtgagccaagatcacgccgctgcactccggcctgggtgacggagcgagactcc

SEQ ID NO: 13098 - DNA, 496 bp, Homo sapiens
ttaaagcaatatatctgtgacatagaaattgtttctccaaagtattgctggggtcaatgggaaataagcaacgacaagcctgttcccataaactttattgcctcctgtaactgactttctaagtaaataaaggttcttagttttgcttttcttgcagaaaggaaagaaagagggatacccgagggatagatatccaagagttatgctaattctctgatattttataataaaagagatttcatctaaaaagaaaaggaggttctgaaggtggttatgtacattcttccaaactcaaagtcacgtctggaacattcttatatggaaagagctaaaaatacttaaaaatttaccttgaaacaatttctcatccaatcatattatggtccaggcaggtgctgatatgagggacatgatggtgcatatcctttgacaagcagaagggactgtgagtctctgagggatgggatgcagactttgatctgctccatacaactat

SEQ ID NO: 13099 - DNA, 55 bp, Homo sapiens
actcctcttcctttctccgccatcgtggtgtgttcttgactccgctgctcgccat

SEQ ID NO: 13100 - DNA, 346 bp, Homo sapiens
atgtacagattgaaatttagttgtttcattgtctgtctgaggaggtgtggacttttatatatagatctacataaaaactgctacatgacaaaaaccacacctaaagaaattttaagaatttggcacagttactcactttgtgtaatctgaaatctagctgctgaatasgctgaagtaaatccttgttcastgaagtctttcaattgagctggttgaatactttgaaaaatgctcagttctaactaatgaaatgatttcccagtaggggtttctgcatatsacctgtatagtagttatatgcatatgtttctgtgcatgttctctacasaattgtaaggtgtcactg

SEQ ID NO: 13101 - DNA, 503 bp, Homo sapiens
accctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaaagcctgaaattcagctccaacatctattaaacatttgcagagtatcagctgggtgc

SEQ ID NO: 13102 - DNA, 272 bp, Homo sapiens
agggacctggattcttagtatttcaggctgctgtcccttttttttttttsatttcctttttgtttttgttgttgatgtgaccgcgtgtccasaaccctgggattccctcgccctcagattccagaatccaatttcttggatttcagtgtttttaagckgctcgggaggctgaggcaggagaatcgcttgaacctgggaggcggaggttgcagtgagccgagatgacaccattgcaccccagcctgggcaataagagcaaaactctgtctgga

SEQ ID NO: 13103 - DNA, 282 bp, Homo sapiens
gtttcagagaatatctttatttctgccttcattttattatgtacccagtagtcattcaggagcaagttgttcagtttccatgcagttgtgcagttttgagtgagtttcttaatcctgagttctaattttattgcactgtggtctgtgagacagtttgttgtgctttctgtccttttacatttgctgaggagggtggatcacttaaggtcaagagttcaagaccagcctggccaatatggtgaaaccccatctctactaaaaataccaaaaaaaaaaaaaaaa

SEQ ID NO: 13104 - DNA, 302 bp, Homo sapiens
tgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaggctgaggccggtatcacttgaggtcaggtgtttgagattagcctggccaacaagctgaaactccatctctactaaaa

SEQ ID NO: 13105 - DNA, 370 bp, Homo sapiens
cattgcatcctttaggacccagtggaacctgacagagcccataggattccctcttctactttcttagacagcagggatgtcagggtctcaaactgcctaacactttgtagcttttctttaacacaaaagcacccttctctcctaacttgggctctgaatactttcccaacagggaagtctgatctgttgccagacttcttkgttagatggctcatacatttatctagagaagcacactcttgmttgmtgtcaaactttagaacaccatggaaggtctaagggcatcctgtgccagggaaactttttaaggaattttatctatgggataaaccccatattccctctagtgtctactggtggctctaatact

SEQ ID NO: 13106 - DNA, 69 bp, Homo sapiens
  misc_feature 44: n=a, g, c or t
caaaatattaaaaataaaaggttgggacaaaagaatagcatganarcacatggaagtaaaaagcaggga

SEQ ID NO: 13107 - DNA, 272 bp, Homo sapiens
accaaggccgagtgtggtagctaatgcctgtaatcccagcactttgggaggctgaggtgggcggaacacttgagctcatgagttgaagatcagcctgggtaacatggcaaaaccttgtctctacaaaaaatatagaaattggcgtggtgtggtggtgtgtgcctgtagtcccagctgcttggggggccgaggcaggaggatcgcaccagcctaggaagtcaaggctgaggtaagatgtgttcatgccactgtgctccagcctgggcaacaca

SEQ ID NO: 13108 - DNA, 319 bp, Homo sapiens
atattagagaagaaaagtttggccgggcacagtgcctcacacctgtaatcccagtactttgggaggccgacgcaggtggatcacttgagatcaggagttcaagaacagcctggccaacatgacaaaaccccgtctctactaaaaattcgaaaaattagcctggcgtggtgatgcatgtctgtggtcccagatacttgggagactgaggcaggagaatcgcttgaacccaggaggcagaggttgcagtgagctgagattgtgccactgtactccaccctgggtgacagaatgagactccatctcaaaaaaaaaaaaaaaa

SEQ ID NO: 13109 - DNA, 235 bp, Homo sapiens
gtacttccaggtgcacgtgatactgatggggaagggtcggctgattgctgccagaaatggagagctcgttttaaggaaatgcggcgtctcctgggagtgaagaggcttttgggccaccttgaggcacgacgggtgccgcttcgtttccctgcgaccgctgcctgtttcgactgagccccttacaggaggacgtggcgggggcagacgggcgcastcccgccctctccgtgactca

SEQ ID NO: 13110 - DNA, 375 bp, Homo sapiens
cattakttaggtactcaaggaaacttttcaccaaatttttattctaaaaattgaaaactcaaaatattgagtacaatttttttttctttttttagtaatagagttctactaatgggaataatgggattttttggcaggggrcgggaggtaacattttgctcaatttgggctgaaagttggtatcccctcattggaataaatagaaaatgttaatctgttaatgctgatgtgtaatgtgatttcacgtatttcatctttgaaaatgtcttttcacacaaacaggtcaaggtactgctaaatactgacacatccacccatgagcatgtgattttagttaagcatattcatcacttgtaaggcatttgtaggattcat

SEQ ID NO: 13111 - DNA, 325 bp, Homo sapiens
  misc_feature 309: n=a, g, c or t
agccagggcaggccgggcacagtggctcacgcctgtaatcccagcactttgggaggccaaagcaggtggattacccaaggccaggagttcaagaccagcctggccaacatggtgaaacccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctcgccaaaaaaaynaaaaaaaaaaaaaaaa

SEQ ID NO: 13112 - DNA, 298 bp, Homo sapiens
tacaaataaaatatcaaaaacatggccaggcgcggtggctcacgcctgtaatcccagcactttgggaggccgaagccggcggatcasgaggtcaggagatcgaaaccgtcctggctaacacagtgaaaccccgtctctactaaaaatacaaaaaattagcctggcttggtgctactmgggaggctgcggcaggagaatggcgtgaacccgggaggcggasttgcagtgagccgagatctcgccactgcactccagcctgggtgacagggcaagactccatctcaaaaaacaaaaacaa

SEQ ID NO: 13113 - DNA, 179 bp, Homo sapiens
tatgactaggaaacaaatgtaatgactgagttctgctttctatgtatgcaactcaccctaaaaacgttttgtaaggtagctggttgaagatatttggaatgtctaacaagttggctgactaatgtcatgaaaactgtacaattgtgttggagccagtctttttttttttttttttccct

SEQ ID NO: 13114 - DNA, 219 bp, Homo sapiens; identical to SEQ ID NO: 12704

SEQ ID NO: 13115 - DNA, 499 bp, Homo sapiens
aaccttaaatagatgtaatttctatttgtcaatgatgcctcagcaaagctagggagaaaataaaaaggatccttctgtgcaacarcccgcatgtccattaccgatgactggataaagaaaacgtgctccacccatgcagtggaatactacgcagccataaaacggaatgaagctcggatccaagctagaacgtaggtgagccttggaaacgtggcgctgagtgagagaagctggacacaaaataaggccaggaatggtggctcacagccgtaatcccagcactttacgaggccaagatgggcagatcacttgagtccaggagtttgaggccagcctgggcaacatgacgaaatcctgcctctacaaaaaatacaaaagttagccaggagttcatttagaggagtcatgtgactatagtcccagctactcaggaggctgagatgggagaatcacttgagcctgggaggtggaggttacagtgagccgagattggggccac

SEQ ID NO: 13116 - DNA, 317 bp, Homo sapiens
ttaaaaattgaggaatatcagccgggcacgatggctcacacctgtaatccctgcactttgggaggccaaggcgggcggatcccgaggtcaggggatggagaccatcctggccaacatgttgaaaccccgtctctaataaaaatacaaaaattagctgggcatggtggcacatgcctgtaatcccagctacttgggaagctgaagcaagataatcgcttgaacccggtaggcggaggttgcagtgagctgagatcatgccactgcactccagtctggcaacagagcgagactccatctcaaaaaaaaaraaaaaaagg

SEQ ID NO: 13117 - DNA, 461 bp, Homo sapiens
gagaagaggtggagctggagtggagcctcaggccctgtggtttgctgtgtttggggcctgctgtcacagcactgggagccttggagagagatggggagctgggatccccaggagtgacatacaactcctgaaatcctcagaatctccgtggtgctctttctgtgcgctggtgttgactgatagcttccgggtggcgctggtcactggaaagaccaaggcaggattagcgggttagaactttcagccccacccccaaccgcggggaggggagaggtccagaggtggaaggtcaagttgattgccagtggggtaatcagttatgcctacttaacaagggctccatgtcaaccctagaagacaggacttggagagcttctggacagctgaataggagggagtgcctggagggcagcaccgtgtccctctcccgtacctcaccctaaaggtctcttcatctgtgt

SEQ ID NO: 13118 - DNA, 295 bp, Homo sapiens
aaattttgaagcctgggccaggcgcggtggctcatgcctgtagttccagcactttgagaggccgaggcaggcggatcacgaggtcaggagatcgagaccatcctggccggcatggtgaaacccatctctactaaaaatacaaaaaattaactgggcacacctgtggtcccagctacttgggaagctgaggcggagagccgcttgaacccgggaggcggagagtgcagtgggccgggatcacgccactgcactccagcctggtgacagcaagacttgtctcaaaaaaaaaaaaaaa

SEQ ID NO: 13119 - DNA, 507 bp, Homo sapiens
attaactgggcgtggtggcgcacscggtagtcagctactcgggaagctgaggtgggagaatctgctactcggaaggctggggtgggagaatcccttgagcccaggagattgaggcttcggtgagctgagattgtgcctttgtgctccagcctgggacactgtctcaaaacaaacaaataaaaaaacaaaagttaatctcactgcttttctttttctctttttttagtgtggctatttggaaatttaaaatgacatatacgggccgggcggggtggctcaacgtctgtaatcccggcctcccaaagtgctgaaattacaggcatgagccacagcgccccgcctcaatggatcctgatgagctacgcaaaccattatttttatgtctttatgaatgccaccagaaagtttcattttgttctttctgaaaacaaccatgattataaaatgtcttctgaaacacggaagtgatgagaacatgttgtacagagaagcatggcattccctctg

SEQ ID NO: 13120 - DNA, 258 bp, Homo sapiens
cactttgggaggctgaggtgggcagatcgcttgacatcaggggtttgagaccagcctggccaacatggtgaaactccgtctctactaaaaatactaaaaattagctgggcgtggtggcgggtgcctgtaatcccagctactcgggaggctgatgcaggagaatcgcctgaaccaggcagatgcaggatgcagtgagccaagattaagacactgcactccaacctaagcaatactttgtctcaaaaaaaaaaaaaaaaa

SEQ ID NO: 13121 - DNA, 357 bp, Homo sapiens
ttaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcctttttttttttttttttg

SEQ ID NO: 13122 - DNA, 125 bp, Homo sapiens
caattcattatggtgttgtgctttttaaatacactttttttgttgttgttgttgagaaagggtgtggctctgtcgcccagcctggagtgcagtggtgcagtcatggctcactgcagccttgacct

SEQ ID NO: 13123 - DNA, 82 bp, Homo sapiens
acttttttttttttycccsggttgctgcttgctgtgagtgtctcwagggtgatacgtgggtraaaaaggtcstggtccgsgc

SEQ ID NO: 13124 - DNA, 298 bp, Homo sapiens
atattagagaagaaaagtttggccgggcacagtgcctcacacctgtaatcccagtactttgggaggccgacgcaggtggatcacttgagatcaggagttcaagaacagcctggccaacatgacaaaaccccgtctctactaaaaattcgaaaaattagcctggcgtggtgatgcatgtctgtggtcccagatacttgggagactgaggcaggagaatcgcttgaacccaggaggcagaggttgcagtgagctgagattgtgccactgtactccaccctgggtgacagaatgagactcc

SEQ ID NO: 13125 - DNA, 85 bp, Homo sapiens
taatttattttggatgtcaaaaggcactgaytgaagatattttctctggagtctccttctttctaacccggctctcccgatgtga

SEQ ID NO: 13126 - DNA, 185 bp, Homo sapiens
  misc_feature 80: n=a, g, c or t
agggggcttggctctgcccggccacagagccggagctggaggtgctgtcccgtctggcggcgatccccgggcagggccgnccggggttttgaagatgctgaacgtcccttcccagtctttcccggcccccaggtcgcagcagcgttgtcgcctccggggggcgtacaagggtacctttaaaacag

SEQ ID NO: 13127 - DNA, 327 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctcaaaaaaaaaaaaaaaaaagc

SEQ ID NO: 13128 - DNA, 322 bp, Homo sapiens
tatcgtcgggcacggtgactcacgcctgtggtcccggcatcttgggaggctgaggcgggtggatcatgaggtcggatcgggaccatcctggccagcatggtgaaacctgtctctgataaaggtgcaagggttatccgggtgtggtggtgtgtgcctgtggtcccggctgctcggggggctgaggcgggagagtcgcttgggcccggaaatcggaggttgcagtgagtgagctgggatcgcgccactgcactccagcctggcgacggagtgagactctgtctcaataaaaaaaacaaaaaacaaaaacaacaacaacaaaaaa

SEQ ID NO: 13129 - DNA, 319 bp, Homo sapiens
cattagaaatgagcatctagggccgggcgcagtggctcactcctgtaatcccagcactttgggaggccaaggtgggtggatcacatgaggtcgggagttcaagatcagcatggtcaacatggtgaaaacccatctctactaaaaatacaaaagttagctgggcgtggtggcaggtgcctatagtcccagctactagggaggctgaggcaggagaatctcttgaaagcgggaggcggaggttgcagtgagccaagattgtgccactgtactccagcctgggtgacagagtgagactttgtcccaaaaaaaaaaaaaaaaa

SEQ ID NO: 13130 - DNA, 473 bp, Homo sapiens
cacagcatgtgttttgtagaaattgataagccgatcctaaaattatatggaaatgcaaagtacctagaatagccaaagcattttggaaaaagcacagcattagaggacttacacactccgtttcacaactttagtaatcaaggcattgtggtattggtagaaggacaggcatatagatcagtggatccaaattgagaatctagaaataaatatctttacggtcaattgattttcaacaaaagtgccacgatcattcagtgagggaaggacagtctttcaacaaccagtgctgaaacaattgttatccacatgcaaatttaaaaaaagaagccgggcctcgtggctcatgctgtaattacagcactttgggaggctaaagtggtagaatcacttgagcccaggaggttgaggctgcagtgagccatgatggcaccactgcactctaaggtgagccacagagcaagattgtttca

SEQ ID NO: 13131 - DNA, 203 bp, Homo sapiens; identical to SEQ ID NO: 12721

SEQ ID NO: 13132 - DNA, 204 bp, Homo sapiens
tccattatgggaggctcattaaaagttggaagaaggccgggcgcggtggctcacgcctgtggtcccagctactcgggaggctgaggcgggagaatggcgtgaacccgggaagcggasttgcagtgagccgagattgcgccactgcagtccgcagtccggcctgggcgacagagcgagactccgtcccaaaaaaaaaaaaaaaaa

SEQ ID NO: 13133 - DNA, 389 bp, Homo sapiens
gaagatgaagaaaaatgagaaaaaaacacacaaaaggcaactttaaaacaaaatatcacgagcagacggggaggctgaacggctgggagctgggaggagacgctgcttaccgatcccggggcttttccagcccacgggcgcctgacgcaggctggagcaagtggtgcgtggggcctggtccccaaggggcggctgagaggccgcactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaa

SEQ ID NO: 13134 - DNA, 256 bp, Homo sapiens
tatttggtggcagctcttggtcctattgctgtggatgttccactgaaaacacggcgggtaggggggagtggtaaggaaagcaacttttttctaatttttgtattggtatccacaagcgtttgtattttttgaattgcaaacactgtgttttctggtctttgggggttagttgaactttctgtattaccttttggaaaacctgagttttaccacagtcttaagcagatttgaaataaattcttttgacactgccaaa

SEQ ID NO: 13135 - DNA, 444 bp, Homo sapiens
cacagcatgtgttttgtagaaattgataagccgatcctaaaattatatggaaatgcaaagtacctagaatagccaaagcattttggaaaaagcacagcattagaggacttacacactccgtttcacaactttagtaatcaaggcattgtggtattggtagaaggacaggcatatagatcagtggatccaaattgagaatctagaaataaatatctttacggtcaattgattttcaacaaaagtgccacgatcattcagtgagggaaggacagtctttcaacaaccagtgctgaaacaattgttatccacatgcaaatttaaaaaaagaagccgggcctcgtggctcatgctgtaattacagcactttgggaggctaaagtggtagaatcacttgagcccaggaggttgaggctgcagtgagccatgatggcaccactgcactct

SEQ ID NO: 13136 - DNA, 518 bp, Homo sapiens
agtttggaggtttctcaaagaacacagaactatcattcaatccagcaatcttgttactaggtgtatatccaaaggaaaagaaattgttataacaaaaagacacatgcactcatatattcattgcagtactatttgctatagcaaagagatgaagtcaacctaggtgcgcatcagtggtggatttggtaaagaaaatggtacatatacaccatggaataatgtacagccataaaagagaacaaaacaggccgggcacagtggctcacatctgtaatttcagcactttgggaggctgaggcaggtggatcacctgaggtcaggagttcaagacaagcctggccaacatggcaaaagccccgtctctactaagaatacaaaaaacattagctgggcatggtggtgcgcacctgtactcccaactactcgggaggcaggcatgagaatcacttgaacccaggaggcagaggttgcagtgagccgaaatcattccactgcactccagcctkgggtgacagagt

SEQ ID NO: 13137 - DNA, 316 bp, Homo sapiens; identical to SEQ ID NO: 12645

SEQ ID NO: 13138 - DNA, 441 bp, Homo sapiens
  misc_feature 427: n=a, g, c or t
atgtctaagttatgggtgactctggatctccaaaggcaaattagtcatggaagaatctttagttttggaaaatcactatgttgcttctcaaaaagtatactagttacgacaaggtagtatttagtgtcttttacatcaacattgaggctggcacggtggctcacgcctgtaatcccggctcttggggaggctgatgcgggtggatcacctgaggtcgggagtttggggccagtctggccggcatggtggaaccccgtctctactgaaagtacaaaaatcggccgggcgtgttggtgtgcgcctgtggtcccagctactcgggaggctgaggcaggagaattgcttgaacccgggaggtggagattgcagtgggccgggatcgtgtcactgctctccagcctgggcaatagagcaagactccgtccanaaaaaaaaaaaaaa

SEQ ID NO: 13139 - DNA, 471 bp, Homo sapiens
atgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcacctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccag

SEQ ID NO: 13140 - DNA, 280 bp, Homo sapiens
atgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggacttggctgggcctttcctatgggcaaggccagtgctcttcctgcccaccagggaccatggagcagtggcaccctatgggctatgatccctaggcct

SEQ ID NO: 13141 - DNA, 394 bp, Homo sapiens
  misc_feature 331: n=a, g, c or t
gtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcrnaacacttcatattgcccccacttgttgaaaaataaatgtagttcaaattgccactttccagca

SEQ ID NO: 13142 - DNA, 395 bp, Homo sapiens
cagacttggttacatggcttttatgacatcactttttctaaattactggaacctgtgtttgtttttacattgttttgtcatgagaaaatacatttatataacttaaggctcttttcttcatttatttcaccttgtcttcaaaaaattacatgaacatgttaattccctaaaagtgaaagaacattatgttttttattggtgaataagaagttgttatggagtgctctatttttacagctgtgcttcagggtatcacgttctgaagaggtcagcttggcatgatctcatgggcatgaatcttggggagacaattctgaaacagccacaggcctgcagcgtcgcaaagccagggcagaacatccagatgctgtcgttaggaggcacgcggtctgtta

SEQ ID NO: 13143 - DNA, 328 bp, Homo sapiens
tattctggattttctctaacaaataatacttgatagggccaggcatggtggctcacgcctacaatcccagcacttttggaggctgacaggggtggatcactttagctcaggagtttgagaccaacctgggcaacatggtgaaacccatgtctaccaaaaatacaaaaaattaaccgggcstggtggtgtgtggtcccagctactaaggaggctgagatggaaggatgacttgaacccgggaggcggaagttgcagcaagccaagatcacgctactgcactccagcctgggtgacccagtgagaccacatctcaaaaaaaaaaaaaaaa

SEQ ID NO: 13144 - DNA, 81 bp, Homo sapiens
aawattgtggcagtttctggscgggcgcagtggctcacgcctgtaatcccagagctttgggaggccgaggsgggsggatta

SEQ ID NO: 13145 - DNA, 280 bp, Homo sapiens
  misc_feature 278: n=a, g, c or t
tagtgtttcttattttggccagttcttttatttatgtccttgtgacccaggtacttggggggccagctacccttctggctttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaactawcaaaaaaaaaaangc

SEQ ID NO: 13146 - DNA, 376 bp, Homo sapiens
cagattatgtacagttgagagaaactttgtgaactggaagacattttttaagaatgcagccaagagttaacaagacggggaaagtgacagagaggttgattgagacacagaggatagaatgcaaaagtttaagatacatttgatttcagccccagaaggggaaaatagaatggagaagaggcagtatttgaagagccgttggctgaaggatattttgtaactgatgaaagatttgagtccctaggtaatggaaacgcagtatattttaaacaggttaaatgaaagaaatccatgtggagacacatcataggaaagctccaaaacaccaaagaccaagagaagattttaaaagcaatcagaggtaggagagaagtca

SEQ ID NO: 13147 - DNA, 307 bp, Homo sapiens
tgtcttaaaaatagggaaatgtggctgggcgcagtgcctctgcccgtaatttgggaggccaaggcgggcggatcgctgaggtcgggagcttgagaccagcctgaccagcatggggaaaccccgtctctactaaaaatacaaaattaactgggcgtggtggtgcgtgcctgtggtcccagctacttgggaggctgaggcaggagaatcacttgaacccaggaggcagaggttgcggtgagccaatatcacgccattgcactccagcctgggcagcaaaagtgaaacactcaaaaaaaaaaaaaaaaag

SEQ ID NO: 13148 - DNA, 263 bp, Homo sapiens; identical to SEQ ID NO: 12632

SEQ ID NO: 13149 - DNA, 131 bp, Homo sapiens
  misc_feature 110: n=a, g, c or t
tctgattaatattggtgtctgggccgggcgtggtggctcacggctgtaatctgagcactttgggaggctgagacgggcagatcacgaggtcaggagatcgagaccatccntggcaaaaaaaaaaaaaaaaa

SEQ ID NO: 13150 - DNA, 630 bp, Homo sapiens
agaggttatccttgacatctccctccagccccccttctcattgctggagcctcctgttgccctcggagtcccttccagcttcttcccactttcggcaacagcccccacccccaacaaacctaatgctaccaagatgccttgtttcaaaatgaagtgattccagcacagtcattcatgctgggtggtagcaactcagtgagctgcccttctaatagatcattgtaccttgaagagaaggcgatgctcaacctgcaggtggaatgtttattgtatctcagaggtgcgtggaatcttagtgacactgaggtcatagcattgtctcaatggcagccattggaattgggcagccgttttctgtagggctaagaccagccttccctggaggagatcagaggtaatctgcacctttcaaaatcagcctgccaaggagaatgcagccatggcttatgcccccttcacaatgctctctggccacctgaccgcaggagagtattgtggaggacaactgggttgggtattccagcctagagatctactgctcagcccctgaatttctataattcttacccttggctgtgctttaaaaaaataataatttttaaaaaactcaaaaaaaaaaaaaaatgcgaa

SEQ ID NO: 13151 - DNA, 474 bp, Homo sapiens
caattagcaatactatttcaaaaaataaactgatgttaatttataaaagagatttaaattaagaggtaagaaggtagcaggtcagtaaagcaagtcagtcagtaaagtatttattagaaaagttatttatttatttttaacttgatgcggatggtattaagaatggaaatatgaaagagaaattcaaaaatgaaatctgggccaggcacggtggctcacgcctgtaatcccaacactttgggtggccaagacgggcggatcacctgaggtcaggagtttgagacaagcctggccaacatggtgaaaccccatctctactaaaaatataaaaatttgacagccatagtggcgcgtatctatgatcccagctacttgggaggctgaggcaggagaatagcttgaacccgggaggcagagtttgcagtgagctgagatcacaccattgcactccagccttgacaacagagtgcgacg

SEQ ID NO: 13152 - DNA, 81 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13153 - DNA, 457 bp, Homo sapiens
tatagttacctttttttaatattgtggcattgacatcacaattttaaataaggaccaaagggaaattttaaaatctattttaaaatatcattatacagtttatgtaatggtggctttttaaatggcttattaaaattggttgatatgattgtttttctcaaactaaattatacacttttttgttttacaatatttcttactgatctaggaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccaggttagctctctagtcggccagccaaaatgttggcatgttttgcccctctattcarattaaccttgaaatatat

SEQ ID NO: 13154 - DNA, 402 bp, Homo sapiens
ctatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggct

SEQ ID NO: 13155 - DNA, 440 bp, Homo sapiens
attatasgcgttctttatacattctctataagtgattttatcagatatgtatttcaccagtatttttttctggtttgtggcttgcccttgcatttttgtaacagtgtcttttgaagcacaaaaggcaaaattttgatgaagtctcgcttgccagtttttgttgtggttcatgtattttgtggcccaagaaatctttgcccaacccaagatcaccttcttcttggaggttaatagttttaacttttacatttagacctatgatctattttgagttaatttttcaatctggtatgaagtaagggtcagggttcattttcttggtcaggtgcaatggctcacacctgtgatttcagcagtttgggaggccgaggtgggtggattgcttgggctgaggagttggagaccagtttgggcaacataatgaaacccccgtctctaca

SEQ ID NO: 13156 - DNA, 384 bp, Homo sapiens
  misc_feature 377: n=a, g, c or t
attaactgggcgtggtggcgcacgcggtagtcagctactcgggaagctgaggtgggagaatctgctactcggaaggctggggtgggagaatcccttgagcccaggagattgaggcttcggtgagctgagattgtgcctttgtgctccagcctgggacactgtctcaaaacaaacaaataaaaaaacaaaagttaatctcactgcttttctttttctctttttttagtgtggctatttggaaatttaaaatgacatatacgggccgggcggggtggctcaacgtctgtaatcccggcctcccaaagtgctgaaattacaggcatgagcacagcgcsccgcctcaatggatcctgatgagctacgcaaaccattatttntaatgtc

SEQ ID NO: 13157 - DNA, 297 bp, Homo sapiens
tacaaataaaatatcaaaaacatggccaggcgcggtggctcacgcctgtaatcccagcactttgggaggccgaagccgcggatcacgaggtcaggagatcgaaaccgtcctggctaacacagtgaaaccccgtctctactaaaaatacaaaaaattagcctggcttggtgctactcgggaggctgcggcaggagaatggcgtgaacccgggaggcggasttgcagtgagccgagatctcgccactgcactccagcctgggtgacagggcaagactccatctcaaaaaacaaaaacaa

SEQ ID NO: 13158 - DNA, 378 bp, Homo sapiens
caaaacaaaacaaaaccaaaccatccatggaaatgttcctacctggacttaggatgggagacggagagttctccctgacagggtaaaagaagccttgacttggccgggcgcggtggctcatgcctagaatctcagcactttgggaggccgactcgggtgattcacctgaggtcaggagttcgagtccagcctggccaacatggtgaagccccatctctactaaaaatacaaaacattagctgggtgtggtggcacaggcctgtggtcccagctacttgggaggctggggcaggggaatcgcttgaacccgggaggcggatgttgccgtgagccgagatcgtgccactgccctccagcctgggcaacaagagcaaaact

SEQ ID NO: 13159 - DNA, 262 bp, Homo sapiens
  misc_feature 262: n=a, g, c or t
tttggggggccgaggtgggcggatcacggggtcaggagattgaccatcccggctggcacggtgagaccccatctctactaaaaatacaaaaaagttggccgggcatggtggcgggtgcctgtagtcccagctactcgggaggctgaggcaggagaatggtgtgaacctggggggtggaggttgcagtgagccgagatcgtgccacagcgctccagcctgggtgaaagaccgagactccatcccaaaaaaaaaaaaaaaaaan

SEQ ID NO: 13160 - DNA, 428 bp, Homo sapiens
  misc_feature 130: n=a, g, c or t
attattattattgttattactattttgtagaaacggggttttgccatgttgtccaagctagtctcaatctcctgagctcaggcaagtcgcctgtstcagcctcccaaagtgctgggattacaggcgtganaccatgcccgtccccagactctcttaaataaccagatctcctgtgaactaactgagtgggaactcactcatcaacaaggggatggtgctaacccattcatgagtggttgacccccttgatccaatacctcccaccaggctctaccccgtctctactaaaaatacaaaaaattagccgggtatggtggcgggcgcttgtagtcccagctacttgggaggctgaggtgggagaatggcgtggacccgggaggcagagcttgtagtgagccgagatcgcgccactgcactccagcttgggg

SEQ ID NO: 13161 - DNA, 326 bp, Homo sapiens
tattacgattactcaagaaatgcaaaataggccgggcgcggtggctcacgcctgtaatcccagcaatttgggaggccgaggcaggtggatcacgaggtcaggagatcaagaccatcctagctaacacggtgcaaacccatctactaaaaataaaaaatattagctgggcgtggcggcaggcgcctgtagtcccaactactcgggaggctgaggcaggagaatggcgtgaacctgggaggcggasttgcagtgagccaagatcgggccactgcactccagcctgggcgacagagggagactccgtctcaaaaaaaaaaaaaaaaagg

SEQ ID NO: 13162 - DNA, 432 bp, Homo sapiens
caaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaastgggaggaggaccggctcaggcccccatcccc

SEQ ID NO: 13163 - DNA, 459 bp, Homo sapiens
  misc_feature 143: n=a, g, c or t
tttagtttaactaagtgaaggtctcactgctcacaagtagcagagccagaatttagaatacaggcagtatagctctctagtgtccatgttttttttcttttgagagggagtctcgctctgtcacccaggctggagtgcagcgncttgatctcagctccctgcaagctccgcctcctgagttcatgcsattctcctgcctcagcctcccgcgtmstgggactacgggcgcccgccacaacgcctggctaattttttgtgtttttagtagagacgggatttcaccctgttagccaggatggtctcgatctcctgacctcgggtggatcacctgaggtcaggagttcaagaccagcttggacaacatggtgaaacctgtctctactaaaaakwcaaaaattagttgggtgtggcggcacatgcctatagtcccagctactcggggggctgaagcaggagaat

SEQ ID NO: 13164 - DNA, 438 bp, Homo sapiens
gttagggcctttgccagggatgccgctgcgtggagctggactgctgggaggggccaggaggggagcccgtcatctatcatggccataccctcacctccaagattctcttccgggacgtggtcaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagctgcccgctgctcggagcgaggatggccgggctctgtcggatcgggaggaggaggaggaggatgacgaggaggaagaagaggaggtggaggctgcagcgca

SEQ ID NO: 13165 - DNA, 445 bp, Homo sapiens
aaagcctcatctcttgataggtggaatgacatgtgcacattggaaaggaaataatcaatggcggccaagtttggaagattagtttgtggctataccatctattacagtatctaatcttttaatttatttacatgattttatgattaatcctctttatcttgtattttaacatgtaataatttaagtcctcttagaaattaggttataaatctcaaattaaaattattgaccttaatttaatagaagagattttgggataatgggaggcctggataaacctcttttttgtgtcattcactatatattcgtcttgtcattcactataaatttaataagtatcttggtttatttagttgcaaatcttccaaaacatctttgcttagtaattgcagctatattatgagaatttactctttcatcttagttttccctgaactggagggct

SEQ ID NO: 13166 - DNA, 461 bp, Homo sapiens
agtgagtcgsggcgccggcactggtggttgggtcagtgccgcgcgccgatcggtcgttaccgcgagsgctggtggccttcaggctggacggcgcgggtcagccctggttcgccggsttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggaggcgtggaaaaagacctcgatgaagttctgcagacccactcagtgtttgtaaatgtttstaaaggtcaggttgccaaaaaggaagatctcatcagtgcgtttggaacagatgascaaactgaaatctgtaagcagattttgactaaaggagaagttcaagtatcagataaagaagacacacacaactggrgcagatgttta

SEQ ID NO: 13167 - DNA, 85 bp, Homo sapiens
atccgggggtcgtttccaggagctgcagccctccagcctggggtctggccaggattaaccctgcttcctcccacccccgtaacca

SEQ ID NO: 13168 - DNA, 495 bp, Homo sapiens
cacgagggaagtgccaatcaaaaccacagtgagctaccacctcacccctccaggatggctgttagaaaacaaacaagcagcctgtgcagtggctcacgcttgtaaccccagcatgttgggaggccgaggcaggcagatcacttgaggccaggagttcgagaccggcctggctaacatggtgaaaccctgtctctaataaaaatacaaaaattagctgggtgtagtggtgtgtgcctgtggtcccagctacttgggaggctgaggcaggagaatcacttgaacctgggaggcggaggttgcagtgagccaagatcatgcgactgcactacagcctgggcaacagagtgagactctgtaaataaataaataaacagactggcctggtggctggtgacttaggcctataattccagcactttgggaggccgaggtgggagggtcacttgagcccaggtgtttgagaccagcctgcacaacattgagagacccatctct

SEQ ID NO: 13169 - DNA, 340 bp, Homo sapiens
ttcatggaaaaagctattcagacccctgcttggaaagctaaggcacactgccacgaagcagcaaggacgccttacaagtctcagtgcaacagagatggacacctgggctgggctggacaatgtttaaggttccttttagtccatgactcaagtgatactgttttaggctatcaggtagtaaacacgatcttagacatccccatctttgtaagcagaacagtacggcacttcaccacatctgcttcccaccatgcttctaagcagctgtcttccccctgctaatgttacaaccaaagcagccacccccacctcctctcgtgttgagcctcacgaccgctga

SEQ ID NO: 13170 - DNA, 198 bp, Homo sapiens
  misc_feature 181: n=a, g, c or t
ccagtctccctcatttgagcaatactctcatttcctctgatgtctggatgatcggcagggcaggaatctgagcgctggccccgtggtgaggccatgttctcataatcagsctccagccagaaaaataagaaacaccgcaacaggcttcagtatcagggctgaaactgctggatgaataaantatttattaaaaaccaa

SEQ ID NO: 13171 - DNA, 113 bp, Homo sapiens
atttaaaaattagccaggcgtggtggtgcatgcctgaagtcccagctactttggaggctgaggcaggaggatggcttgagcctggaagattgacgctgtggtgagctgtgatc

SEQ ID NO: 13172 - DNA, 382 bp, Homo sapiens
caattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggaaaaaaaaaa

SEQ ID NO: 13173 - DNA, 407 bp, Homo sapiens
caagaagggaacagagcacgccgaccctctccctttcccctctgtctctcttagtggctttacagtgggtaccctgtcagaaaccagcactgggggccctgcsacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctct

SEQ ID NO: 13174 - DNA, 407 bp, Homo sapiens
  misc_feature 177: n=a, g, c or t
cagatcaatatctctcatgaacatagatgtgaaaatcctcaacaaaacattagaaaatcaaatccaacaatgtataaaaagaattatacaccatgactaagtgggatttactccaggtatgcaaggctggttcaacattcaaaataaattaatgtaactcatcacatcaacagaatnaaaagaaaaatcatatgatcatatcaattgatgcagaaaaatgcatttgacaaaacccgacattcattcatgttaaatgaacaaccactctcagaaaactaggaatagtgggaaacttcctcaagttgataaaatctaccaaaaaaaccagttaacatcatacatagtggtaacaagctacatgctttccccctaaattcaagaacaagaaaattacatccactctcaac

SEQ ID NO: 13175 - DNA, 470 bp, Homo sapiens
ttttccaaggtgccgcgccaggggttgctgaggtagaggtggctcccctgctcctccttccacctctccgattccacctcctcctcgcaccccgctgggaactcctccaggggctgagattggattcwccgagcctgcggagagtggggaactgcgggcaggtcggcggagttagatggcagcaaaggtgggccggcttggtgtgataaagttccaactgggtccttccgcgagccctgggtccataagatgtcatcggcgagcgctggacttgaccgtcaacttgggattgttaaggtaaatggtgtctccttctgtcgccaaggcggtggcatggtctcggctggctgcaatctccacctccttgcttccagcgattctcctgcctcagccccccgagtagcagaaattacaggagtttcatggcagggcgcttggctggcttgtttaaattcattctgaataagaac

SEQ ID NO: 13176 - DNA, 438 bp, Homo sapiens
ccaaacattcattatcacataaggttgctgcaaacacaggaggatttacttatcttttagttcatttcgcaatctctatttgcaataattttgtgtaggttaatacagaatatgtgctattaagtaacactaaaaaggctgggcatggtggctcacacctggagtcccagcactttggtaggctgagacaggcagatcgcttgagctctggagttcaagaccagcctggacaacatggtgaaacctgtctctaccaaaaatacaaaaagtgagctggtgtggtgatgtgtgcctgtggttccagttacttgggaggctgaaatgggaggatcacttgagctccggaagtggaggctgcagtgagccgagactgtgccactgcactccagcctgggcaagaaagcagacccgtctcagggggaaaaaaaaaaaaaaaaa

SEQ ID NO: 13177 - DNA, 421 bp, Homo sapiens
tgtttttattgtttgtttgtttgttttttgagttggagtctcgctttgtcgcccaggctggagtgcggtggcgcggtcgctgttcactgcaatcttcccctccctggatcaggtgattctcctgcctcagcctcccaggtagctgggattgcaggtgcccgccaccatgcccggctaatttttgtgtttttggtggagacagagtttcaccatgttggccagactggtccggaacgcctgacctcgggtgatctgcccaccttggcctcccaaagtgctgggattacaggcgtgagcaccgcgcctagcctgaccacgtttttgattcttgcttctgttatatctgtattaaccgttcttcttagctttcgtggcagatgtgataagcatgcctttgtgtctttctctaagtcactgactt

SEQ ID NO: 13178 - DNA, 431 bp, Homo sapiens
  misc_feature 106,348: n=a, g, c or t
tkwctttgtaggttcatgccatttstaaaascctctttgttgtctttttattggaattttgagagggagttaaatgtctgtttttaatctascatctttaaaccanaattcsagctatktaatttcagcatgaagaattgcattawaaacagagcagtgaatcattttatgaataatartgctggattttatttttaaaaattatcctagcctaaaatgtttaggatcatcatagcattaagagagakttatatttggtaaggaatcataaacatcgtcagttttcatgcttaaagtatttaggatcatawtagcattaagaaagatttatatttggtaaaaaatcanawacatggtcagttttctagtggagatttttcatggcactatawatctttagtaacwagattttctatgtttagtctttgtat

SEQ ID NO: 13179 - DNA, 493 bp, Homo sapiens
caaagtgaaataattcagccgtcagatggtggaattcatctcttcaaagaggttttgccttttaaatgttcagttctaagtgattaataagtggcacacctaaaatatgacatggtaaagttgaaaggaagaaagatacaaggcaaacgctaatcaaaagaaagcgggtattacatttttgtctcagacaaaccagacttgaaggcagaaagccagataagggataaaggtcagtacttaaggaaaggggaagtaatgtaccagaatgacatcatgatgctgcgtttgtaggcgcctagcaacataagcctcgaactgtttaaaggaaaaatcatcagaattgcaaggagaaacacagtcatggtgggggagtttaatgtccctgtctgatacttgtagatgacgcagatattaagttaacaaaatgcatgcagtggacatatataaactttagcccagtcattaggaaagcttacgttcatttcaagccacg

SEQ ID NO: 13180 - DNA, 667 bp, Homo sapiens
aacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatct

SEQ ID NO: 13181 - DNA, 197 bp, Homo sapiens
  misc_feature 80,84: n=a, g, c or t
ttttaatctgatagttcaagttctttcattgtggatttttttcttttttcttttcctttcttttttttttttttwawttncmanacagggtcacttgagcctgggaggttgagactgcagttagccctctttgcacmactgsactcmagccttggtgacagagtgggaccctgtctcaaaaaaaaaaaaaaaaaaaa

SEQ ID NO: 13182 - DNA, 457 bp, Homo sapiens
aacccctgccctggtgaaagggctcccgcaccgcccggystccccatctgcctggcgttgtgcgcagagctggaaagcatggctgttgtatgtattcttgcgcccgtgtgacaacatttaaacttctaaaaacggaacctccttccgtgttaggattgcaagttaacctaggaaaaacagcattctgcaaattatttgctggaaaatctcggtgacttaaggcccatgtattactttgcaggggtctctcactctagtttactggtgtagattttttaaaaaatccatcttatcaaaaaataccgtttaaggtggaaaatttcaaatgcaagtcgcagttgatgagattgcaattaatatatttdagatagaattagagaaaaactacagtcagtgcatattaagtatttttttcatattttggggggattagatttttaacgataactttgaagtt

SEQ ID NO: 13183 - DNA, 441 bp, Homo sapiens
tttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctggggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgc

SEQ ID NO: 13184 - DNA, 325 bp, Homo sapiens
  misc_feature 198,234,264: n=a, g, c or t
akaggggcctagtgttgtccagggctgggggcactgctccaggccgtgtggaggggccctgcaggcctggtgacgcagctgctgcggcaaggtgccagcgtggaggagaggacattgaggtgctgctgggccacggggcagacccaggcatcagggacaggcatcggccgctctgcgctgcacagggctgccgccgwnggacacctgcttgccgtccagttgctggtcacccanggggccgaggtsgatrctcgggacaccctnggcctcacacccctgcatcacgcctctcgggaaggccacgtggatgttgccggytgcctgc

SEQ ID NO: 13185 - DNA, 448 bp, Homo sapiens
ttcatagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaacctcaagacggctttcttttggcgactgagggtttttctgccacaggaagctgggccgggctgctgtgcctgggaggagggaaggaggaatgagaaagcggtgacggtccctgcccccccctcgccaggtgactgtcccacccatttagttgaatgtagcggccagagaggcactcgcggcagcccgtacggtgggacctctcggtgtccttcgggaaacaggaggagcaagttcgactccagcgagggaaaac

SEQ ID NO: 13186 - DNA, 454 bp, Homo sapiens
ataaaagcagtcctgcttctcaaaggagacacccatcctggaagacctgggacaaggtagagaagaggtcttctcccctcatgccttcatggagaggctcatgctgctagacatagcaacctctgtcaggaaatgtcgcgtcttcagcccttcacgtaggcaggtttgattcagcgtcctcgtggcatttcctgttcctgcccacttgtgctcgcgcacgcgcgattggggtcggcctttctgacatcagctgtctaaccgttcttctgaagcttggtcctcgggcagggggcagggaatcgaagacctgcgtggtcacaggggaagagaagagaaaggtcccggcaagacagtgtacatctagggtcggcttccaaaggaccggcaagtgacaacacggaaaatgtgaagacaagcccagggtcgtcttctgactctccatgtgttcgtgatg

SEQ ID NO: 13187 - DNA, 197 bp, Homo sapiens
atgattctcacctggcagatctatggaaagattagctgactctttggatccctgaatatagttaatagaaatttggaaggaccatgtcaaaattaactaatgtgaactgacaaagatttggtgttcaaagcaaaaattaaactttggaaaagtgagcaagtacttaatcagaaacaaaaaaaaaaargaagggaaaa

SEQ ID NO: 13188 - DNA, 317 bp, Homo sapiens
  misc_feature 90: n=a, g, c or t
caattattaaaatcaggaacttaatactgagtaagatctgtagataatagtatatcaaatgttgccaattgagccaataatatatatrvntwgtacattatttttatgaattttaaatatattattatwttagaaattgtttctggttcaggttttcagtctaggatcaggcattccattagttgttgagtctctttagtctccttttaaaatagagccgtttttcagtgtttgtctttcttgagcttgacctttttggaagactaaaagccattcattctattgacggtccctccamttgggcttgttggaagtcc

SEQ ID NO: 13189 - DNA, 457 bp, Homo sapiens
tataaataaggggaacacagtgtgcaaagggctatgataaaacatggggggtggggggcaacaactaattctgtcaggaaggaggagggaagtctgggaaggctgggatcgtctgcactaaattttcttaccctggcaagcggaaggactgaaaggagatgagcagggagcactctataaatatgagtcgactgatggagctttgtttttaactcaggaatgaaggggtacagggacacactcaagccctttgtttcaaagtgttacgttggaccatgatgtagtcaatgtaaagatgtgtttacacaactttacaatcctgaagttgcagccattcccagcctgggattcttgagggattaggagggggctatagaatgcgtgagtgctccacaatatatccctttcagttggggctgaaggctcgtctaagctcgtagtgcctgcctcaactgtg

SEQ ID NO: 13190 - DNA, 346 bp, Homo sapiens
tttgcctaattgtcttcttcaagtgtgtcaatgctgtttagttcccaggacttgctaactacatttggtaaagagcaagcaagagagctagaagttccttcatgtggtgtgggcctgggagccgtgatggagtgttctaacaagaaagagctgtagaagatttcagcagctatcagtatgttagcccctcagttgcctcaccaccagcaccctcttttcagcaggcatttactgggcctcaagtgtgtgtgattagaaatttggttaacaggctgggcgcagtggttcgtgcctgcggtcccagcactttgggaggccgaggcgggcggatcacgaggtcaggagt

SEQ ID NO: 13191 - DNA, 455 bp, Homo sapiens
tttacttcttaagtggtgctaacaaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaadatgtgtggggtgtggtggcaggagcctgtaatcctagctactcaggaggctgaggcaggagaatcgcttgagcccaggaggcggagattkcagtgagccgagatcgtgtcactgcact

SEQ ID NO: 13192 - DNA, 486 bp, Homo sapiens
aaagtggaaggcaacgacacacggcccgtggcgccttcagctagggagaaagagaggacgggggctggcgggcgggattagctgccggaggctgagtttccgcagcctgagtctccatctgtcgctagactggagtgcagtggcgcgatcttggctcacttcaacctccacatcctgggttcaagcgactctcctgcctcagcctcccaagtagctgggactacaggtgcgcaccaccatgttcaactaatttttgtaattttagtggagacgaggtttcaccatgttggccaagatggtctcgatctcttgaccttgtgatccacccaccttggcctcccaaaggtactgagattahagatgtgagccactgcgsctagccagaaaaatatttattgatcctaaagtgggagtcagcgccactgttgmtgctagtgttgaatccagaamcatagctggacatgggatcagaggatgaacaagaga

SEQ ID NO: 13193 - DNA, 66 bp, Homo sapiens
ctgaaattaaatcgcacacccccaccatttcctctccctgggatctggaggaacatcatacatagt

SEQ ID NO: 13194 - DNA, 160 bp, Homo sapiens
gaataactcagttttaggtaagcctcccctatatcctagaataacctgcctcttcggctgggaagcggagggaaccttctcttccttaaagacagggtctcgcactgtcacccaggctggagtgcagtggtgcaacccacctcccgggttcaagcaattc

SEQ ID NO: 13195 - DNA, 372 bp, Homo sapiens
atatacaaaaagtttaggaacatggagcaaaatgtctgattcaaaacaatctaggctgggcgcagtggctcacgcctagcactttgggagttggaggcgggaggatggcttgagctcaggagtttgagaccagcctgggcaatgtagtgagaatccatctctataaaaaaatttttaaaaattacctgggcatgatggtgcgcatctctcgtcccagctacttggaaggctgaggtgggaggatagcttgagcctaggagttcaaggctgctgtgagctgtgatcaggccactacactcagcatgggaggtagagcaaaaccttgtcttaaaaaaaaaaaawtctggccgcgtacggtggcycatgcctata

SEQ ID NO: 13196 - DNA, 252 bp, Homo sapiens
ctatcgagccctggctctccgggcagctggaggggtcgcgctgcgcctgttggggctgcacctcggaccagggcttctgctgcatctgcascatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggcgc

SEQ ID NO: 13197 - DNA, 498 bp, Homo sapiens
aacaaaatgtcatttcagatatgttatagttggtttaaactggcttcaagcagtcattaaaaggtggtggtcagaactatcatccaaaacaaaattataaatgatgggtgagtatacctttaaagataaactcatgctgaaattttcttcaggaaagcagcttgattaaactaggtaataattttatcccattatcatcagtgtatggtatttattctttttatattcagagagatactaacttaagagactgttcatttgtgaaaaccacacctggaaattgaattccagagcctactaacctcctgtatctcttcttctggcacaaccctacccttcattttagaagaaaaacacaatagtggtttaattctcatattcattatgagtaagggaggaaaaagagatgcccacagtgtaataaggaatggaggcaccctgcgggtcctttacctagacattaacctgagagtccggtgttgatgtttacagttctaa

SEQ ID NO: 13198 - DNA, 479 bp, Homo sapiens
caggctttagggagaatgggatgggaagacctaacgtttatagagtcaatgtaaaatcaggtttctatggatgaagggggagaagaatgtaaagtattataagagaattattcttatttttctgcaagtctcaaattcatgttttcagttcatagatttcctcacaaatgtagcaagctagccactcattaataaatcagctacctctctagctagctagctataatactgttgatttagcattttaaaattttgatctgtataaaatatacaacataaagttctaactacggccgggtgcggtggctcacacctgtattcctagcactttgagaggccaaggcgggtggattgcctgagctcaggagttcaagaccagcctgggcaacacggtgaaacctgtctctactaaaatacaaaaarttagccgggcatggcagcgtgcgcctgtagtcccagccactcagggggctgagaca

SEQ ID NO: 13199 - DNA, 227 bp, Homo sapiens
aatctcaatagaagcctgctgtttaccctcagggaacaagtagttttcaaaattgagctcctccaaggtcattggccaatgctgtgtgcaggcattggtcatctttgtaaactcatggcattatttcctcatatgcattatgatactaagaaattcaaccccaacctgtatgaaaagcacagcccagggccctaattgaggctagcatgaatgcctttgaggggcca

SEQ ID NO: 13200 - DNA, 420 bp, Homo sapiens
cattaaatcttaaagatccaaaataattcttgactccatgtctcacgtccttggcacactgctgtgaggrgtgggctcccaatcccttgggcagccctgcccttgtggctttgcaggctgctctcctgggttggagttgagtgcctgtgactctgtgatttttccaggtgcagggtgtgagctgccagtggatctaccactctgggccgggaaggtgggggccctattcccacagcttcactaggcagtgccccagtggggactctgtgtgggagtttgtattaggccattcccacatttttataaagaaatacctggccaggtgcagtggctcatgtctgtaatcccagcactttgggaggctgaggcaggcggatcacaaggtcaggagtttgaaaccagactggtcagtatggtgaa

SEQ ID NO: 13201 - DNA, 73 bp, Homo sapiens
cttttggamaaacttggagasagtgtccaggaccttagttcatttgatgaatacagttcagaacttaaatctg

SEQ ID NO: 13202 - DNA, 339 bp, Homo sapiens
agatttttgtatttttagtacagatggggtttcaccatgttggcaaggatggttttgatctcttgacctcatgatctgascgcstcggcctcccagggtgctgggattacagatgtgagscaccgtgcccggsstactttattatattaagtacatataaaagtatatataaaatataggccggatgtggtggctcacgcctgtaggcccagcactttgggasgccaaggcgggcagattacttgaggtcaggagttcgagaccagcctggctgacagtgaaaccscgtctctgctaagaatacaaaaattagctgggtgcagtggsgggtamctgtgg

SEQ ID NO: 13203 - DNA, 230 bp, Homo sapiens
ggscgaggcaggtggatcacctgaggtcaggagttcgagaccagcctggccaacatggtgaaacctgtctctactaaaaatacaaaaattggccggacgtggtggtgcacgtctgtgatcccggctacttgagaggctgaggtacaagaatcgcttgaacctgtggggcggagattgcagtgagccgagatcgcgccattgcactccagtctgggcaatagagcgagact

SEQ ID NO: 13204 - DNA, 442 bp, Homo sapiens
aggcgattactgggcaggctcagtctttcgcctcagtctcgagctctcgctggccttcgggtgtacgtgctccgggatcttcagcacccgcgccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggagtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacct

SEQ ID NO: 13205 - DNA, 374 bp, Homo sapiens
  misc_feature 318: n=a, g, c or t
ctatcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacatctttttgtttttattttattttatttttgtttgttttctccgtgtgtgtgttttcctaatttatttacctctgtttcccctttttccttttttttttnaattaaagagcaaagctttttattactttgtaatttaaaaaactgaaaaaaaaaaa

SEQ ID NO: 13206 - DNA, 431 bp, Homo sapiens
cttctgatgttcggatgtgttcggagtttcttccttctggtgggttcgtggtctcgctggctcgggagtgaagctgcagacgtttgcggagattcacaagcctccctcccagattcagggaaggagatgcagcccccaccccttgactggaggaggaccaaggtcaccttgcagagcaccgtgagatgtggaagatgccagaactgtctgtgggaaatgggatttgtacttggcttgtctgcctcttgcaaccagagtcctggttctcagggcctcacctgtgcatctcttgttgagcacagaggaggcactcggcataaatgaagaggatgcttgctgagctggctggcccatcctctcttctttcccttgtttttctattttatstttcaaagcagtgtttcaagtgtttataaactaatctatgtata

SEQ ID NO: 13207 - DNA, 450 bp, Homo sapiens
aggaacagaaatgttgagaagggtagactgatgactacccctcagtggaaacagaccagatctcagcttatctggctggaaggaaagcaaaaaaacaaagcaaaaccaaccaaaaaatcctaagaaacaaaagacagattcaagccaatctgtgatttgtaaaataagccaggtgcaggcttgtgtgccttcagctgaatgtaagaagtccagctatcatgaagtctccatgtggacagacaattcagaggaatgagagagagagagacctgagcagctagcagtgccagcacctagatgtttgaatcttcccagcccagatacatgatggaaaaaacttcaagatgcccattggacagcaaccacatgaaagacctggagtgagaactcctaagctgagatctcactctttcagactccagagccaaataaataattattaatgtttaa

SEQ ID NO: 13208 - DNA, 404 bp, Homo sapiens
gagttttattatggacaatgtccagtgtcattgccaatactctccaaaatgatttgaccatgaagtacagggaggagaagagtattttttgaacacttgtaaatgattgcttttcttccataatagcacacatctaggtattttgcccaatttgcagatgaggcaaaaatttggagatgaatttcaaagaagtcgaacagctagatgagtgcagagatggagatttaatcaaagggagtctgctgtaaaactcctccacatgtgcaaattggccaatatgaaagcaatgaatatttgaaaattgaagttttctgctacttcaccaattttctcaagggctttgattcagttttctatatcagaaggtaaaaggcgagaggsttccatggmtgcctgtcaacagg

SEQ ID NO: 13209 - DNA, 490 bp, Homo sapiens
acagatgttaaataggaaattattacttgttaacttcttacagcagtagtaccttctttaaaaaaaaaaaagawtctgsggtattttttttaaaaaaaagtttactgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaawtacaaaaaaattagcvgggtatgatggtgtgtgcctctagtcccagctacttgggaggctgaggtcagaggatggcttgagcccaagaggcagaggttacagggtcaagatcgc

SEQ ID NO: 13210 - DNA, 171 bp, Homo sapiens
attagaacctgtttagatttaaatattcttttaaaaataggagaaataatttgtgtcagataatgctttaaatttaagatattttccctcttttttttttttttttttttgagaccgagtcttgctttggcacccgggctggagtgcagtcagtggcatgatctctgctca

SEQ ID NO: 13211 - DNA, 443 bp, Homo sapiens
cagatgtattatgtatgaactttgtactatgtatagccagagttttatttattttttaaaaaagaaactttttcttgataaaggaataatggtggtctagctagttcttgtaaaagtgatgcctcttgaaaaaaaacagtcctattcactagcttttagtaaaagaatcagatcttttctttcttgttaccttggagtcttaaaaactgattgctaaggtgaaacaattcaatgcataagtatggagctaagtgccttttggaggatttcttggaagagcatttatggagatacttaagggaggtagcaaagatttgaaccgtctgtctttttaagtaagggcagaaagcaaggttgtccaggttgtactggacacttctctccccacccctttcctgattgttttatgtgattgattttaaattctcacactgccacttctt

SEQ ID NO: 13212 - DNA, 447 bp, Homo sapiens
  misc_feature 355: n=a, g, c or t
cacttgagtacagaagtaacaacattagctgcttcgtaaacaagatggcatgggagatattctgttttgagtaaatgacaagtcctacagtctagataggaagatttctcctccatatggattttgtgatttcgtcttgtgttgagtaaggaaggggagcttggattccaagatcaatttaatgtctatattccttggcattgtcatgttagagcagcacatctcagatggctttcaatagttattttagcattgattttcctctactagagtaaatcaaaagatggtttagaaaatcaaagtcagttttccttggagttttctcagaataaagggagctgtggtgttgaagggnttttttggctcctatttacatatgatgcaartcaatctgtgtgaatctctttcctctgttgagctctactataggctctactatatgcagag

SEQ ID NO: 13213 - DNA, 454 bp, Homo sapiens
  misc_feature 439: n=a, g, c or t
tttatcagtggacaaacttcctaaaaaaattcacacactcatatctgcatataaaccaacatcataaaagtactaaaatgacactgttctgaatcatgcagtctttgcaaataacaagctggctgaaaaatatctaaatataattttratttttgaactttttcttctaattggaaaattagctcatacctgtaatcccagcactttgggaggctgaggcaggcagattgcttgaggtcaggagttcgagaccagcctggccaacatggtgaaaccccatctctgctaaaaatacaaaaattagccggacgtggtggcgggcgcctgtaatcccagatactcaggaggctgaagaaggagaatctgttgagcctgggaggcagaggttgccatgagctgagatcacggcactgtactccagcctgggcgacaagagcangaactctgtctcaaa

SEQ ID NO: 13214 - DNA, 349 bp, Homo sapiens
agaaagggaacagcagctgagctgagcagcacatgcttggagcgttcctgccatcgacttcggattatttctgctttcttgagacgcagccatcagcatgggactcgatgcagcccggagagcaccgcccgcgcasacgcgcacagaccctcccttggagacgcgctccccggcgcgtgcggccgagcccgcgtgaaatgcacagaccctccggtgaggctctgccacgtgtgaccctgagcactgcgamsccttcccttccatcctcgcgtggccacccaaagtcttgcctacacctcgtacgtgcagatgccaatkccatagaaataaatgatgtaaggacagaaaa

SEQ ID NO: 13215 - DNA, 59 bp, Homo sapiens
acacttsgssccawactaattttaattggcgtagtctagaaaactcataattacaatat

SEQ ID NO: 13216 - DNA, 491 bp, Homo sapiens
taaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccag

SEQ ID NO: 13217 - DNA, 433 bp, Homo sapiens
taatgatgtgttgttatcctttcatttctagaaatggatccctggaattagatggagtattgtgaaagtataattttaaacaaatgtttttgtagagacggggtctcactatattgcccaggctgatctctaactcccaggctcaagtgatcctattactttggcctcctgaagtgctaggattgcaagtgtgaaccaccatgcccatcctgaaggtataattattaaratgctatccagtgttcataatctgcttatctaataattcaaatgctttgtttgccctgctgaggtcagactttggcctactctgtgaatgaatcagtttttgctgttgttacggatggtagagttgagtcaagatgttaatggcccttgtccaatatggggagctagttaagaatgtcttctgattctatcctgtggagtgaga

SEQ ID NO: 13218 - DNA, 469 bp, Homo sapiens
ttttaaataagatggttagggaaggcctcacagggagggtgacatttgaacagagccttgaaggacatgaggaagcaggccagatggatcacctgggggcacagcattgcacgcagaagaaacagcaagtgcgaagaccctgagtgggacagtccctagtttgtgctggtaacagcaaggagtccagtatggctggagctgagggagagggagagtagtaggtaagatcaaagagaaagggcaggggagattgtatagggcctcatgcagtttttaggcttttaactctgagatgggactattggaaggttttgagcagagtaatgacaagatctgatgtgccttctaaaatgactgttgtggctgccatgttgggtagactatatcaggccaggggtagaggcaagagaccagttaggggagctctttcagtatttgaggtgagaggctggatgctgtggctcacgcc

SEQ ID NO: 13219 - DNA, 128 bp, Homo sapiens
caaaaatccaatttctgttcttttttgtgactagtctgctggtaacattgccagtgacagactcaggagtcaaaacatggtgactggagaaaaatacacatgctaggttgtttatttaaaaaaaaaat

SEQ ID NO: 13220 - DNA, 351 bp, Homo sapiens
acgaaacctgcttcggcggcccgaggtgggggttttgagtcggttagtggaggcagtgggagcaggatgggcggasttctgttccaaaaatttcccctaagtgcggttgacagtgtgcaggcaggcgggggtgcgcggggcggtcagcgatctgcagcttcgcgggacagagatgtaacccaactcgttcacggatgttccgcgcgccgtgtcaccggctgcgggccaggggtactcggaaggcgcgggcaggagcctggcgaggatgcaccttcccctgccttggaaaggtagaactggggagtgcgggagggtggaggtggcccggaaaagaacacctcttcgcaacca

SEQ ID NO: 13221 - DNA, 459 bp, Homo sapiens
  misc_feature 384: n=a, g, c or t
aggcgtgasaccgcgcccggctggcctgttctttattgtggccatttgtatacttgtctttaaccccttgcttgactgtaagcctcttgggaatagggactatgacttagcactttatacgcctaaccctcagcgtgtagtatgtagtcatgcttattgaatgaactgataagtctctgtatacccatacctagacttgtgtgtaaggagtggagtaagaagattaagatgaagtgagcttaagctggaaatgtgagacagcatattgtagtgattgggagcaggattctggagccaggctatcctgactccacctcttactagttgcgtggccttgggcaagttcatgcctgtaacccccgtactttgggaggccgaggccgncagatcacctgagttcaggggttcaagaccagcttggccaacatggtgaaaccggtctctactaaaaatacaaaa

SEQ ID NO: 13222 - DNA, 477 bp, Homo sapiens
  misc_feature 161..162: n=a, g, c or t
actaaattggattcaaagacagttgagcagatctacagccctgttgggtccatccgaaaatcaaggtggccagtaaggtgacagctcttttaggagccttttacctgctataatctgtctgattattggattctttactcaggtcatagcacgtatcctcnntcccagcacatagcctgcacccagcacatctgagtgtgtgttctgaccacatcactattatgtgacctcccacgctcaggtcacgaaaggatcagcaaagaagggcaagaaggcccagcatttggtgcataccaggggcaaatcagacatcacagtattctatgtactattgtgtacctctgctctgggagccaaatccctggatttagttttattcttaaccattgagggatttggttaaatgatttctcactccagctgggtgtggtggctcgtgcctgtaatcccagcactttgggaggctgaggccagcgg

SEQ ID NO: 13223 - DNA, 56 bp, Homo sapiens
ctcactcgcrcrttargargctcggrtcgttrtrgtgcgctgtcttcccgcttgcr

SEQ ID NO: 13224 - DNA, 318 bp, Homo sapiens
gcgcttgactgacaggcggcggcggcgcagttgcgagtgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccct

SEQ ID NO: 13225 - DNA, 499 bp, Homo sapiens
ctctggcccagagcgctcgggctgtcggtctagcaggggggactcccctgaggggccgctgcgggtcgccgtcttcggaggcaccggcgagggcagagcaacagcctcttcacggtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtcsccttaacccttgatgcstgttctatgggtctctagagcggaaggagcattatactcrggaaacatttgctggaaggggttatgagaattcctctctgtatgc

SEQ ID NO: 13226 - DNA, 478 bp, Homo sapiens
ataataataacaatgagattgaaaatgagggcacatggtgtgtttagggacggctgaggccagtgaatgtcaaggcagactgcatctttgacagcctcgcctcactggctcctgaaatcctcacacacaaaacagcattcttcttgtgttcttaaagtgaaaggcactgtttccctgtcacactagcaatgttgcgaagtaaatgtcatcctttcctcctccttggccctgccttctacagctagtgcccctgccagttgtttcctcagcacgtctccagcgttcctcttctcttccccctcggcacggccttacttctggtctcatcatcctatgcctgggctgatgcctttgcttcccagctgcagtcggctggggatgaatgtggggttaaggcaggcattccagatatttatagaattgttcatggttcttttcccattagccatgagttacttgagggtgaagatagtgtctt

SEQ ID NO: 13227 - DNA, 86 bp, Homo sapiens
ctktctttgctttaaattcctggcacttctttttactgtctataagakaaaacctatcataagcccaattttttttttccacttag

SEQ ID NO: 13228 - DNA, 419 bp, Homo sapiens
  misc_feature 3: n=a, g, c or t
ttntttstgtgvtattgscatccasttctccttctacccatgccatttctcatacctggaccctgaatttaacagcaacccagctgcaaacagcagccactgatgatgcagggatgcagagcagcaggagaaaagaagctgggtctctgagtgactgtgtggagcagagctgccttgccatcctgaacaacatactccttgactttagcattgcggtggactcctgaagggtattggaccggaaaaagtcattcgagatgagaccaacgtgcttagaaccaaaggtttgtttgggctgaacacaggtcttgccaggcactcaggataatagaatttggagaagagagaagaaatgtaagcccaggcaccaagabgatcagtgaatgagaaggaatgattaagaggstggaagacaacac

SEQ ID NO: 13229 - DNA, 446 bp, Homo sapiens
ttagacggacatggtggtgggcacctgtagtcccagctacttgggaggctgaggcaggagaatggcgtgaacccgggaggcggasttgcagtgagcagagatcgcgccactgcactctagcctgggtgacagagtgagactccgtctcaaaaacaaacaaacaaacaaaataggtaaaawagaaaattgaagtcatatataagctcaccttcagaaatagccacagtcagccaagcgtgttggctcatgcctgtaatcccagcactttgggaggccaaggcaggcagattacttgaggtcaggagtttgagaacagcccggccaaagctgacaaaaccccatctctactaaaaatacaaaaattagccggccatggtagcatgtgcstgtaatctcaactacttaggaggytgaggtacgagaattgatggaacctgggaggtgga

SEQ ID NO: 13230 - DNA, 517 bp, Homo sapiens
taaaaatgtgaaacttgggtttggtgttttcttctaagtgcctaaataagcaagccaggctgttgatattttagccagagaaatcggcaagccaagattaacccggatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagtttgcccaaagggtccccctctaagtaaaacaaatattcagaccacaggctttaatgtaaactgtcaaaaagtgggatgtggaggatttttg

SEQ ID NO: 13231 - DNA, 444 bp, Homo sapiens
cttcattcctacttagaaaaaggtatttagtaaaaagtattaagtaaaaagttgtgaattgcctggtggtggctataactctagttttctgttttcacccagggcatgtgagtgctgtctattaaaatgttaggtatctaacaaagccaagatatctttgagagagactttaaatcttctgtagaaggttaacaaacttctatagaaagttattctcctgcctaggcctcccacagtgctgactactgtgtgttcattaagaacaaaattcacggctgggtgcagtgccttatgcctgtaatcccagcactttgagaggccaaggcaggctgattgcttcatctcaggagtttgagacctgcctggacaacatggcgagactctgttctaccaaaaatatcaaaaaagagcctggtgtgtgcctgttgcctcaactgcttggga

SEQ ID NO: 13232 - DNA, 443 bp, Homo sapiens
taaaatctgattaaaactaaaattgagttttttgaagtctgattatcccatgaaatggaattttaaacctaattacagatggatttgcatatacttttcagcaccattgaaaagaaacttggtataaatttattaatgacatccttttctctcgtttccttggggcatgacgttagtttaggagcatgagggaggtggggagaaacaccacccttctccccgcccttccttagaattttttaaaaaactttactctgtggagaatcagttccctaggagcctggggcatagtcacactttcattctcatctttgctgctttaccggcttaggtggctgatagttttcctgaattgtttttcaatactcagagctcttgtctttcggaagatggaagaggagcatgcacgatcatagctgctggtgtgtcttccctgtcagctt

SEQ ID NO: 13233 - DNA, 455 bp, Homo sapiens
taaatagtaaatggtagctgctggtgatgattttttaaaaaattactaatagtgttgccagcatggtcattattataaagctacttagagtaatagatatattataaataacaaagggcacaagtgattaatagggatgttaataacctttttgcactaaatctgcatttagaaaaggaccaaaaagctatttgttgcaggcctgcagtgactctgagattcaaaagtaagctgctttttggcctggcgtggtggcccatgcctgtgatcccagcactttgggaggccgaggtgggtggatcacctgagatcaggggctcgagatgagcctggccggcatggtgaaacccgtctctactaaaaatacaaagattggctgggcgtggtggcggggacctgtggtctcagctactcgggaggctgaggcaggagaatcacatgaacccaggaggcgg

SEQ ID NO: 13234 - DNA, 444 bp, Homo sapiens
  misc_feature 62,369..370: n=a, g, c or t
cakaagaaggagaatgagaccagggtggtgcwgtrtgavmtgggcaaccccatgaagaagancgcccagataggaatcgcgatgttggtragcgtggggaatctggaagaggctggggaktctgtgtccttccagctgcagatacggaggtactgacctggcgagcgtgcctacccaccacccttcccccgtctgacccccgtgcagagcccctcaggtccyttccatacagaagggtctttcgaggccaggcgcggtggctcacacctgtaatcccagcacattgcgaggccaaggcagaaggatcactggaggtcaggagttggagaccagcctggccaacatggtgaaaccccatctctactaaannataaaaattagctgggcatggtggtgcgcacctacaatcccagctactcgggagcytgaggcaggagaatagct

SEQ ID NO: 13235 - DNA, 446 bp, Homo sapiens
  misc_feature 39: n=a, g, c or t
gcttcatcttctggttttcctaatagaagatggtttccnatgacttcaaccagaaggttctcaaagtgtggtctctggactggcagcatcagcatcacccaggaacatgtagaaatgcaaatttatgcaaatatgtgacccagtcctgtaatcctagcactttggtaggccaagagtggtggctcatccctgtaatcctagcactttgggaggctgaggcaggcagatcacttgatgccaggagtttgagaccagcttggttaacatggtgaaacttgcctctactaaaagtacaaaaattacccaggcatggtggtgggcacctgtaatctcagctacttgggtggctgagacaggagaaccacttgaacctgggaagcagcgtttgcagtgagccgtgattgtaccactgcactacagcctgggtgacagagtgagactgtcta

SEQ ID NO: 13236 - DNA, 454 bp, Homo sapiens
  misc_feature 200: n=a, g, c or t
catagtggaatgagccagatggaggaagaatgtggctgggaaaacaggatgcttaaacttgtagtttctggaggtggagcaatttcaggtttgacggtvcagggaatgagtggctgtactgggttgagaacaagagtcactggacatgagaagtaagcgggaagccagggtatttaaaaagggacctgtgacttctgaanccttcctagcgaggcagggaatggcttggagaggaaggtccagccagtggcaaaggcctcagtgaacgaaggggagaggaaacgaagtcatggccggttgcagtggctcacgcctgtaatcccagcactttgggaggccgaggagggcggatcagctggggtcagtagctcagaccagcctggccagcatggtaaaaccccatctctactggaaatacaaaaattagccaagcgtggtggccgcacttctgtaa

SEQ ID NO: 13237 - DNA, 452 bp, Homo sapiens
atattatactaagtgaaataagccagtcacaaagggataaatattgtatgattctagttatatgtggtacctagaatagtcaaattcataaagacagaaagtagaatggcggttgccaagagtttggtgagggggtaggagtggggagttattgtttaatgggtacagtttcagctttgcaagatcaaaagaattttggagattgcgtgcacaacaagtgaatgtactaaaactacttgatatggtttggctgtttccccacccaaatctcatcttgaattgcgattcccataatccccacatgtcgttgggggtactggtgggagggaattgaatcatgggagcagttaccctcatgctgttttcatgatagtgaatgagttctcacaagatccaatggttttataaggggcttttccccctacccttcattctcattcttctctctccta

SEQ ID NO: 13238 - DNA, 473 bp, Homo sapiens
ttcaaatgtgttttatctctaaatttgaatgtccaatctgtatttcacattgttcggtctaagctctccatttgcttgtgtttaaaactaagatattaggccgggtgcagtggcttgtgcctgtgatcccagcactttgggaggccaaggcaggcggatcacctgaggtcaggagtttgagaccatcctggccaacatggtgagacctcatctctactaaaaatacaaaaatcatctgggtgtggctgaagatgatgtggaatgagaaacaaatgtcaacataataaaatctcagttaaagtattttaaaaattcttagttgagcagctctgggggaataagggcaaatatgcttgttatgaactgcactgaaatctaccaaagttaatgtttactttgtgtagatccatttgtctattttatttatttttcccagtgaaaagtgtgttttgatagagaacttttcattctat

SEQ ID NO: 13239 - DNA, 433 bp, Homo sapiens
gatagatgtatagtacagatgtatggtacaaattaaaaccatctcattgtggttttaatttgcatttctctgatggctaatgctattgaacatttttttcatgtatttatttgctatctgtatatccttttcagtcaactatctatatttcttacgcattttgaaattggattgttcttttgactgttgaattttagttctttatagcttctaaatactagtcctttgttagatatgtggcttgtaaatatcttttcccagtctacagcttgtcgtttcattaccttaataggtcttttgcagagcaagttttacattttgatgaagtacaatttatcaacattttcttttacggatcatgcttttggtgtcaagtctaataactcttaaaagagttctgggcatkgtggctcacgcctataatcccagcact

SEQ ID NO: 13240 - DNA, 414 bp, Homo sapiens
atcaaatcgcagacatcatgtaattttgcctgactaactttgctatgcatttctaacttaggacttaaaaaaatcaccaccccattatcacttttaatacaattaacaataatttaaaaatattatctaatttgggctgggcgcggtggctcacgcctgtggtcccagcactttgggaggccgaggtgggcggatcgcgaggtcaggagattgggaccatcctggctaacacggtgaagccccgtctctactaaaaatacaaaaaatagccgggcatggtggcgggcacctgtggtcccagctactcaggaggctgaggcgggagaatggcgtgascagaagacggagcttgcgtgagccgggatcatgccactgcactccagcctgggcaacagagcaagactccatcacaaa

SEQ ID NO: 13241 - DNA, 437 bp, Homo sapiens
atttgcaatatcatttcattggctaagaggttgccccagtgctacaatgtaagcttccgtctcattttgcagtgaatgaaaacatttttccttacatagttgtgtatagcagaactagtatctatcccatggtgatgctagtaagcctgactcacaacttcaaaaagaactttgaaataaattatatggatcttatgaactgtaataatctttaatttcaacttcattatgaaaatttatggctgggagtcgtggaatcgtgcctatactttgggaggctgaggtgggtggatcactagagcccaggagttcgaaaccagcctgggcagcctggtgaaacctgtcttaaaaaaaaaatmcaaaaattagcygggtgtggtggtgcatgcctgcagcctcagctactcgggagctgaggtgggaggatcacctgagct

SEQ ID NO: 13242 - DNA, 432 bp, Homo sapiens
attctacttctgggtatgtgccagatttcagtgacttgtttatattgaataacatgtgccggagaaatggctcacacctgtagtctcagctacttgggagtctgaggcaggattgcttgagctcaggagttccaaggtgcagtaagctaagatcaggtccctgcattccagcctgggtgacggagcaagactctgtctctaagaaataaataaataacgtttaaaaagtgtggcagaagtgtgtaagtttcgaatcttgttcacaaaaggcattgcggcttattccttsssstttctctttcttttttctcctgctaagagaaaacagttgtttggttttgaagataatcagttacccctctagagaggtctaacgggcaaggaactgaggcctccacccaaaagtcggcttgaacttgccagatatgcgag

SEQ ID NO: 13243 - DNA, 89 bp, Homo sapiens
aaattagctgggcgtggcagcatgcgcctgtggtcccagctgctgggaaggctgaggcaggagaatggcgtgaaaccgggaggcggast

SEQ ID NO: 13244 - DNA, 418 bp, Homo sapiens
tcttttgactctccagaaaggaaacggattaagtactccagggaaacgtgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggcggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttc

SEQ ID NO: 13245 - DNA, 467 bp, Homo sapiens
taaaaacctgtacacagtgtttattgtggttaggaagcaatttcccaatgtacctataagaaatgtgcatcaagccagcctgaccaacatggtgaaacccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagrgcttattaaaaagatg

SEQ ID NO: 13246 - DNA, 459 bp, Homo sapiens
taaaaaaatagatttataataatagtcatcagcattcttttaaattgtgacaagttagtcttagaaggatacaaaaatgtataaaagacttgtgaatttctgacaaatttaaattaggatatgtccataaatagcaattaaaattgtttccaaagagttatttcaaagcatcacatattacaaaaaaatggtgaaaatataaatataggtcacaatttataggacttttgtatattgtgtatgtttccatagaaataggtaaaggaaataatggtttctttttgggttataggcttacagatggattttctatagcaggcgtatgttaccaaaaaaatgggaatgggctgatgcttggatattaacttaaaaatgggatacaaactggccgggcctggtggctcgtgcctgtaatcccggcactttgggaggccgaggtgggtggatcatgaggtcagg

SEQ ID NO: 13247 - DNA, 109 bp, Homo sapiens
tcgtcttctatttagagaatttcctttaaccattattttagaatgtctgcttgtgacaaatctcttggtttttcatcatctgagaatgtcttaattttttttttttttt

SEQ ID NO: 13248 - DNA, 457 bp, Homo sapiens
atttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctt

SEQ ID NO: 13249 - DNA, 485 bp, Homo sapiens
caaagaaagagatacaggataggattatcaatggcctggmtcgcagggacttatatagtatgttcctgacctctctggtggagtttaatggaaatggctttggagacaggaaatactgggttccagccttgtctctgtggcatacttactccatgaatttaggcaagttatttgtctcttcacatggtcattgagaaaatgaaataacaaatctgtatcagtaaggcacctgggacagtagcctcttgatggatattacttttctttttcccaggctgtcctgttgccatcttcacacttttgcctaaatgcagagtttgtttgtttgtttgtttgttttttaatagctagggcattatttaaacatttttgttaattgagaaatatctgaagcagtttttaaaaaaatagggagcactggccaggtgcggtggctcacacctgtaatcccagcactttaggaggctgaggcaggtggatcatga

SEQ ID NO: 13250 - DNA, 445 bp, Homo sapiens
tttacttatgaattggacagtaagtctgaattaatttcacaagattcatagcttcttttatgctgcagaaaagcccagggcaaagaataagaagaaagacattcatgtgtttattcattcaacaaacatctttgccggcatagcgtgggaggaggtcaccagacccttctcctgggagtttccctcccttctgagtgccacagatcctccctgaaatgtgtggccgtagagccgccgttgcctccatgacttagcagttctctgcttcctttgcaggggccctggcctccagtctgagtgctgacctcgaagagcccctgagtgaggaggagacagaacaccctctcctgcctctgccccgagccactaaacccagaatctccaggaaatttcgttgctgtactagtgccctcagcaggtcttcccattagtggacttctgaagc

SEQ ID NO: 13251 - DNA, 174 bp, Homo sapiens
aattgctcgcattacggsctgagstcactgcstgtsagatcagtggcaccattagattctcacaggagcatgaascctattgtgagctgcgcatgcaamggatgtagcttgcamcctccttatgataacctaatgcctgaggatctgtsactgtctcccatcacscctggatgg

SEQ ID NO: 13252 - DNA, 469 bp, Homo sapiens
  misc_feature 467: n=a, g, c or t
catcagaggcttagaggcgagtgggaagggactcagacagtgcaggacgagaaacgcccgtggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggggcaaccgctgtcatgagttacagtccttccaggatgtgcctctgaaaatggattgcatataaatgtacgcataaacaacacgtaggattgttttgtgtgctttaaaaatgctatctatgcagtggttcatgcctgtaatcccagctactcgggaggctgaggcaggagaatcgcttgaacccggggaagcagaagtcgcagtgagccgagatcgcgccattgcactccagcctggacaacaaaagcganac

SEQ ID NO: 13253 - DNA, 450 bp, Homo sapiens
agttggggcgccgcttcccctccaaacgttggggcctgcactctcaacctgctataaggaagttaaaccgcagctcaccgaggagtagggtgtctacggggcgggcccgtgtagaccagctgtgctcctcgggcacaaacccgccgtacatgccaggcctagaagcttttggctttgtggacgcaaaatctggttggagccgccttctccaccctgactctcccgcctctcctttttagaaggaaccgcactgagaaagggtatttctgaaggctcaatgcgtaggagaaggggtgggaagatgggtttgtggaatgggctgagggtggggagtggtcaggtgactgatttcatgtttattgtacagattcctaaaacatagttttactaagtgactccttaaattctgattaatgtgatttttttttttttttgagtttttgggttttt

SEQ ID NO: 13254 - DNA, 488 bp, Homo sapiens
ttaaggaaacagttggaagacaaggaaggcaacagacatagattagccatttgctgaaggttaactgggaaaagaaggatggaggaaggctataccgggggctgcagagtgcagatgtgcatgtgtaatatgggagggagctgagggtttatatgctgaggggtaaaaggtgggatggagtcaggattgaaaatgaggaagagaggccgggtgcagtggctcacgcctgtaatctcagcactttgggaggccgaggcgggcggatgacaaggtcaggagtttgagaccagcctgaccaacatggtgaggccccgtctctactaaaaatacaaaaattagccaggtgtggtggcgcacgctataatcctagctactcgggaggctgaggtaggagaatcgcttgaacctgggaggcggaggttgcggtgggccgagatcatgccattgcactccagtctgggtgacagagcgagactcccgtctcaaaa

SEQ ID NO: 13255 - DNA, 257 bp, Homo sapiens
acgttttgcgtcttgctgtgcgtgaggaagcggggatccaggtcaaggctatggaaagttccagaagcaaaaacaaaaaaagttcgggtacagcggctcacacctgtaatcccagctcttagggagatggaaactggaggatcacttgaggccaggagttcaagaccagcctgggcaacatagcaagacccagtctcttaaaagaaaattaaaaagaaagagtaaataaagttccagaagctttgctctcctcaaaa

SEQ ID NO: 13256 - DNA, 479 bp, Homo sapiens
ttgagattcagtggatcagcaatcgctacctggacttttcctccaaagaagtcaaagagtgagtggcttccagtcctggggtcagagctatgaatatawtgagggacactgaggctcaggcctctgaccagcccctctccccgcacccagtgccttttcctctccatcgggtgcacaacttattgctgcgtatgtgagggtgtatcaggtggaacatatgaaattgctaatattctacctctttgacccataaaaaatgacaacttcatagggttcaacctaacattggctaaggtggtaggaaggtatcaatttatataagctgtttggataggagccccttgggatgaagagccaggcagcaatgtgtgtccactttatacagagggatggaagtcattcatagatcacaaacactgaggtactatttggctattttgtcccatttcattcaaagtagatggattcagtcccagaag

SEQ ID NO: 13257 - DNA, 464 bp, Homo sapiens
tcaaaatataataaatttatttaatcaaaaatattaaaaagatatatagcaggaagaatggctttattggaaattcactccccaaacttaatcatattacaaattacttctataaatgcatattgtacaaaataggaatagatctgatgcagtcatgattccactgaatgagctgggtccttccaagtgctcctggtagaggtgggctgcagtttgcagaagaaagaaaatattaaggcttaagaatcctggccgggcacggtggcacatgcctgtaatctcagcatttgggaggctgaggcgggcagatcatttgaggtcaggatttcgagaccagactggccaacatggtgaaaccttgcctctaccaaaaacacaaaaattagtcaggtgcagtggtgcacacctgtagtcccagctacttgagaggctgaggtatgagaatcgcttgwaacccgggaggc

SEQ ID NO: 13258 - DNA, 469 bp, Homo sapiens
attgagggtgattaaagttaaaaagatgaatctaagagggacataacgattatttacctggtggatcctgactagtagaattattgtattggtagggagtctgtgacgtgcttttcctcagtgatctgtaggatcaaaatcaggtctggttaagccctgtttcctggaggaccctaaactgaacatgaaattgcagtaatcataggggatctcttccctccgaattttccggagctcttccccaagaggatccgtgaagactagtgaggaggaagcagctgctctattaggggaggaggggagttccttgccagctcttgacttctctgtttcatccttcagccaacagtgaagtatgagcgacascagagtacctggatgctacaggtggaacctgcacccctatcaaatggagggcctgaattggttgcgcttctcctgggctcagggcactgacaccatcttggct

SEQ ID NO: 13259 - DNA, 184 bp, Homo sapiens
actcccaagatsgcggacctactggsctccatcctgagctccatggagaagccacccagcctcggtgaccaggagactcggcgcaaggccgagaacaggccgcccgcctsaagaaactcacaagagcaagasaaacaacagaaagtcggagtyycgtaaaaggatggagaaggaggtgtcagat

SEQ ID NO: 13260 - DNA, 475 bp, Homo sapiens
taagaacgcatggacacatagaggggaataacacacactggggcctatcagagagtggaagctgggaggagagagaggagcaggaaaaatacctaatggctactaggtttggtacctgggtgacgaaatagtctgtgcaacaaacccccatgacacaagtttacctatgtaacaaacctgaacatgtatgtacccctgaacttaaaagtgaaaaaaataaaaaatatatatacacaagtcattataatataaataataataattgataatagadagtacaccgtgctatgcaaatgcaaaaggaggatgccttcatggggaagatggtaaatctcaaggggaagcattaagcacgaaaatctgttataattattggagaaccaagatattgttagtatttaatgaaaacagaatcctgaaacacatcattactgcagaaacaataaagaatttttatccagcaaaattaaacagt

SEQ ID NO: 13261 - DNA, 289 bp, Homo sapiens
acactgctggttaactgcttcggaagaggacagcccgcagtctggagtgagcagcgamsagagaaaaggagacggcctttcggacaagggactggttggtttgttcttgtgcagagaacccactcgctcactctcaaacggtagctgttcggtttatttgtccttttgcagtgtatccggagccccactgtgtgcacgcacttgcttccggcagagatcctgcccttcaggagcaactaaacttgttgcaaataaagtgctgtgaaagtgcaaaaaaaaaaaaaaaatc

SEQ ID NO: 13262 - DNA, 238 bp, Homo sapiens
gattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccaccagtgcccactcaaagtttcttacggcataggcgaggaggagcatgatcaggaaggccgggtgattgt

SEQ ID NO: 13263 - DNA, 475 bp, Homo sapiens
tacagacttgtttaattattctcatcattattagagaaaatgaagtaccttgtggttccatttttagagaatttgggggaaagcaggaaaaaatacattgtagtgataataaaaatatctaatactgtgtactattattatccacaggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagcc

SEQ ID NO: 13264 - DNA, 94 bp, Homo sapiens
catagctggagtttgaagctttgaagcaaaaatatctgtagaacatcttaaacgtgaccaaaatatgatgttaaaatcagcaactctttatacg

SEQ ID NO: 13265 - DNA, 467 bp, Homo sapiens
cgggttgcttttaaaattatagtccttatcaatggaaactccagatttctttatcaaagggaggtgggtgggcatgaatctagttggaaaaggggacttgaagctaagtttacatggcactttaagactgagaacatgtcaattgttcataatcaggaatatggtagagggagagcaggtgtagatgatgggacgggaaagtgctgaaaccagcccagcagacctgtgagtcgcctctggttctcacgcagcagtgtgtgtgtgctcacagggatgttccacccctggttctcatgcagtagtgtgggagagtgctgaagccggcccagcatgcctcttagttgcctctggttctcatgcagcagtgtgtgtgcttacaggagtggagatgatgggatgggagagtgctgaagctggcccagcatgcctctgagtcacccctggctctcatgcagcagtgtgtgtgc

SEQ ID NO: 13266 - DNA, 197 bp, Homo sapiens
akctgggagttgaagagcsgatgggcagcaggcagacttgagtctcctttctgtcsatgggctcgggccactgtctcaggtccacccgtggctccaaaatggtctcctaggtccgtgatagsaaagatccaggaaatactgcagaggaagatggtgcgagagttcctggccgagttcatgagcacatatgtsatgat

SEQ ID NO: 13267 - DNA, 482 bp, Homo sapiens
gcggcgtcgccaggaggagcgcgcgggcacagggtgccgctgaccgaggcgtgcaaagactccagaattggaggcatgatgaagactctgctgctgtttgtggggctgctgctgacctgggagatstgggcaggtcctgggggaccagacggtctcagacaatgagctccaggaaatgtccaatcagggaagtaagtacgtcaataaggaaattcaaaatgctgtcaacggggtgaaacagataaagaactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctg

SEQ ID NO: 13268 - DNA, 399 bp, Homo sapiens
actccggcatttgcagcagagcgaaaggtggtggagtcctgaaggagggcctgatgtcttcatcattctcaaattcttgcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcat

SEQ ID NO: 13269 - DNA, 404 bp, Homo sapiens
  misc_feature 323,400: n=a, g, c or t
gagacatcccctgagaaggccagggtcagactggctgggctgcaasagccggagtgcctgcsgtgttcctgcagtttccagtgtgagctgcagaggagagacagccactttgtcctgaccacctggccgtgggccctccctgtagagccacactgcaggaaaacaaggctgcttcagcccagcgagacccatcttgcctgggtgccacctcccagcctggatcagcactcggagctcccacctgcctcccaggggagtgggcatccaccctgagcacctggttctaggaatttcccttcctttcatttctgaggcagtgccgnccggcttggcatctcatgctgtctcacgttccgcagctggtctgggcccaagtgctgaggactcagggatccctganaccg

SEQ ID NO: 13270 - DNA, 215 bp, Homo sapiens
aaaagctctcaacttcgggagctgaggcgcaggctggccagagcgtggagaggaaagccctttccatcctcaaggccgttgcaggagatgcccgcragccaccttcgccagcaccacaccggggtgtaatggataggtaacagagaagacctcgtcccttcctagtcagggcatcagcatgactgartgcttcctgccccccaccagcagcccca

SEQ ID NO: 13271 - DNA, 367 bp, Homo sapiens
  misc_feature 177: n=a, g, c or t
tactgcaacctctgcstcccgggttcgggctgaggcaggagaatggcgtgaacccgggaggcggasttgtagtgatccgagatcgcgccactgcactccagcctgggcaacagagtgagactctgtctcaaaaaaataaaataaaataaaataaaataaaataaaataaaatadaancacttaawatcaagctaatgtgattatccttcacaatagcactgcgattagaagtttatatgatgatcatgttaagatgaacatggggattggggtgctaactttatatatatacacacacacttatatacatatacatatgtatatataaagwtctctatctatctatctatctatctatctatctata

SEQ ID NO: 13272 - DNA, 465 bp, Homo sapiens
tttagtagagattgggtttcgccatgttggctggrstggtctcgaactcctgacttcaagtgatccgccttggcctcccaaagtgctaggattacaggtgtgagccaccatgcccaaccataaaagccggtttaatttaggggagttggccaaattctttcataacctaacaccactcctgcagagttctttccaaaatattagctggtacaaaatgctccattctctcgtgaagcactaagagcttggttggaaggctggtgataccatgctaatgctgtttggcttctggttaactcctttcctcccctctccttgacagcttctacccaagcaagatcctcccacggctggataaaaaccacaaccatagcttcaaactgtgcttagtagtgtgactaggttgtggatctcttggtggtacaagtattcagagtcccttggtcaaaagcagtggtagggact

SEQ ID NO: 13273 - DNA, 199 bp, Homo sapiens
gttttagggagggagagcggcctgggtcctgggtgttgtgtgcggasgtgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgt

SEQ ID NO: 13274 - DNA, 322 bp, Homo sapiens
caacaatgtaaatttgtttaaagaatatgcaggatatggccgggtgcagtggctcacacctgtaatcccagcactttgggaggccaaggcggacggatcacctggggtcgggagttcaagaccagcctgaccaacatggagaaaccccatctctactaaaaatacaaaattagccgggcatggtggcacatgcctgtaattccagctacttgggaggctgaggcaggagaatcgcttgaatccgggaggcagaggttgcggtgagccgagatcgctccattgtattccagcctgggcaacaagaatgaaactctgtctcaaa

SEQ ID NO: 13275 - DNA, 419 bp, Homo sapiens
aasaaattcctagaaacattaactatcaaaatggactcaagaagcaagaacatctggagagacaaataacaactaatgagattgagttagtaatcaaaatacttccagcaaagagaagcccaggaccagattactttactggttaattcttccaaattttaaaagaggaattaatagcaatacttctcaaactcttccaaaaatcaaagaaaatattacttcctaactcattctgtgaggccatcattactctcataccaaaaacggaaaaagatattacaaaaaaagaaaactgtaaaagcccttgacaaaataatgacaatatccagcagtatattaaagaggattatacaccctgaccaagtgttctttatcccagcaatgcaaggttggttcaacatatgaaaatgaattaatac

SEQ ID NO: 13276 - DNA, 432 bp, Homo sapiens
  misc_feature 412: n=a, g, c or t
ataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccanatgccyttttttatgaccca

SEQ ID NO: 13277 - DNA, 466 bp, Homo sapiens
aggccccggcttgctcaccacccaactcatacccgcctcatcggctgttcacacgtgcacttcctgaactaccacattctacagtgataataatgactgagttctgtcttattcggtaaagctcttgggtacagtggtgatcatgttacacacatatcaagtggtgtgggaaaaaagcatccagaaggcaatttcaagcatgcaaaatgggatcactgacatggaaaatcagtgacatctgattcccattgtgccagccttctgtaaatatgtaagtaagtggaattttgtcaraaggttcttagctattatgaattaccattgcattttaaagatcaaaatttctaagagagttttaggaaagccttgcacattcatagttgtgttttttagctcatactgcttcttgaaacccaagcattttgaaacttttgggatgctcctgggtatgtagcttaaaattgtt

SEQ ID NO: 13278 - DNA, 351 bp, Homo sapiens
agacccgctcccgaaaccttgtcgaaggaccaaaggcgaccggtgcaggtgcacgacgccagctcccttctggggggccggggctgggggttgccatggcscccagccacctgtcagtgcgggagatgagggaagatgagaagcccctggtgctggagatgctgaagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggctctcgaggtcagcctctccaacccctacctcagctcct

SEQ ID NO: 13279 - DNA, 465 bp, Homo sapiens
gacattttgatttcagatctaaataactggtctcaacacaagacagacatccccccaggtagtgtataagagaagtcgctcatagtttggtagaaatgccctctcagcacctccacctccctttgctctaatttgtcatgatgaggcatgggcagcactcacacagaacaggtcattcctcctttcaacgagggtttgcagggccaggccctgtggggtgctgaggatgccagggaaggtagggtatgagccctgtttccggaacttcctgaggagtggctggctccagatcgggctggccaggcaaggagacaggcagttccggtgctgggcacacacagcccatgtcaggatgtaaccaaagcatgggaccgggaactagggcaggaaggcaggaccaggaactctggtttgtaggatctggagcaagtcaaaggtgagggcaggaggtgagcagctctgaga

SEQ ID NO: 13280 - DNA, 434 bp, Homo sapiens
atcgcattaggttcttttttttaaatttgttcttggtttggttagtttttggccagtgttgggggtgggagggttggcagcaatgcagttggtcttgcttttttaacttttatccttatttttgttatggaaaagtttaaacataagaaaatcctgtggccaggcacggtgggtcaagcctgtaatcccagcactttgggaggccaaggcgggcagatcatctgaggtcaggagatcgagaccagcctggccaacatggtgaaacccgtctctagtaaaaatacaaaaattagctagggcatggtggcaggcacctataatcccagctactcgggaggctgaggsgggagaatcacttgaacccaggaggcggagattgcagtgagctgagatcgtgccaccacactccagcctggacaacagagcgagactct

SEQ ID NO: 13281 - DNA, 202 bp, Homo sapiens
ctatgctggataatggattctcaggaatggagtggcacctgaccttgaagtcatatagaagctcgtatgaggccaggcacagtggctcactcctgtaatcccagcactttgggaggccgaggcaggtggatcatctgaggtcaggagttcgagaccaggctggccaacatggggaaaccctgtctctactaaaaatgcaaaa

SEQ ID NO: 13282 - DNA, 72 bp, Homo sapiens
acctaacttgcgcagaaaacaagatgagattggcatggctttatttgttttttttgttttgttttggttttt

SEQ ID NO: 13283 - DNA, 341 bp, Homo sapiens
tgattatttttttaagttgaatggtgtttagtgtgcccatgttcataacagcatattattcacaacagccatacaggctgggtgtggtggctcatgtctataatcccagcactttgggaagccaatgtgggcagattgagtccaggagtgtaagggcaatatggtgaaacctgtctatacaaaaaattggccgggcttggtggtgggcacctgtagtcccaattactgggaaggctgagatgggagaatcgcctgagcccaggaggtcaaagctgcagtgtgccttcattgtgccactgcactttagcctggacgacagagtgagaccctgtgtcaaaaaa

SEQ ID NO: 13284 - DNA, 442 bp, Homo sapiens
gttgtagagatgggttttggaaatgatagttgggtcttgaaactactattggagtgcaaatgcctcctccctcatttggcggagaaacgtcaaaaatcctcagaacggaagaatccattctctttattttgggacacagcctggtaaaacttgtaagaaattatgacagctctgtgggaagcaagtgcaagtgtgggagaagcaagttgatgtgtgaagcagacatcagtgtgtgaaccagagtttatttgaacagtagtagttgctggtggcagaatgttaaaaatgtgagtattaagagtattaatgatgtgactattaagacttggattagtgttgaagaaatgtgaacttgaatagatttgctatgaaagtcttcggattttttttcctgtaatggattttatttcaatttcagttcactttatatgagtctccctgg

SEQ ID NO: 13285 - DNA, 441 bp, Homo sapiens
atttccgtagaaggcgccggccttggaggcgcacgtcccttgcggcggcgggagagaaatcgcttggacttcggggcggcctcggactgccatggcctttaccctgtactcactgctgcaggcarccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgca

SEQ ID NO: 13286 - DNA, 303 bp, Homo sapiens
atctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaaaaaaaaaaaaaaa

SEQ ID NO: 13287 - DNA, 305 bp, Homo sapiens
acactcaattttccagcccccagtcctgtagacatcctgggtgtgcggcacacatcggctcactcacactgaccctctgagccggtgagaactccacaagaagagggcsagsgcctcacaagatcaaggcggaacaacgcgtttgtgggatgatgaagacctcataacagacgtgccagtgggttgattactgtgaaattctcaactgtggtttctgtaacttaaaaaaaaaaatttcsactttgggaggctaggcgggcagatcacgaggtcagaagatcgagaccatcctggstaacacagtg

SEQ ID NO: 13288 - DNA, 455 bp, Homo sapiens
accgtgggtcggaccctgtggctggatgaaagcgcgctcgttcgtgccacaccctaggagtctgaagcctcagttatatcagtgaacgtgtccctgaaacaagatcgaagaggggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaa

SEQ ID NO: 13289 - DNA, 455 bp, Homo sapiens
  misc_feature 373: n=a, g, c or t
taatttacttttaagtaagtacttaaaaattaataaaactggagactgcagggaattaaacagatctgagttttcttatatctttttttatataaagaaatggattttcagtagagtcacaccatagcagtttcactgctttttgattaatgaaactattaagtgagtccccacaggccacaaagcctgaactttaaaggtagaaaaaatcataaatgttagtggtttttagtcatggactggcctggggttaatggttttctgcaaggttgctctcagtgccaacttataattgaagttttgttcagagccatttttctttcaaaaagcagttgataaatgcggtttttattttccttaggtaacaaaagangaaagaacttttcaagaaattatgaaaagttataggaatcagccccaagctaatagtcacgtgagttacattatttttccta

SEQ ID NO: 13290 - DNA, 487 bp, Homo sapiens
aaatctgtgagcacaaggctggagaaaagttacagattaacagcatctcaaggcaaaaccgttgttcagggtacagatcaaaatggagtttcttaagtcttccttttctaaatagacacacttgtgataccctaacttgtattaacctgattgactctctcttagctgagaaacctgaacggactccatttggctccttcatttgcaagacatcaagggctccttacccacccccttcctcaaggaattaacttgtgcaagctgactcccagcacatcaaagaatgcaattaactgataacatgctgtggcaagctatgtccgcagttcccaggaatttgtccagttgatattaccctaagcccctgtgtttttgtctggttgatagcacccaaagcccagcgtctatcaccttgtgatggatttaaagcccctgcacctggaactgtttgctttcctgtaaccatttgtctttttaacttcttttg

SEQ ID NO: 13291 - DNA, 269 bp, Homo sapiens
  misc_feature 88,206: n=a, g, c or t
acagagcaaaaatctgtctaaaaaaaaaaaagaagagastggcacatccatacaatggatgagccaactkttaaaaaaaaaagawtgnggggctgggcgtggtggctcacacctgtaatcccaggactttgggaggcckaggcgggcggatcatgaggtcaggagatcgaraaccttcctggctaacacggtgaaacctgtstctnctaaraatacacacgcacacaaaawtyagctgggtgtggtggcaagmacctgtattcccagct

SEQ ID NO: 13292 - DNA, 313 bp, Homo sapiens
acatgaaaaacagcagttagggccaggcatggtggctcacgcctgtaatctcagcactttgggaggctgaggcaggcagatcatttgaggtcaggagtttgagtccaccctggccaacatggtgagacctcgtctctactaaaaatacaaaaattagctgggcatagtggtgcgtgcctgtagtcccagctacttgggaggctgaggcaggagaattgcttgaacccaggaggcagaggctgcagtgagctgagatcatgccactgcactgcagcctgggtgacagagtgagactctgtctcaaaaaaaaaaa

SEQ ID NO: 13293 - DNA, 200 bp, Homo sapiens; identical to SEQ ID NO: 11569

SEQ ID NO: 13294 - DNA, 433 bp, Homo sapiens
gccggtagccatcttcgtgcatagcttgcaacaccatgaaaaaattactgagacactaggaatgctgtgaactgagaaagtttgggacctttggcataactaaatccttcatttaacagatggagtctcagtctgtcactaaggctggagtgcagtggcgcgatctcggctcactgcaacctccacctcccgggttcacgcgattctccagcctcagccgtccacgtagctgggactacaggtgcatgccaccacacccagtgttgtgaaccacttgtcatgggataaccaaaattaaacctggaatcgcagaagaaacaaattttttgaagaaattggatgtacttttttaaaatttttcattcaactaaaactttgttaactgtttcttggttgtggtcttctctaaattgtaatctttggcattcacttc

SEQ ID NO: 13295 - DNA, 171 bp, Homo sapiens; identical to SEQ ID NO: 11926

SEQ ID NO: 13296 - DNA, 269 bp, Homo sapiens
agttcccagtcgcggccaaatcacgcctcagccacctcccgcaagcctctsactgcctcagcsrcgctttcsaggctggtttctggtccccatccgsggmwggtscggccctgggaccgaatcacttcccagcgagaggaaggtcaaatttmtcgaccggctacggaaggtcgsggccgsagcmctgtcagccgcstcgggsccccaggacccctcgggtctstttaaccggaagcggaagtgcgtgtcggsgggatcatggcgacttt

SEQ ID NO: 13297 - DNA, 192 bp, Homo sapiens
aatacagaaagttggccgggcgtggtggtaggcacctgtggtcccagctactcgggaggctgaggcgggagaatcgcttkggctcgggaggtggaggttgcagtgacctkagatcataccactgcattccagcttgggtgacacagcaaggctccgtctcaaaaaaaaaaaatgttgatagcmcttattatt

SEQ ID NO: 13298 - DNA, 474 bp, Homo sapiens
ttcataaaacttcttgaaagttgcctcatccccgtaagctaaaactgttaaacaaaatgaaaatatttagagcatataacagcctcttttgctggaaggttttatagaaataaagttgccagcatatttttagaagagtaactgctccctgacaccagaatggcttattttgaaaaataagccaaaacaaatatacccttagataggtgtctataatattccagcaaagggattgggataggaaattcctacccatccctgtttttgctttggatgaaaacagtcttaagaggtttcaattgatggaaaagattagtatacatcatttcattggccagacgtggtggcgtctgactgaaatcccagaactttgagagccccaggcaggcggatcatgaggtcaagagatcaagaccagcctggccaacatggtgaaaactcgtctctactaaaagtacagaaattagctgaatg

SEQ ID NO: 13299 - DNA, 87 bp, Homo sapiens
tsaagaaaaaaaatttttttttttttggaagaatttgaaagskgctgatccagagtcattacctttaagaaaatgggmcgggcatgg

SEQ ID NO: 13300 - DNA, 75 bp, Homo sapiens
tatacatatataatattatatatatttbgtctgtttgtagttttattactagatgatttttccsgttgtccttaa

SEQ ID NO: 13301 - DNA, 449 bp, Homo sapiens
gcactgacatgsccgtcgcccgggtccgcgcgtccgccgcgcccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggmctgcaagcatccgggtcggctcctggccggagcaagatggctgagggcgagcggcagccgcgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaasgggaag

SEQ ID NO: 13302 - DNA, 300 bp, Homo sapiens
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttgttatcacaccactgcactcctgcctgggtgacagagcaagagcctgtcgccaaaaaa

SEQ ID NO: 13303 - DNA, 338 bp, Homo sapiens
  misc_feature 132: n=a, g, c or t
taattaaatttcttttaaaagtcttcgattttgggtagaggccccccagtttttttctctttttttttttgagatggagtctcactctgtcgcccaggctggagtgcagtggcacgawtctcagctcactgnaatctccgcctcccaggttcacgcsattctcctgsctsagcctcctgagtagctgggactacaggcacccaccacsatgcctggctaattttttggwattttaagtagaagcggagtttsacsatgttagcsaggcatggtctcgatctcctgaccttgtgatccgcctgcttcggcstcccaaaggsctgggattacaggcgtga

SEQ ID NO: 13304 - DNA, 423 bp, Homo sapiens
  misc_feature 193,206,316: n=a, g, c or t
tttgcctgtgacgtcacaggatcgcgcccgcttttctctcgggtgatccggccgagtggcctgggttagcagctgctgcatttccccggctggctgcggtcactggtggcagtgctcaggcgcccgccgcccttgaccttcggccccgcgagctstaaccctacagcgcaggaagatcggscgccgcggccangctctgatgctgnbtgtctggtagaagaaggttactcacagttctgctgcaggctcagaagtggccctttcaaccctccagagacatgagactagtgcagttccgggcacccacctggtgggnmctcacttgggcctggagacagggaatgctggaggggttatcaacctcaatgcctttgaccccacactcccgaagacgatgacgcattcctagagcagggagaggcc

SEQ ID NO: 13305 - DNA, 250 bp, Homo sapiens
aaagacacaatccatgaaagaaataagaagtaacctggacctcacctattagaatggccaaaacccagagcactaacaccagcatatgctgaggaggatgtggagcaacaggagctcccattcactgcaggtgggaatgcaaaatggcacaggcacttcagaagacagcctggcggtttcttacaaagctaaacatactcttaccatatggtcaagcaattgcaaccttgttgatttaccaaaaggagtt

SEQ ID NO: 13306 - DNA, 200 bp, Homo sapiens; identical to SEQ ID NO: 11569

SEQ ID NO: 13307 - DNA, 461 bp, Homo sapiens
aataaatatttgtgcacaagtatttgtgtagacatgtttgcatttctcttgggtatatacctagaagtgaaattgctggataatatgtttaactatttgaggactgatagactactttgtaaagtggccaacatgagtaagttttcatcacatttataaaatgttagtgtacttacattagcttgcaaagcatttaataagcagcaagagttaaaccacgttggtccaagtgaactgaaagcagacttctgtgttacatgtgtatgagttactgaacatgttccataatacaggagtgtgagcacactaacaggtaagtgcaggaaaacaagaagaaatattttcagagtatagtcaaaagtacactgagcatgggagaattgttttgacattttgctcaaaactatttctgaagaaaaattcaacatttctttcacggaaagttttaggaacaggtaaat

SEQ ID NO: 13308 - DNA, 304 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccaccccaaaa

SEQ ID NO: 13309 - DNA, 140 bp, Homo sapiens
tgaatataattagtctcatttgaaatttagtagctgaacatatactgtattaattaacaatactggtcaggcacgttggctcatgcctgtcatcccagcactttgggaggccggggcaggaggatcagtcaagaccggga

SEQ ID NO: 13310 - DNA, 236 bp, Homo sapiens
tcaaagataaagaaaagatcctaaaagcagcaagagaaaagaaacaacatacaatggagctctaatatgtctggcagcagacttttcagtggaaaccctacaggccacgagagcggcacagcatagtcaaagtgctgaagggggctgggcgcggtgactcacacctgtaatcccagcactttgggaggccgaggtggacggatcacaaggtcaagagatggagaccatcctagcca

SEQ ID NO: 13311 - DNA, 325 bp, Homo sapiens
  misc_feature 199: n=a, g, c or t
catataacctttaaaaaataccatacatatttatgaatgcaatgattaaaaccagctataggagtackgctggcgtggtggctcatgcctgcaatctcagcactttgggaggcagaggcgggcggatcactcgaggtcaggagttcaggaccagcctggccaacatggtgaawsctgtctctactggggatacaaaaantagctgggcatggtggccgcacgcctgtaatcccagctacttgggaggctgaggcaggagaatcgcttgaaccccggaggcggaggttgcggtgagcggagattgcgccactgcactccggcctgt

SEQ ID NO: 13312 - DNA, 415 bp, Homo sapiens
caaagggaaaaatgcaaaamttggctgggtgtggtggctcacacctgtggtcccagctacttgggaggctgaggtgggaggatcgcctgggcctggggaggttgaggctgcagtgtgccatgatcgcgccactgcactccagcctgggcaacagagtgagacccccctatctcaagaaaaaaaaacccaaattttgtttcataattatgtaaattaggcctgggcatggtggcttatgcctgtagtcccaacactttgggaggccgaggcgggcggatcacttgaggtcaggagttcgagaccagcctgagcaatgtggtggaaccccatctctaccaaaaatagaaaaaattagccatgcacgcctgtggtcccagctacttgggaggctgaggcaggaggatcgcttgatcct

SEQ ID NO: 13313 - DNA, 370 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagcsggscgcasagtgcacgcctgtaatccctgctactcgggaggstgaaacaggagaatcacttgaacccaggagacggaggttgcggtgagttgagattatgccamtgtactccagcstgggtgacagagcgagactcagtctcaaaaaaaaaaaaaaa

SEQ ID NO: 13314 - DNA, 83 bp, Homo sapiens
gttttttatgcgggattaagcttgctgctgcgtgacagcggagggctaggaaaaggcgcagtggggcccggagctgtcacccc

SEQ ID NO: 13315 - DNA, 386 bp, Homo sapiens
  misc_feature 366: n=a, g, c or t
attaatcatcaagaagacgtaacaggccaggcgtggtggttcacacctgtattcccagcattttgggaggctgaggcaggagaatcgcttgaactcaggaggcagaggttgcagtgagccaaagttgcaccattgcactccatcctgggcaatgagagtgaaactccgtctcaaaaaaaagagaagacataacaatcaaatatgtgtcaacataataaaagaaattcagggccgggcgcggtcgttcacgcctgtaatcccagcactttgggaggccgaggcggacagatcacgaggtcaggagttcaagaccagcctgactaacatggtaaaaccccatctctactaaaaatacaaaaattagcnggvcgtggtggcacacgctt

SEQ ID NO: 13316 - DNA, 208 bp, Homo sapiens
ctttctacatatggccagccagttttcccagcaccatttattaaacagggaatcctctccccattgcttgtttttctcaggtttgtcaaagatcagatagttgtagatatgcggcgttatttctgagggctctgttctcttccattgacctatacctctgttttggtaccagtaccatgctgttttggttactgtagctttgtagtat

SEQ ID NO: 13317 - DNA, 142 bp, Homo sapiens
caggaaaacaaacaaacaaacaaaaaaacagaaaacgaggccgggcaaggtgtctcacacctgtaatcccagcactttcgaagactgagacaggcggatcacctgaggtctggagttcaagaccagcctggccaacatggtg

SEQ ID NO: 13318 - DNA, 314 bp, Homo sapiens
  misc_feature 241: n=a, g, c or t
tgtcaattttgtttatcttttcaagaaactaacttcttggccaggcacagtggctcacgcctgtagtcccagcactttgggaggctgaggtgggtggatcacttgagggcgggagtttgagaccagcctggccaacacagtggaaccctgtctctactaaaactacaaaaattagccaggtgtggtggcacatgcctatagtcctggctactcctagctactcaggagactgaggcacaanaattgcttgaacctgggaggcggaggttgcagtgagccgggatcgcaccactgcactccagcctgggcgacag

SEQ ID NO: 13319 - DNA, 355 bp, Homo sapiens
  misc_feature 213: n=a, g, c or t
caaactctcttatgccctggcaagccaatgaggataccctttgasaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagcngggcgcagagtgcacgcctgtaatccctgctactcgggaggctgaaacaggagaatcacttgaacccaggagacggaggttgcggtgagttgagattatgccactgtactccagcctgggtgacagagcgagactcagtctc

SEQ ID NO: 13320 - DNA, 319 bp, Homo sapiens
ttgaaaaaataggacaagaacttatttttaaaaagaggccaggtgcggtggcccatgcctgtaataccagtactttgggaggccgaggtgggcggatcacctgagatggggagttcgagaccagcctggccaacatggtgaagccccgtctctactaagaatacaaaggttggccgggcttggtggcgggcacttgtaatcccaactactcaggagtctgaggcatgagtgtcgcttgaacctgggaggcagaggttgcagtgagctgaggtcacaccgttgcactctagcctgggagacaagagggaaactctgtctc

SEQ ID NO: 13321 - DNA, 382 bp, Homo sapiens
ttggagttttgctcttgttgcccaggctggagtgcagtggtgtgatcttggctctctgcagcctccgcctcctgggttcaggcgattctcctgcctcagcctcccaagtggctgggattacaggtatgcgccaccatgcctggctaattttgtgtttttagtggagatggggtttctccatgttggtcgggagtttgagaccaccctggccatgatggtgaaccccgtctctactgaaaatacaaaaattggctgggtgtggtggtgcacacctgtaatcccagctacgtgggaggctgaggcatgagaatggcttgaggtcagcagatggaggttgcagtgggccgagattgtgccactgcaatccagcctagatgacaga

SEQ ID NO: 13322 - DNA, 375 bp, Homo sapiens
caattttggatctttcctgctttctcttgtgggcatttagtgctgtaaatttccctctacacactgctttgaatgcgtcccagagattctggtatgttgtgtctttgttctctttggttttaaagaacatctttatttctgcgttcatttcattatgtaactagtagtcattcaggagcaggktgttcagtttccatgtagttgagtggttttgagtgagattcttaatcctgagttctagtttgattgcactgtggtctgagagacagtttgktataatttctggtcttttacatttgctggaggagagctttacttccaagtatgtggtcaattttkgaataagtgtgatgkggtgstgaaaaaaatgtatat

SEQ ID NO: 13323 - DNA, 85 bp, Homo sapiens
cctttcttccttttggtgcgagcttgctgtggtttttgctctgggtcctctgggaatggcgcctggmtgtggccgcgtggtctct

SEQ ID NO: 13324 - DNA, 467 bp, Homo sapiens
  misc_feature 430: n=a, g, c or t
gcgggcagatcatgaggtaaggagatcgagaccatcctggctaagacggtgaaaccctgtctctactaaaaacacaaaaaattagctgggtgtggtggcagtcgcctgtggtcccagctactcgggaggctgaggcaggagaatggcgggaacctgggaggtggagcttgcagtgagccaaaatcacgccactgcactccagcctgggtgacagagtgagactctgtcccagaaaaaaaaaattgtggaacactttctgctgctcagtatgatgtgaaatctcaacaagcaaaaagattggctaggctgggagcagtggctcaggcctgtaatcccagcactttgggaggccaaggtgggtagattgcttcagctcaggagctctagaacagcctgggcaacatggcaaaacccagtctctaaaaaaatncaaaaattagttgggcgtggtggcacatgcctatggt

SEQ ID NO: 13325 - DNA, 380 bp, Homo sapiens; identical to SEQ ID NO: 12238

SEQ ID NO: 13326 - DNA, 432 bp, Homo sapiens
caatcatcatttgtatgtgactttatggttttagatcatgttcctttaatctagggtttctcaaccttggcactgactgttgacatcaattcttggttgtgagggccatcctgtgccttgcaggatacttaaataatctctgscctctacctactagataccagtaacaccttcagacagtgacaatcaaaaatgtctccagatattgccaaacgttccctagcaggcaaaatcacccccagttgagagccagtgctttagtccttasttatcacatttccctaaaagaaatatcattggtattctcaaggtcttgcaatatgaagaacttgaactctaatctcccgtctcctagtttcccaggmtctttctgctagctgtgctttcatccagttgtttggcagatgtttattgagcatctccctggggtca

SEQ ID NO: 13327 - DNA, 298 bp, Homo sapiens
taaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctcaaaa

SEQ ID NO: 13328 - DNA, 213 bp, Homo sapiens
gacaaccctggcgggggttcgctggctgcggcmccggctccggaccccgcagagcagcaccccccggggaaagacattttctgctcccaccgagttggcaggggcctgcttcctgaatctcctgggtgtgtcttaactgccagtcccagcacctcctggaaagccccactctcctccagtggtcacagtggaaggatcatgggagaaacagaa

SEQ ID NO: 13329 - DNA, 129 bp, Homo sapiens
gttaaatattgtctaatcaggccgggcgcggtggctcacgtctgtggtcccggcactttgggagcctgaggcaggcggatcatgaggtcaggagatcaagaccatcgtggcttacacggtgaaacccac

SEQ ID NO: 13330 - DNA, 160 bp, Homo sapiens
attcatttctacagtgtttgtatgttgataaggtcttcccttggctaaatcgtctctgctctctgaagcagtgcctgactccaatgctgggagcaccacaacccacaaatctccaggatgaccagacaaggtcaccttctgttcaaggtcaggggccagg

SEQ ID NO: 13331 - DNA, 485 bp, Homo sapiens
gactgacaactcacacggctgggtactcttctgagacaaaacttccagaggagcgatcaggcagcaacatttgctgttcaccaatatccattgttctgcagcctctgctgctgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagaatgactttgacgagttgagagaagaagccttcagaagatcaaactactccgagctaaaggaggaagttcaaacccatggcaaagaagttaaaaacctt

SEQ ID NO: 13332 - DNA, 111 bp, Homo sapiens
gtgtgttaagaaatgagctgtaggctcagtgcagtggctcatgcctgtaatcccagcactttgggaggctgaggtgggcggatcatgaggtaaggagttcgagagcagcct

SEQ ID NO: 13333 - DNA, 187 bp, Homo sapiens; identical to SEQ ID NO: 11697

SEQ ID NO: 13334 - DNA, 176 bp, Homo sapiens
attaggctgggcgcggtggctcacaactgtgatcccagcactctgagaggccgaggcgggcggatcacctgaggtcgggagttcgagaccagactgaccaacatggagaaaccgcgtcgctgcaaaaatacaaaaaaaattagccgggcgtggtggcacatgcctgtaatcccagc

SEQ ID NO: 13335 - DNA, 481 bp, Homo sapiens
ctgtagctctttctttcatctgaaacttgtgctgtttttactaggaagaaagaaaagattatggttgttgtttttggaaaatgataatctatatcaacttttctttcatttttcaactgagtaatcttagcacagaatataccctgaaggcccaaagtcctaaagtgtcaagaccatctgtttatagtaaatctataaatacatttacttataggactaagatcatctagactagcagatgatttgctatcagaaccactgaagaataaaacctacaggcaataagcaagagagctgaagatgacctggccaactatgagtcaactctgagactacctctgacatgaaaagctcaaaacatctaggttcttcatctttatatattgaaatccacatattgcactatacttggaattaacaagagccaggagttttaacacaattctcacagtaatcatagagcagatgggcattctgtacc

SEQ ID NO: 13336 - DNA, 500 bp, Homo sapiens
agtgggattagtgaactggctagttagttaatctatgaaccagaaccaggtcttcatgacactaaatatgcttgtgccttgatcctggacttccagcctctagaactatgagaaagaagtttctgctgtttataagataccctaatttatggtgttttgttattcagatcgaacagactaggaaatagtatggaaaacaaaagctgccagacttcagttttcatttaattggtcagacctatacaacatatctagcttctccctaactgcagggaaggctctgaaaatcagtgtttaactttttcattgtggctgcttcaggagtcccatttcgtggtatgctgtttggaggagattttcacaagtgatgataacctgtttttcttccaactctgactttggaaaacatcgtaaaagataaagaagttgtaatacaacatggatgaaccctgaaaacattatgccaaatgaaagaagcattcacaaaagatcatatattg

SEQ ID NO: 13337 - DNA, 422 bp, Homo sapiens
aatacagaaagttggccgggcgtggtggtaggcacctgtggtcccagctactcgggaggctgaggcgggagaatcgcttgggctcgggaggtggaggttgcagtgacctgagatcataccactgcattccagcttgggtgacacagcaaggctccgtctcaaaaaaaaaaaatkttgatagcactattatttcttgtagccaaaaagtggaaacaactcaaatacacaacagstgaagaagggataawtaaaaaaataaaatgtggtatatccaaacgatggactgttctgcaataaagaggagtgagatactgataatgctacaatatggatgagccttgaaaacattatgctgagagaaagakgcaggccacaaaggccacatatttaatggtttcaactgamatgtccaaaacaggcaa

SEQ ID NO: 13338 - DNA, 446 bp, Homo sapiens
tcaaagataaagaaaagatcctaaaagcagcaagagaaaagaaacaacatacaatggagctctaatatgtctggcagcagacttttcagtggaaaccctacaggccacgagagcggcacagcatagtcaaagtgctgaagggggctgggcgsggtgactcacacctagtaatcccagcactttgggaggccgaggtggacggatcacaaggtcaagagatggagaccatcctagccaacatggtgaaactccgtctctactaaaaatacaaaaattagctgggtgtggtggtgtgtgcctgtagtcccagctactcgggaggctgaggcaggagaattgcttaaacctgggaggcagaggctgcagtgagctgagattgtgccatcgcactcctgcccgatgacagagcgactccatcgagaaagagaagaaagaaaagrcaaaag

SEQ ID NO: 13339 - DNA, 130 bp, Homo sapiens
tattttsagtagggacggggttacaccatgttggccaggctggtctcgaactcctgacctcaagtgatccacccgcctcagtctcccaaagtgctgagattacaggcatgagtcactacgcccggcccat

SEQ ID NO: 13340 - DNA, 348 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagact

SEQ ID NO: 13341 - DNA, 200 bp, Homo sapiens; identical to SEQ ID NO: 11569

SEQ ID NO: 13342 - DNA, 290 bp, Homo sapiens
ctttaattgccctacatttggcaataaaagcatgactacagcctcccagagacagtgaagttcctgtgtctattgcagaaagaaaattaacctggttcccaatgatgttactcaagggggctcagaatcaaaaccattatttgtgctttaaccactaatattcacttttttgacactcagtttagagtggcctttggaaataagtcacatatattctyttatgaacccaatcatgcatttaacttgttttccaaatgtttattgaacactgactatatatatatagatat

SEQ ID NO: 13343 - DNA, 328 bp, Homo sapiens
cctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgascactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaatt

SEQ ID NO: 13344 - DNA, 87 bp, Homo sapiens
cctaactaaaggagcaatttctttggaattacttctctgtaatagaaattcttggctggtggagtggctcatgcatgtaattccagc

SEQ ID NO: 13345 - DNA, 376 bp, Homo sapiens
gttcccttcctattctcagtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaagctcgccctcccctacctgcggaagagtcaagggaatgtcatcaacatctccagcctggtgggggcaatcggccagg

SEQ ID NO: 13346 - DNA, 476 bp, Homo sapiens
  misc_feature 40: n=a, g, c or t
catctttaaacttctcagagggtcagagtacatcgttttngattagggaaaattataaattgaaattatgtggaatattaatttattcattaaggattttgttaaaagtttgatagccattatgctcggctctggggtgtaagtgtaataaagatggtgccttattacatagcaggtactcaatatataatatcctgcttttaagagacccactatcttaaaaggagatatatcacatgtaaatagttaaagtgtgtaatagtgatttgtttgactgactttggaagcacaatggagaataatcatttaactgccaataaaatcttttaagttttagtacgatatttgaaaaatgatttggcatttaataaaaaattactttttagggatggtgttgtgggtgaatgcagtatatacacagtaaggaactgtggaatagcctggcttgttctgaggaatgaaagtgatttggtgtt

SEQ ID NO: 13347 - DNA, 429 bp, Homo sapiens
acacctcctcctggcttcggatggggaggagctccaaggagatccgttgctagggaggaagttaggttgctaagggttctatggggttcttactccagccaggaccaggtttcagggccacaggcgtaasttataaaactggagtttggctgagcgtggtggctcatgcctgtaatcccaatactttgggaggctgaggcgggtggatcatttgaggtcaggagtttgagaccagcctgatcaccagggtgaaacccgtctctactaaaataaaaaaattagctgggcttggtggcgcgcgcctgtaatcccaactactcgggaggatgaggcacaagaatcacttgaactcgggaggcggagtttgcagtgagccgagatcacgcctcggcactccagcctggacaacagagtaagactgtctcaaaa

SEQ ID NO: 13348 - DNA, 179 bp, Homo sapiens
  misc_feature 9: n=a, g, c or t
aaaaastgntgaggtttgaggccccgttttgctgctcactagctacatgatcttgggcaagttatttaagstctctgagcttcagtttcttcctctgsagaatggggatgaaagtggastactacctcatggcatgttttgaggatgaaatgagctaataaacacagtcttcagcccta

SEQ ID NO: 13349 - DNA, 339 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatdagtgtgccattgcaccccagtgtgggccacagagcgag

SEQ ID NO: 13350 - DNA, 300 bp, Homo sapiens
tgtctaggctgagcgtggtggctcacgcctgtactcctaccactttgggaggccaaggcaggcggatcatttgaggtcagaagttcgataccagcctgaccaacatgatgaaaccccgtctctactaaaatacaaaaattaatcgggcatggtggcgggcacctgtgatctcagctactcgggaggctgaggcaggagaatcacttgaacccaggaggcagaggttgcagtgagccaagatcacaccactgcactccagcctgggcgacaaagcaagactccatctcaaaaraaaaaaaa

SEQ ID NO: 13351 - DNA, 439 bp, Homo sapiens
  misc_feature 386: n=a, g, c or t
ttaaaataatacttagaggctgggtgaggtgctcacgcctgtaaccccagcactttgggaggccagggcgggtggatcacctgaggtcaggagttcaagaccagcctgaccagcatggtgaaacccgtctttactaaaagtaccgagattaggccaggcgtggtgggtcacgcctgtaatctcagcactttcggaggccgaggtgggcggatcatctgaggtcaggagttcgagaccatcctgaccggcatggcsggaaccctgcctctactaaaaatacaaaaaaaattagtcmgttgtggtggcagatgcctgtagtcccggctactcgggaagctaaggcaggagaatcgcttgaaccgaggaggcggaggttgcagtgagcngaaatcacgssactasactccagcctgggcgacaagagsaaaactccgtctca

SEQ ID NO: 13352 - DNA, 267 bp, Homo sapiens
attaggctgggcgcggtggctcacaactgtgatcccagcactctgagaggccgaggcgggcggatcacctgaggtcgggagttcgagaccagactgaccaacatggagaaaccgcgtcgctgcaaaaatacaaaaaaaattagccgggcgtggtggcacatgcctgtaatcccagctactcgggaggctgaggttaggaggatcgcttgaatctgggaggtggaggttgcggtgagccgagatcatgccattgcactccagcctggg

SEQ ID NO: 13353 - DNA, 339 bp, Homo sapiens
tttaaaaaataaataagtaaataaaattgagcctcattttttaacctaattgaaaatgggtgataaaaatgtatacattgcgaccaggtgcggtggctcacacttgtaatcccagcactttgggaggccaaggcaggtggatcacctgaggtcaggagttcaagaccagcctggccaacatggtgaaacttcgtctctattaaaaatacaaaaatcagccaagtgtggtggcacatgcctgtagtcccagctacccgggaggctgaggcaggagaatcgcttgaacttgggatgctgcagttgcagtgagctgagatcgcaccattgcactcctgcctg

SEQ ID NO: 13354 - DNA, 156 bp, Homo sapiens
agaccgagcgcttgaggtgccgcarccgccgccgccgccrccgccgcgatgtgaccttcagggccgccaggacgggatgaccggagcctccgcccmgcggcgcccgcggctcgcctmggcctcccgggcgctctgaccgcgcgtmcccggcccgcm

SEQ ID NO: 13355 - DNA, 377 bp, Homo sapiens
agtgcggtgttttagccggtggctgctgtctctgggcgggccgtgggaggctcccgaggtgggggccggggcgggatggctgcagcggcggccggggccgggagcgggccctgggcggcccaggagargcagttcccgccggcgctgctgagtttcttcatctacaacccgcgcttcrggccgcgcggaaggacaggaggaaaataagattttattttatcatccaaatgatgtagaaaagaatgagaagattagaaatgtcggattgtgrtgaagctattgtacagtttacaaggacatttagcccatcaaaacctggcaaaatctttacatacacagaagaacagacagtkcttcaatgaaccagaagaaaattt

SEQ ID NO: 13356 - DNA, 342 bp, Homo sapiens
gaaaatgagtacgaaatgtaaagtttcactagaaagtttaaagtaggtacaaggttgacagagcaagtagtttcaagggaaggatctcttctgggaagtggtggtggcctgcgtaggcaggcagttgatacagccttaagatgtaggtcagagagactgtggtatagaaaagtaggtttggaaggtgggagagtggctgagcacactggttcactgggaaaaagtagtcagtctgggatrgagcttggaggatggccatgtggcaggtcagacaggaggaggagcagtcttcaaaatagaaacggrdggaacattaggaagttcagtgatatccaaggaaag

SEQ ID NO: 13357 - DNA, 352 bp, Homo sapiens
cctagatatcgcgagagggcgggtccgcttggcttcggcgtcgcgtcgctcctgcgctggagctctaggccggcgtctmtccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctwtagccctgagcgggatctgcggctgcctgcgagtctctgctgtgccgacccttctcttcgcggaccccacgccaagcagcgaccctgagccgacagccggagcgcccggcaatggcggcctcgacggcctcg

SEQ ID NO: 13358 - DNA, 171 bp, Homo sapiens
aaattagccaggtgtggtggtgcatgcctgttatcccagctacttgggaggctgaggcaggagaatcgcttgaacctgggaggtagaggttgcggtgagctgagattgcatcattgcactccagcctgggcaacaagagtgaaactccgtatcaaaaaaaaaaaaaaaagg

SEQ ID NO: 13359 - DNA, 293 bp, Homo sapiens
acacctggccttctccatgctcggaataacttcctgcagcgaccaacaggctaaagagggggaagggatccagcaccggctcctcctccggcaaccacggtgggagcggcggaggaaatggacataaacccgggaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcc

SEQ ID NO: 13360 - DNA, 513 bp, Homo sapiens
gttttcctgagtctctgctctgagctggatggtcgagtccggcccctcgtgtacaccctccgctgctgggctcagggtcgggggctgtcagggagtggcccccttctcagtaactacgccctgaccttgctggtgatctattttcttcagaccagggaccctcctgtgttgcccactgtgtcccagctcacccagaaagcaggagagggggaacaggtggaagtcgatggctgggactgcagtttccccagggatgcctcaagactggagcccagcataaatgtggagcccctcagtgagtttggggagcctggtagaggactagtaatgatgttcatcaacagtaggtaacatatatcacactaactgtgtgccaggcatggttctcacagaaagcctgtgagatacctaatattattactgccattttacagatgaagaaaccatgtttgggagcaattaaggtgacttgcccaaggttacacttgctagcaaggagcagcagcatctggg

SEQ ID NO: 13361 - DNA, 411 bp, Homo sapiens
aaggtttgtagcttgcaagacgtgcactaataatattttatatgatctttcctggttggcaggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgattgccacagtgtcctatgaagacccacccactgccaaggctgccgtggaatggtttgatgggaaagattttcaagggagcaaacttaaagtctcccttgctcggaagaagcctccaatgaacagta

SEQ ID NO: 13362 - DNA, 291 bp, Homo sapiens
tgttcttttcacttttacatatctgatatgcaaaacgttatttcattttaatttactttgattatgatttaggttaacattttaataagcttattagcatcttatgtttcttttatgtctttgccsatttttstgttgaggtatttatctttttsatattgttacaaggttccttatatatctagggtattaatctttattttgataaatgctgtatagagtttttcagcttattgtttgsstttagtagttttgtgcsattcttttttggagacagagtctcgstctgtc

SEQ ID NO: 13363 - DNA, 342 bp, Homo sapiens
ccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaattgcatcttgtcttgttcttgcagcccggcatgccagtgcttcctccacgaatttgaaagacatattggctgacctgatacctaaggagcaggccagaattaagactttcaggcagcaacatggcaagacggtggtgggcaaatcactgtggacatgatgtatggtggc

SEQ ID NO: 13364 - DNA, 225 bp, Homo sapiens
agatttcgaggtcagcgccttcctctgctcctctaggtctgggcttcagggcacgaagagaagttagggtagaacggagccctaaggagaggtgccgtgggcgccgaaaccagctttgaccactcgatgagggccttcctgtttacggatccttcaatttatagatgaggaagctcgggctcagagaagttgagtaactcctcaggcctcacagcctgtaagtgc

SEQ ID NO: 13365 - DNA, 76 bp, Homo sapiens
ttatcattttcttagttttgtaataccttttttatttgtgaataaaattatcacctggaaaaaaaaaaaaaaaaaa

SEQ ID NO: 13366 - DNA, 328 bp, Homo sapiens
aaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgataggacttattaactatattgaacattttttcctttgcctttgaccctatgtatagttacgatgccagattagatttatagcagcctcaagttgtattaaatgatattttgcttcctgtaatactattataaaataaagtttgtttattctctcaaaaaaaaaaaaaaaaag

SEQ ID NO: 13367 - DNA, 342 bp, Homo sapiens
  misc_feature 229: n=a, g, c or t
acacctggccttctccatgctcggaataacttcctgcagcgaccaacaggctaaagagggggaagggatccagcaccggctcctcctccggcaaccacggtgggagcggcggaggaaatggacataaacccgggaattttaaatccaagctgggtttcatcaactgggatgccataaacaaggaccagagaagctctcgcatcccgtgacctccagacaaggagccacnagattggatgggagcccccacactccctccttaaaacaccaccctctcatcactaatctcagcccttgcccttgaaataaaccttagctgccccacaaaaaaaaaaaaaaaaa

SEQ ID NO: 13368 - DNA, 438 bp, Homo sapiens
tttagaaatgagatctagagaacacgtcttctaaaaggggcatattttatattagtgaagaggtattactgacacaatttcttctatatatgaacctatttttaatgaaacttcaaatagcaataagttccgttatatactgtggcctgaaataatttgagaaaaaaggttactttgttattcagcttttcataatatctatgctgagtattttcacgtatcttccaagtactcagctttttcgtatttcaaataaggtcagaccttttatacttttgaccaaatagttattttctatgttggacacttagttatttaccaaagcctccgatttgtgatgcagtgtttgtagtccttgtaaacaatatatacagactatacaagaattaattttattgggctttcaaaaaccatatttgcattccagaaccaaatctt

SEQ ID NO: 13369 - DNA, 464 bp, Homo sapiens
cctcaaaggaggggcagagctgcgcagggcaggagcagctggcccactggcggcccgcaacactccgtctcaccctctggcccactgcatctagaggagggccgtctgtgaggccactacccctccagcaactgggaggtgggactgtcagaagctggcccagggtggtggtcagctgggtcagggacctacggcacctgctggaccacctcgccttctccatcgaagcagggaagtgggagcctcgagccctcgggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcctcgccaccaaggagatccaggttaaaaagtacaagtgtggcctcatc

SEQ ID NO: 13370 - DNA, 335 bp, Homo sapiens
ctaagatggctgctgggcgaccacttcctgacagaagaaaagatgtggagtgggctgctacctcctggcctaaatgaaagtgacgctgagtcagactcggaaggtgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacaaaaagcacaacctcaagattcaga

SEQ ID NO: 13371 - DNA, 294 bp, Homo sapiens
  misc_feature 272: n=a, g, c or t
tttatttataggaagctactactaaaaaaagtcactaactttgtgtacctataatccctaaattaaaattaaattttaattggctggctgtaatttgcattgagagaccttttactagtagctagtgttaggaagtgaacctaaaataagaaaatataatgatctgtgtttatcattagccttgtacaaatgtaaattactaatagtgatgttcttttgcaaggcatagaacatttgtatgaaaagacattttagtatgctttgaaaaaaanctcagcttttagttttttttcc

SEQ ID NO: 13372 - DNA, 229 bp, Homo sapiens
cagcgatattgggctttttttcatatgcttgtkggccgcatgtgtgtcttcttttgaagtgtctgtttatgtcctttgcccactttctaatgagatttttttttcttgtaaatttgtttaagttcattatcagtgttggacattagatctttgtcacatgcatcttgcaacagttttctcctattctgtaggttgtctgttcactctgttgacagtttcttctgctgtg

SEQ ID NO: 13373 - DNA, 311 bp, Homo sapiens
ccttttctgggaacgtgagtatcaaccaaggctggagtgcagtggcaccatctcggctcactgcaacctctggctcccaggttcaagcgattctcctgcctcagccccctgagtagctgggattacaggcacgcgccaccactcccagggtcttactctgtgacccacgctggagtgcaatggcaccatcacgacttactgaggcctccacttcccgggctcaagtgattctcacacctcagcctcctgagtagctgagaccacagatggagttttgctcttgttgcccaggctggaaaaaaaaaaaaaaa

SEQ ID NO: 13374 - DNA, 448 bp, Homo sapiens
ggctctctgttcagtagacttagggactgtttccatcagggttaggcctgatccacctgaacgcacagtgaatatccctcctggctgtgtcacaccacacttggagaagtcgcaattgagacaggggacatgaaaagagatgcagttttcagtttaaaagttgaatgcccaatttaatttctacccaagtagatgaggtctcacttgagctgtgccccaggctccgcagaccaaagggtcgcaagggacccagactgatccagacacctctcttttccaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggc

SEQ ID NO: 13375 - DNA, 349 bp, Homo sapiens
attgcgtagttccgaataccctcggccacacctggcttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgtatcccgtgacctccagacaaggagccacmagattggatgggagcccccacactccctccttaaaactccaccctctcatcactaatctcagcccttgcccttgaaataaaccttagctgcscca

SEQ ID NO: 13376 - DNA, 76 bp, Homo sapiens; identical to SEQ ID NO: 13365

SEQ ID NO: 13377 - DNA, 434 bp, Homo sapiens
  misc_feature 286: n=a, g, c or t
accggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtaccgngccagagatactatggcgggactgagtttattgatgaacttgagaccctctgtcagaagcgagccctgcaggcctataagctggacccacagtgctggggggtcaacgtccagccctactcaggctcccctgcaaactttgctgtgta

SEQ ID NO: 13378 - DNA, 303 bp, Homo sapiens
  misc_feature 295: n=a, g, c or t
cttggctggccggtgtatgtccgctggattgtgaggcccgggatctgggctccgcgtggtgcagaaatgctgtgccggctcggggtcggtggctgcggcgctccctgccctgcagctttgggctagggacctgcsgcttgcgccggttcctacgagcggcgccaagcgcccactctcccagtgtgggcagtggcaccagtctctgcagtacatgcgaacggctggtacgaggccctggccgcgtcttcgccggtgcggggttgcgggaggaagtactgctcggcgtgcacgcccnacgggcct

SEQ ID NO: 13379 - DNA, 437 bp, Homo sapiens
aattttcgattccactctcttccgtttctgtcgctgcagtcgtccgcgggtaaggccctccctagaccctttatacctactttacctttcggaggtcaagacacctcctgttgccgcctcctcgcccaacacacaggcgccccccgcacggtaccaagcttgactaacggcctctaggggtgtgtggtgggacttgaaatcctcccttaatgaagtcacaccttctccgtccgcttccacccggtcggcccatggcagagccccatgtagcccaggaatcggcttggccttcggggaggtcagcgtccttactatccccactctccagtgcggcacattcgttcccctaggactccggccggttgccggcccaggcgggtgcttctccccaccaccgcccagctcagctcagcccagcccagcccactctgccctta

SEQ ID NO: 13380 - DNA, 287 bp, Homo sapiens
gacattgtttgccaaaatcccaggcagcatggacctcagtcttctctgggtacttctgcccctagtcaccatggcctggggcagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacaccacagagcctcggggaacc

SEQ ID NO: 13381 - DNA, 416 bp, Homo sapiens
aaggaggaacccaccgcacctacagggcggtcgagtgagggagctgctggcgggtgggtctggcaactctttgggaggccgacgcgggcggaccggcgggtgctgggaacgagcctcggcttgcggccggcagtttccgtgggtctgtgaagaggtcggcggcccctgcggcgccagtcagctttaagaaaaagtagagatcacttctgactgtactgaacagcaaaaattaagtgacttgctgccctgcacatcatggcactgccattccgtaagacttagaaaagtacaaagaccttgatgaagatgagctccttgggaatctgtcagaaacagaactgaaacaactggaaactgkttttggatgatcttgaccccgagaatgcccttctgcctgcagggttccggcagaagaa

SEQ ID NO: 13382 - DNA, 460 bp, Homo sapiens
  misc_feature 329,358,382,425: n=a, g, c or t
agattgatgagaggaaatgtgttctgcccaactgtataatgcatttgaagcttaaaacaatgaatcagtattgatctggccacaaaatattaatgatttgaattaaaaagaaaattttagaaaatgatagctttgacaaattaaggtagcatttcatccacacgatggagtgtgttttattcagtaattgatttaaaaatggaatcaacctaagtgtctaacaggagggagttttataaattgttcacagaacatctgttccaaggagaccttgatgttcatagatttgtaaagaatgctgcttactagcacactgactgctctgcaanatgtctgagggttcctccacttggggcangttgggggtttgatcgcagagtanataaatggtgcattttataatgtaatatattctagcagatgcngcccacgactgtatagatactcttatgtaccacat

SEQ ID NO: 13383 - DNA, 473 bp, Homo sapiens
agcaacctgctctggttcccttccacgctgtgaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctacc

SEQ ID NO: 13384 - DNA, 337 bp, Homo sapiens
acacctggccttctccatgctcggaataacttcctgcagcgaccaacaggctaaagagggggaagggatccagcaccggctcctcctccggcaaccacggtgggagcggcggaggaaatggacataaacccgggaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaaaaaaaaaa

SEQ ID NO: 13385 - DNA, 335 bp, Homo sapiens
actcctgcttcctctctgcctctgtttctagttctcactctgacgtcccgcgtcctttttcatttgtctgcttctcgctcccttccgtgttctgttccctcttcctccctcttccctgggcctgtttctcgstgtccctgtcttttatccttctcatctgcctcttttttgctcaccctgtttctcactgccctcccctccgcctttctcacccctctgtccttttgagctcttbtttgctctgtctcttcatttgccttttgcactctcaaactctttcatcttcccattcgctgtctgtatttctccataactatatctttcttcctctgtct

SEQ ID NO: 13386 - DNA, 453 bp, Homo sapiens
aaacgggaagtgctatggtggagagaaagattactctggccgggctgtaaaggacggctacaatgggaggctgaaggcagaaccaagaaaatgggagtgagtatggaaaaggtacgattcagacggcataatggacgggacttggagactgaattgtagtgggccgaccacaaaatgataaggcatggaaggaagtagagtttggggggaaggatccctagtcccttaatggctaccttcttccccaggagttgttaggccatccgatcccctggcctgggaaagaaacactgatttcgttgctggcttgttcactcaccagaagctacagctactaacagttctaaaaactgtttcatgtgatgaggaacagacgaaaatagttttgagccctaagtccgccgattccagtgctttcttgaacccgcatttactaaaatattttcatgactg

SEQ ID NO: 13387 - DNA, 473 bp, Homo sapiens
tcctttccctcagctattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgaaactaccctgcttttcccccagttttggtctgtgaacacatttgggaaattcttctgatcctaccgctactctcttgagatgaagaaacagctcagatttgaccaagatcacacaagtaggagttgaggaattggaacccactatgactgactccaaattaatatagtgtttatagccacttacataataatgagggtgttgctatgctttcctctgtacaagctggtggtgtatcaattcgttcttscttaactttgggactgtcacagggttcctgcaattc

SEQ ID NO: 13388 - DNA, 469 bp, Homo sapiens
ttctgattagctgtatctggtattaattgcatgttaaaacactggaatttttaaaattgaaattagatcagtcattcttttcttttctcaagatgtctcatggctgacactgaagaagaaatgtaattcataacttgcactaaatgtatattttttttcttaaaaatttaccattcttatttatatttttatggattaaratttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaactacattaactg

SEQ ID NO: 13389 - DNA, 83 bp, Homo sapiens
gtcccgggcacctgcctagagggtagggtggaaactccatccccaatgagcacgggctcatctctgctggttcccgtctaggc

SEQ ID NO: 13390 - DNA, 378 bp, Homo sapiens
attatttataacggaggggacacagggatatggtttattccacagttaagtggtctgacggagccgagtctccaattgtaggctctacggaaatgaacttgctggtcctgcccaggcaaatgggcttagttccctatttatttatcctccagcaacagaactgagttcactcggtatctgaaattgacttttccagcagaaagtttttgtgggtatgggcactggccttggstttgagcaagcttgatgaatgttggatatttctggatttcagggtggccggtggaaatcctgccctttctgtacctgggcagtgcgcatcacgcttcccgcaagacatgctggatgccttgggcatcactgccttgatcaacgtct

SEQ ID NO: 13391 - DNA, 390 bp, Homo sapiens
cttttttgattagccttctgaccatgattaaaatggtgtacctcaaagtagctgctaaccttatgtgtatctgcaacaccctgaaaaattatctaatgaaaaggcacaaagaaaaagcttgtcaatgttgtggataattagaaagtgaataattttatttaatattagataaacaagcacataacagagatacatatattcaaatggaaggagtaaaattaccaccacatgcagatctgtttttctgtccagaaaataacaagagattctactcaggtaaaaaaggaaaggaaggaaaaccattgtaattaaaataaaatttaatacaatagccgtttattaattcaacttctaaagaatctttgtgattacacaatgaccagctagtaa

SEQ ID NO: 13392 - DNA, 361 bp, Homo sapiens
attgcgtagttccgaataccctcggccacacctggccttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaagaaaaa

SEQ ID NO: 13393 - DNA, 172 bp, Homo sapiens
gtcaggagttctagaccatgcctggccaacatggtgaaacccgtttctactaaaaatacaaaaattagctgggcatggtggcgagcgcatgtagtcccagctactcgggaggctgaggcaggagaatcgcttgaatccgtgagcggagtttcaccatgttggccaggctggt

SEQ ID NO: 13394 - DNA, 461 bp, Homo sapiens
taccgtaatattatatcttgccctgcttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatct

SEQ ID NO: 13395 - DNA, 85 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13396 - DNA, 117 bp, Homo sapiens
  misc_feature 35: n=a, g, c or t
acataagaaaattgaggtttggaagagtgaagcknttttctttttcttttttttttttgagasggatctcccactgtsgcccaggctggagtgcagtggcgcaatctcggctcactg

SEQ ID NO: 13397 - DNA, 469 bp, Homo sapiens
ataagacccaggctgacgtggtctccgatggagctgaggaacttactgggaactggagcaaaggtgactcttgttatgttttagcaaagcgactggcagcattttgcccctgccctagagatgtgtggaactttgaacttgagagagatgatttagggtatctggcagaagaaatttctaagcagcaaagcattcaagaggtgacttgggtgctgttgaaagcattcagttttaaaaggaaaacagaggatagaagtttgaaaaatttgcagcctggcaatgcgatagaaaattccattttctgaatagaaattcaagccagctgcagaaatttgcataaggaaggaggagccaaatgttaatccccaagacaatggggaaaatgtctccaggccatgtcagaggccttcacggcagtccctcccatcacaggcccagaagcctaggaggaaaagtggtttcatgggct

SEQ ID NO: 13398 - DNA, 326 bp, Homo sapiens
acacctggccttctccatgctcggaataasttcctgsagcgaccaacaggctaaagagggggaagggatccagcaccggctcctcctccggcaaccacggtgggagcggcggaggaaatggacataaacccgggaattttaaatccaagctgggtttcatcaactgggatgccataaacaaggaccagagaagctctcgcatcscgtgasctccagataaggagccaccagattggatgggagcccccacactccctccttaaaacascascctctcatcactaatctcagcccttgcccttgaaataaaccttagctgccccaca

SEQ ID NO: 13399 - DNA, 378 bp, Homo sapiens
  misc_feature 82: n=a, g, c or t
agatttgtaagggaccagcctggaagcagggaatcggtcaggatccgagtsaccctggagcccaggcagagatcagcgaaanyctcgctgatgcataggtctggaaggcgtggggctccgggaggctgagcagctggactcggcatgaccagaggtcgtgaggccgttccgcagcttgggacgctcctgaccctcagaatcaagcgcgggccactgcattagcatgggagaaatggcagagatagggcttgarggagggatgcccgagattaaaggtattaaaggtaaattggtgtcgccgcaaaaccagcgtgggagccaggaaacgagagtttcagtctttcttcgctaattccagagatagctgcatatcacagg

SEQ ID NO: 13400 - DNA, 269 bp, Homo sapiens
  misc_feature 160: n=a, g, c or t
ctcacctctgtaatcctagcactttgggagaccgctgaggcaggtgtatcacctgaggtcaggagtgagaccagcctggccaacatggggaacctgtctctgctaaacatacaaaaattagccgggtgtggtggcgggcactataatcctagctacgcgngagggtcaggcaggaggattgcttgaacscgggagtggaggttgcagtgagccgagatcacactattgcactccagcctgagcaacaagagcaaactccgcctcaaaaa

SEQ ID NO: 13401 - DNA, 225 bp, Homo sapiens
aaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttggatgatttcacaaaagttcatsttcattgcagatacctgcctttctttctagggtgtatctcccacttcac

SEQ ID NO: 13402 - DNA, 446 bp, Homo sapiens
aaaaagattcgggcgtggtggcttatacctgtggtcccaacattttggaaggctgaggtgggaggattgcttgaggataggagtttgagaccagcctggtcaacatggcgagactcctgtctctacaaaattttttttaaaaattggctgggcatggtggcttgtgcctgcagttccagcttcttgggaggctgaggtgggaggatcccttgagcacaggagtttgaggctgcagtgagctataattgtgcactgcactgcagcctgggtgacagagcaagagcttgtctcaaaacacaagaaaacaaaacaaggctgggcacagtggctcatggcctgtaatcccgctttgggaggcggaggtgggtggatcgcttgaggtcaggagttcgagaccagcctggtgaacatggcgggacccccctatstactgagagtacagaaaa

SEQ ID NO: 13403 - DNA, 421 bp, Homo sapiens
atatacagaaaactgaaactggaccccttccttacaccttatacaaaaattaactcaagatggattgaaaattaaatgaaaaacccaaaaccaaaaaaagaccctagaagaaaacctaggtgatatcattcgggacataggcatggacaaagacttcatgaagaaaatgccaaaagcaatggcaacaaaagccaaaattcacaaatgggatctaattaaactaaagagcttctgcacaacaaaagaaactatcatcagagtgaacaggtaacttagagattgggagaaaatttttgcagtctacccatctgacaaaggtgtagtgtccagagtctacaaggaacttaaacaaatttacaagacaaaaacaaaaaacccgtctaaaagtgggcaaaggwtatgaacagacacttctcagaag

SEQ ID NO: 13404 - DNA, 263 bp, Homo sapiens
cacaaagaataggatgggataaagaaagtggacacttaaataagctataaattatatggtccttgtctagcaggagacamctgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttc

SEQ ID NO: 13405 - DNA, 76 bp, Homo sapiens; identical to SEQ ID NO: 13365

SEQ ID NO: 13406 - DNA, 481 bp, Homo sapiens
tcagtcgcctcagccgcggtgtgagggagccggagtcttccttagcttctccgccatgggtgtcgcttcgtagccgggctgctccgggaaaggcctcgtacagcacgcattcaccagaatcctgtcagctttcctcttctcatccagacgcctggccaggatcctcgataagactgtgacccccaacttggacaccccataaggttcccagatgatgtgacagctactggtctccagccacaccttgagaacacttggctttgactaccacttcttaaacttaaaggaaaactagacaatccaccagcccaggaggggacaagcaggcttattcctcstcctcgtcatctctggctccagccccaccctggcccttgctggsattcttcstcttcacgtggctggggttggccaccccaatagggaagcagagggagaagtcaatgtgcttctgggaatccaggcggacagtgaagaacag

SEQ ID NO: 13407 - DNA, 357 bp, Homo sapiens
  misc_feature 254..256: n=a, g, c or t
attgcgtagttccgaataccctcggccacacctggccttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgcatcccgtgacctccagacaaggagccannngattggatgggagcccccacactccctccttaaaacaccaccctctcatcactaatctcagcccttgcccttgaaataaaccttagctgccccacaaaaga

SEQ ID NO: 13408 - DNA, 226 bp, Homo sapiens
gagaaagagraacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactcca

SEQ ID NO: 13409 - DNA, 366 bp, Homo sapiens
tttacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactc

SEQ ID NO: 13410 - DNA, 438 bp, Homo sapiens
ataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaracacctgttttcctagagtcattggttacaaatatgcttcgtctaagagctatttgtccattctcctggagagtgtttcaatttcgacccatcagttgtgaaccactaattattcagatgaataagtgtacagatgaggaggc

SEQ ID NO: 13411 - DNA, 310 bp, Homo sapiens
ccttttctgggaacgtgagtatcaaccaaggctggagtgcagtggcaccatctcggctcactgcaacctctggctcccaggttcaagcgattctcctgcctcagccccctgagtagctgggattacaggcacgcgccaccactcccagggtcttactctgtgacccacgctggagtgcaatggcaccatcacgacttactgaggcctccacttcccgggctcaagtgattctcacacctcagcctcctgagtagctgagaccacagatggagttttgctcttgttgcccaggctggaaaaaaaaaaaaaa

SEQ ID NO: 13412 - DNA, 366 bp, Homo sapiens
attgcgtagttccgaataccctcggccacacctggccttctccatgctcggaataacttcctgcagcgaccaacaggctaaagagggggaagggatccagcaccggctcctcctccggcaaccacggtgggagcggcggaggaaatggacataaacccgggaattttaaatccaagctgggtttcatcaactgggatgccataaacaagaaccaggtcccgccccccagcacccgagccctcctctacttyagccgactctgggaggatttcaaacagaacactcctttyctcaactggaaagcaattattgagggtgcggacgcgtcatccactgcagaaacgtgcargcagagccgatcagccs

SEQ ID NO: 13413 - DNA, 419 bp, Homo sapiens
caagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcasggcgacascttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgg

SEQ ID NO: 13414 - DNA, 358 bp, Homo sapiens
gccagagttctttctgctatcccttactttagtaatatcctttaaaaatgtaccgcggccaggtgctgtggctcacgcctgtaatcccagcactgtgggaggctgaggtgggtggataacctgaggttaggagttccagaccagcctggccaacatggtgaaaccccatctctactaaaaatacaaaaattagctggaccctatggtacatacctgtaatcctagctacttgggaggctgagccaggagaattgcttgaacctaggaggcggaggttgcagtgagccgagatcatgccattgcactccagcctgggcaacaagagtgaaactccatcagaaaaaaaaaaaaaaaaagg

SEQ ID NO: 13415 - DNA, 268 bp, Homo sapiens
cttgctgaggctggggcaaccaccgcagkcgagacagcaggcggctcaagtggacagccgggatggcagagcgtgcggrcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggc

SEQ ID NO: 13416 - DNA, 68 bp, Homo sapiens
  misc_feature 46: n=a, g, c or t
taccatttcacacataagaaaattgaggtttggaagagtgaagcknttttctttttcttttttttttt

SEQ ID NO: 13417 - DNA, 313 bp, Homo sapiens
tcttaaacaccggttctcaccttgggtggcacactggaattatttggggagctttgtaaatcatcattgctttattctcactcccagagattgggatttgattgatctggagtaggattgaaatttttaaaaaattctcccgggtgattctaatgttcaaccaggggctctcagctatatctgcaccagagtcacccagagaagctttaaaaactgtcaatacctgagccccactcctggaaattctaatttaagtgttcttcggggggtggggtggggttcaggctttttttttttttttggaaggcttctc

SEQ ID NO: 13418 - DNA, 187 bp, Homo sapiens
accagttgggttgcacattgtgtggtcgtccaaataactcaatcttgcgagtgccaggagatagtctttcaatcatgccatagatttcatctggtttatgactggtggaacgaacctaggaaataaaaactagctgctttttaagttaaaaaaaaaaaaaaaaaaaaaaaaaaaaaaaaaaaaaaaa

SEQ ID NO: 13419 - DNA, 311 bp, Homo sapiens
cctttgtgctgcggcggcggcttctsgagtcctccccgasgcgtcctctaggccagcgagccccgygstctccggtgacgaccatgtcggcggcgggacggrcgcggcgtagaggcgggcttctccagcgaggagctgstctcgctccgtttcccgctgcaccgcgcctgscgsgacggggacctggccasgctctgctcgctgctgcagcagacaccccacgcccacctggcctctgaggactccttctatggctggacgcccgtgcactgggccgcgcatttcggcaagggtcttgctctgttgcccac

SEQ ID NO: 13420 - DNA, 351 bp, Homo sapiens
  misc_feature 255: n=a, g, c or t
attgcgtagttccgaataccctcggccacacctggccttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgcatcccgtgacctccagacaaggagccaynagattggatgggagcccccacactccctccttaaaacaccaccctctcatcactaatctcagcccttgcccttgaaataaaccttagctgccccac

SEQ ID NO: 13421 - DNA, 457 bp, Homo sapiens
actagggtgttcactattgtgaatttataatcttaaaagttggggatgctaaaagtaccagactaaaatactacgaggttttctcatcttttaattccattttgttagaaaaaaataatcacaaccggggttcttttacctttccccagccatctagactgctttactgcaatgttgggaagattgcatacaataaaaactgtagctagttgattgggatttgggaaaattgaatcaagcatttgcattcatccagaatggtcttaaactgctgactgtggggtgcccacaggatgagcactggtggcatgggtgggaggaatttccttggatactgcaattgcatttgaaagatctattttccaaaacctgagcagagagaggctaggaggaatgcagacaggacattgaaaatgcgaattccctttactagtagaacatgaaatatctgataatg

SEQ ID NO: 13422 - DNA, 466 bp, Homo sapiens
gtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcgcttcctgcccttgttggaagccccagggtggactctcagcacgaaggtctctcccttaactgctgcccttccaagacttgctcccgagatggagtgggcgtggtcttccaggctggcccttccttctcctcaccgccaccttccctgccccagccccagcagccatgggtacatggggtccccagctcacctatggattcccgccagtctgcccagctgca

SEQ ID NO: 13423 - DNA, 440 bp, Homo sapiens
taatttagatgccagctttaaatagttaactatatgcttactgtggagtgcaccaatgaaacaactcattttgttcttttggcttctcaatacttctttgtgacaaagcatcaactgtataagataaatagtagcttattttgtgagtatggttgctctatgtagcaagcagttgtgacctaaagcaacccataaattacagatttagtgggagaactggacagttaacaacgtcacttttgctttggactactacttaggtcccttaaagtggtgccagtgccacagaactgaagattcctgactgtagggaatataccatctaattttgagtttcaatagagtaactttgattttagtgagttgttgggaaatcctttagatcattagttatgcagcaaaattgcttggctttaataatcatatgtactggcttattc

SEQ ID NO: 13424 - DNA, 447 bp, Homo sapiens
catgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctcttatatattatgagtttgaaaaattttgaaggtagcatattgaagtgatctataaatatcttcagtcctctctgaagtgtgggtatttcttctatctaaaaawtacatacagtga

SEQ ID NO: 13425 - DNA, 369 bp, Homo sapiens
atttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgctgtaatcccagcacttggagaggctgaggttgcgccactacactccagcctgggtgacagagtg

SEQ ID NO: 13426 - DNA, 99 bp, Homo sapiens
  misc_feature 47: n=a, g, c or t
aacagcccggaagccgctggctgggttaacctgtggcgcgctccsgntttccggcgcctgaagttttagctgcggtggtggcggcagtcgggaccgacy

SEQ ID NO: 13427 - DNA, 480 bp, Homo sapiens
agaatcactaggcgccggcgctcccgaggcagtgtgtttccgcccagagctggagtctcccagctgccagccgaccccgaacccgcactcccgccaaccgcgctttttgtgggcggtcggaaaccacagcctccgttggatatgttcgtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaag

SEQ ID NO: 13428 - DNA, 365 bp, Homo sapiens
attgcgtagttccgaataccctcggccacacctggcttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaagaaaaaaaaaa

SEQ ID NO: 13429 - DNA, 169 bp, Homo sapiens
aaattagccaggtgtggtggtgcatgcctgttatcccagctacttgggaggctgaggcaggagaatcgcttgaacctgggaggtagaggttgcggtgagctgagattgcatcattgcactccagcctgggcaacaagagtgaaactccgtatcaaaaaaaaaaaaaaaa

SEQ ID NO: 13430 - DNA, 459 bp, Homo sapiens
aaactcctgctaagctaactagctcttttttatgggtccatgcacacgaccgaactcctctttcactgaccagagattatttctgacaacccaggatatcccgaaagcttggaggcatatggctggaaaatgaaacgacccaggacatcgtttctggctgcatcattattttgtgtcgcgtagtaccagatgggcagtcagtgagcggcgcagggatgtgaacggacggttttataatgtgaaaattttcccttggtaaagctaaaacagatttaatttccctctcttttctttcactacttccccctctttattccccctctgtctgcaatatcagtgaactcaactttgcagtgaggtggccaaaaaagagagagaatgaggagatcttgatcatcttagtgtcagabgagtcgcagcggactgggaactgcagctgcgaccccccgcgtchtgtgc

SEQ ID NO: 13431 - DNA, 304 bp, Homo sapiens
taatgttgaaattggggtgcttttaggactcttcagtggtagagctgtctggttagaaattaatctttaagttgggatgccgaggtgggaggatcaggtgaggccaggagtttgagacccggtctctacaaaaaatacaaaaaattatctgggtttggtggtgcacacctttagtgccagctactcggaaggccaaggcaggaggatcacttaagtccaggagttcgaggctgcagtgaactgtgattgcaccactgcactcaagcctgggtgacagagcaagactccgtctcaaaaaaaaaaa

SEQ ID NO: 13432 - DNA, 415 bp, Homo sapiens
tactgcagcctcttttaagacaaactagaaataagttaaccataggctgagcatggtggctcatgcctgtaatcccagctttgggaggccgaggtgggaggatcacttcagatgaggagttggagaccagttgggccaacatgatgaaaccccatctaaaaatacagaaattaaccgggtatggtgttgggcacctttaatcccagctacttgggaggctgaggcgggaggattgcttgaacccaggaggtggaggttgcagtgagctgaaatcatgccactgcacttcaggctgggtgacagagtgagactccatctcaaaaaaaaattaaraagtaaaaataaataaattaaccatagttctttgaaaatagtgtctatgtgtctaaattttttttctttctttctttctttt

SEQ ID NO: 13433 - DNA, 426 bp, Homo sapiens
agaaacccatgtttctaaattattgaactaactttcatattgtaaaaaaaatccaaaataaaaaggtcaagaaataactgaaaagatgcataaataaacaatagtcagcataataaaatataaacagacataaaacactattttacacccacggtttggcaaagatgtggggaaatgggaattatctttcactgcctatagaactgtaaattggtacgaagactttgaggagtgctaggtttaatatctgataaagttaaaattgaatgtactcggccgggtccggtggctcatgcctataatcccagcactttgggaggccaaggtggctggatcacccgagatcaggagtttaagaccaccctggccaacatggtgaaacccatctctactaaaaatattaaaaaattagctgggtgtggcggc

SEQ ID NO: 13434 - DNA, 372 bp, Homo sapiens
ctttttaaacggggtgacgtggactggggagtacctgaagcttcttgggcgtggtgggttgggatgggggactgggggtatgtgtgtgacttggggaacacaggtggggtctgccctgcaccccctcccagcccgaccatcctgtccccagtgctctggcgctgcttcagcaccgtggtcatctttctgttcctgctggacgagcagacgagcctgctggtgctggtcccggcggtgttggagccgccattcagctgtggaaagtgaagaaggcattgaagatgactattttttggagaggcctgatgcccgaatttcagtttggcacttacagcgaatctgagaggaaaaccgaggagtacgatactcagg

SEQ ID NO: 13435 - DNA, 141 bp, Homo sapiens
cttctccatgctcggaataacttcctgcagcgaccaacaggctaaagagggggaagggatccagcaccggctcctcctccggcaaccacggtgggagcggcggaggaaatggacataaacccgggtgtgaaaagccaggga

SEQ ID NO: 13436 - DNA, 313 bp, Homo sapiens
aaaaagattcgggcgtggtggcttatacctgtggtcccaacatyytsgaaggctgaggtgggaggattgcttgaggataggagtttgagaccagcctggtcaacatggcgagactcctgtctctacaaaattttttttaaaaattggctgggatggtggcttgtgcctgsagttccagcttcttgggaggctgaggtgggaggatcccttgagcacaggagtytgaggctgcagtgagctataattstgcactgcamtgcagcctgggtgacagagcaagagcttgtctcaaaacacaagaaaacaaaacaag

SEQ ID NO: 13437 - DNA, 406 bp, Homo sapiens
caacttattttctgagataccactaggcctactgtctttcatgccattttatataaacattttgatagatactctgtcttttgttttttatctcttctcttttcaagagtcacttgactttttcaaatattcttaaaagatagatttagttattgtattttggtctacaattttggacttggcagtttgttttactaatgcagaattattctttttgtttcaaacatagtttgccatcatctggctactacctaatcatgttgtactagttattgtggaaagaaaattgtacatacatttccttgtcctttgggagatgtctttgagtcaaacccacaagcatgaactctcacctgaaagaaaactggaaaaggagaaactttaaatcagtatgttttgaaaggaa

SEQ ID NO: 13438 - DNA, 464 bp, Homo sapiens
caaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcasygctggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttg

SEQ ID NO: 13439 - DNA, 464 bp, Homo sapiens
aaataatattgttcacttttgcctatttttgagctttttatagaaaaatgctactgcgaaattattttgagtcatatcttttgatcgatattaagatacatttgcagagttttgtatgtgtgtttatatccatcttacataattctttactgtatagcgttccctttagccactggaaaatgatataatgtcattgcttacagaaggtgactgattcttattcagtgctactttctacagacaggtaactattcgcatttacgattaagaaatgttcacaccttcacactggtatcaactgcaacaaccactatacttctccagtgattgccagatggcccactatacatcctttcttctatttctttcttttgtggccagaaagtcaggacctcaaagaggtataagtttgtgtgtataattccctggcttttttctaaaattttagtatgcatttatgtggc

SEQ ID NO: 13440 - DNA, 147 bp, Homo sapiens
tttcactgagaggggaagattcatgatccttgtatgatacttaaaattcatgacccaaaataaatgcatgtgggctgcactagtaactgataacttgctmwggtcmtgctgtgtgcccaacttaagcagggcattatatgtatatta

SEQ ID NO: 13441 - DNA, 293 bp, Homo sapiens
  misc_feature 234: n=a, g, c or t
cgtcatcatgctggtgggcaacaagagtgacctgcgccacctgcgggctgtgcactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgcgctgcccacgacgagtccccggggaacaacgtgntggacatcagcgtgcsgcccaccacggacggacagaagcccaacaagctgcagtgctgc

SEQ ID NO: 13442 - DNA, 511 bp, Homo sapiens
aaaaagattcgggcgtggtggcttatacctgtggtcccaacattttggaaggctgaggtgggaggattgcttgaggataggagtttgagaccagcctggtcaacatggcgagactcctgtctctacaaaattttttttaaaaattggctgggcatggtggcttgtgcctgcagttccagcttcttgggaggctgaggtgggaggatcccttgagcacaggagtttgaggctgcagtgagctataattgtgcactgcactgcagcctgggtgacagagcaagagcttgtctcaaaacacaagaaaacaaaacaaggctgggcacagtggctcatggcctgtaatcccgctttgggaggcggaggtgggtggatcgcttgaggtcaggagttcgagaccagcctggtgaacatggcgggacccccctatctactgagagtacagaaaattggccgggggtggtggcgtgcgctgtggtcccagctgcttgggaggctgaggcaggagaattgc

SEQ ID NO: 13443 - DNA, 346 bp, Homo sapiens
  misc_feature 254..255: n=a, g, c or t
attgcgtagttccgaataccctcggccacacctggccttctccatgctcggaataacttcctgcagcgaccaacaggctaaagagggggaagggatccagcaccggctcctcctccggcaaccacggtgggagcggcggagaaaatgacataaacccgggaactctgagacgtctcctgggatgtttaactttgacactttctggaaggaccagagaagctctcgcatcccgtgacctccagacaaggagccanngattggatgggagcccccacactccctccttaaaacaccaccctctcatcactaatctcagcccttgcccttgaaataaaccttagctgcc

SEQ ID NO: 13444 - DNA, 120 bp, Homo sapiens
agtaagattagcttgactaagggagcgaagggcgtcacactgcttttggaaacaggtggtgaggctggcgtcgccatgttttctaagggactttctcaggatcagatccaagagtggtcc

SEQ ID NO: 13445 - DNA, 441 bp, Homo sapiens
taggtcaaaaagggaaatgtatcaatgcatagccctgtggttggtaattgtgtatgctcagctttataactgcagtcatttgaaatactttaagaacaaccagtgtcttccactggcttcactcagatgctaatctctggaaacacttgcacagacacactcaaaacactaataagttctaggtgttccttaatccaatcaacttgacacctaaaattaagtcccaaagaacacctcttatcaactcagcacccatacatacctccttaaaccgtacttaatttccaaataaagacaatgagaaagttgtagttctacctatcatgatgccagtatcctctgattgtgatttttgggattttagacattatggattttagattaggcattttgatcttttgggatttcaccattcaggattaaggtgttcgagattgtgtc

SEQ ID NO: 13446 - DNA, 300 bp, Homo sapiens
  misc_feature 125: n=a, g, c or t
atcacagttcattacagcctcaacgtctcggactcagatgatcctgccacctcaatctcccaagtagttgggaacacagaagtgattcagcactcaggattattgcccacrcccctacgattgcncccccaagcaatcaccagcaagcacccaatgcctagccakvcccaccccttcccccaaactacctttgaaaaacccctaacctaccagccttcaatgagattgatttgagtaataactccatctccagtgtggagtggccagcctcacatcaattaaactctttctttactacaa

SEQ ID NO: 13447 - DNA, 388 bp, Homo sapiens
  misc_feature 380: n=a, g, c or t
aaaatctgcaagctgaaccaactcaactgtggctgccttgcccacctgaagacctcaggatccaccagcagcccaagacacctcggaagctgtttcaaggtcagtaccagaagtcgtgtttttgagtgatttgcaatgtaatgcaaaactcaatggaatgaggagtttttttgtggccttgtattttctttcacaccactgaatgccagtgtttatgctggggcatgcttagagatggaaatttggaaggaaagtccatcacagcatttgtgcsaattggggatccagcaataatatctgtttaacaacaccaatagtaagcagatgaatgtatattgaccacgttagaagtaaaacgagaaagatgttagaatgacatngaggaaaa

SEQ ID NO: 13448 - DNA, 54 bp, Homo sapiens
ctctgcgtgcgccggastgccgtggcgggtgggccgctgacttctcstcccggc

SEQ ID NO: 13449 - DNA, 269 bp, Homo sapiens
  misc_feature 185: n=a, g, c or t
atcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttttsntccccccgaaaactttccccccttctcctccctgcctctaactccgatccccctacgccatctcgtcaaaaaaaaaaaaaaaaa

SEQ ID NO: 13450 - DNA, 403 bp, Homo sapiens
  misc_feature 237..238,373: n=a, g, c or t
ctttctctcttgaaccatttgaaagttgtgcatgttatgacattttgcctggatgtgctaagcatacgtctcctaagaataagtatattctcttatataaccacaatatttactctttaaaaactgtagaaattctataacatcacattccatattcagatgttccaagtgtaccaaaaatacctttactttttttttttttaagagmcaaggtcttggtcggtcacccaggctggnntacagtagcatggtcatagttcactgcagccgttaaacttttgggctgaagtgatccttctgcctcagtctcccttctggagtagctaggactacaggagtggaccaccatgccaggctaatttttaattttttnccttttgtagaggtagagtcttgctatatt

SEQ ID NO: 13451 - DNA, 303 bp, Homo sapiens
tttaatggctgggcacggtggctcacacgtgtaatcccagcactttgggaggctaaggtgggcggatcacaaggtcaggagatagagaccatcctggcgaacacggtgaaaccccgtctctactaaaaatacaaaatttagccgggcgtggtggcgggctcctgtagtcctagctactcgggaggctgaggcaggagaatggtgtgaacccgggaggtgcagcttgcagtgagctgagatcgggccactgcagtctagcctgggtgacagagagagactcggttccaaaaaaaaaaaaaaaaa

SEQ ID NO: 13452 - DNA, 401 bp, Homo sapiens
aatggaggtggaggccgtctgtggtggcgcgggcgaggtggaggcccaggactctgaccctgcccctgccttcagcaaggcccccggcagcgcsccactacgaactgccgtgggttgaaaaatataggccattaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggccagcactcaaagatgccatgttggaactcaatgcttcaaatgacaggggcattgacgttgtgaggaataaaattaaaatgtttgctcaacaaaaagtcactcttcccaaaggccgac

SEQ ID NO: 13453 - DNA, 465 bp, Homo sapiens
aatccagckgctgctctacaagcasaacaacaactgggaagccttctcagctacacttcggggcactggtccaaccccaccaaaatccctcgtttcccttagcgtggtaagacggagcctgacctgagctccaactgtcctatctttttcaaatgtttcaaacttactgcctttgttcagcagaaccacgggcacggtgatgatggtgacaagcgcagagcacccagcagtcccagaagaaccttcsacggtgtctgcaagccgagcagatcaagtccaattagagggaagcgtgtggccccagtttccgtagagggtcggggctgctccagaggcagcaggatttgcaggaaggaagactgtacacagagaataaataacttggccaagccattcagctaggaagttgtagatcctaaattaagagttcaaggtcttaatggctactctatgcggcctctcata

SEQ ID NO: 13454 - DNA, 441 bp, Homo sapiens
ttagatgatttttcctgtaaagagctaataagaatattctcgtaatttattgtacattatgattttgatatatacttagtaaagataagtaaggtacttggcccagccaggaagaggtgatacatccttagaaagctaatggtcagtcctgacaggactggggtggtgggcaggtgttgctgctccacattgccctgaactaacagtggggtctggagtgcccagcatgggggctgtttcatgtmmcctcttactgatggttttggtttgcttgtgtggaagacagttgttcggctttggtttatgttttatacaagaagagatgtgtcaattaggtaaattactggcatcttagttttcagcagttttgttttacaagaaactagcctggtaaagtataagaatgcaaaatactgggctgggcgtggtggctcatgcctg

SEQ ID NO: 13455 - DNA, 429 bp, Homo sapiens
atggctgcccacaggtctgcaggcactcggtacgccgctaacgcgaggggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatggttctcagactggaacagcaaagatggagttttgttgcccagact

SEQ ID NO: 13456 - DNA, 191 bp, Homo sapiens
  misc_feature 46: n=a, g, c or t
agaccagcagaggcagcagccgagcagccgcagcctgckccctctnccgcccgcccgccctccgctctgccctccctccttccttcttgcttctaatagccctggtacatggtacacacccccccacctcctgcaattaaacagtagcatcgccaaaaaaaaaaaaaaaaaaaaaaaaaaaaaaaaaaaaa

SEQ ID NO: 13457 - DNA, 91 bp, Homo sapiens
  misc_feature 81..84: n=a, g, c or t
gaacacttccatggattgtccttggacttagggcgccctgcccgccttttgcagaggagaaaaaacttttttttttttttnnnncccccga

SEQ ID NO: 13458 - DNA, 81 bp, Homo sapiens
agaactgtctgggacagacgctgcccggatccctgcggctgcctgcactctggaccacgagctctgagagcagcaggttga

SEQ ID NO: 13459 - DNA, 341 bp, Homo sapiens
  misc_feature 265,267,269,300: n=a, g, c or t
atcttatcctctatgccaaacactgttctctttgaaaatgtcatgacctttcgttacaaaggaaacatcaacaaagaactactgctttatcacaggacttagtagccatgaaggtcctcatcctcgcctgcctggtggctcttgctcttgcaagggagaccatagaaagcctttcaagcagtgaggaatctattacagaatacaagcagaaagttgagaaggttaaacatgaggaccagcagcaaggagaggatgaacaccaggntnanatctacccctctttccagccacagcctctgntctatccattcgttgaacctatcccctatggttttcttcca

SEQ ID NO: 13460 - DNA, 433 bp, Homo sapiens
atgttgttgttctagagtttggaatatactgattatctcagacttgacatttatactgaaggatgaagtaagacctccagctttttttaaaaaaggtgttgatttggaacacctgtatgggttatggtttattaaggttatggtttagaaagttttttttccctcagagccttaacttgttaagaaggttcatttatcctgcactgaaaacaaaaactctatatactttgtttgtgtgcctcctgcactctcccattccctatgtgaatatgctctagttgatatttttaatatattgatttcttttttctcacagcaacaagtgcttactctagaggttagtgggccctgatatgtcatcagtcagatgcctgcctagccaaagctggactaagattattctgtacatttgttgatcttgatatagacttat

SEQ ID NO: 13461 - DNA, 56 bp, Homo sapiens
atraaaaaaaaaaaaaaaaaaaaaaaaaaaaaaaaaaaaaaaaaaaaaaaaaaaaa

SEQ ID NO: 13462 - DNA, 305 bp, Homo sapiens
ccttttctgggaacgtgagtatcaaccaaggctggagtgcagtggcaccatctcggctcactgcaacctctggctcccaggttcaagcgattctcctgcctcagccccctgagtagctgggattacaggcacgcgccaccactcccagggtcttactctgtgacccacgctggagtgcaatggcaccatcacgacttactgaggcctccacttcccgggctcaagtgattctcacacctcagcctcctgagtagctgagaccacagatggagttttgctcttgttgcccaggctggaaaaaaaaa

SEQ ID NO: 13463 - DNA, 370 bp, Homo sapiens
atatacagaaaactgaaactggaccccttccttacaccttatacaaaaattaactcaagatggattgaaaattaaatgaaaaacccaaaaccaaaaaaagaccctagaagaaaacctaggtgatatcattcgggacataggcatggacaaagacttcatgaagaaaatgccaaaagcaatggcaacaaaagccaaaattcacaaatgggatctaattaaactaaagagcttctgcacaacaaaagaaactatcatcagagtgaacaggtaacttagagattgggagaaaatttttgcagtctacccatctgacaaaggtgtagtgtccagagtctacaaggaacttaaacaaatttacaagacaaaaaca

SEQ ID NO: 13464 - DNA, 91 bp, Homo sapiens
  misc_feature 82..84: n=a, g, c or t
gaacacttccatggattgtccttggacttagggcgccctgcccgccttttgcagaggagaaaaaacttttttttttttttknnnyccccga

SEQ ID NO: 13465 - DNA, 263 bp, Homo sapiens
gttggmcaggmtggtctcgaactcctgacctcgtgatccgcctgcctcagctaaggagtacaagaccagcctggacaacatgataaaacccccatctttactgaaaataaaaaaaaaattagctgggggtggtggcgcacacctataatcccagccacttgggaggctgaggcatgagaatcgcttgagcctgggaggcagaggttgcagtgagctgagatcgtgtcatcgcactccagcctgggtgatagagtgagacaccc

SEQ ID NO: 13466 - DNA, 482 bp, Homo sapiens
acattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaacaaaaaatagaaataaaattagaactgcgttttaagttctaatttgcatttattaatttgtccaaaagcagaactcttggaaatcccttgaaaatataagctggaatgttttacttagccatgcaagtcatttatg

SEQ ID NO: 13467 - DNA, 459 bp, Homo sapiens
actgcacgccattagtgtattatttgattgtgtatcttcaggggttttgaaagttgttcttggagaagatatcctgtaaagttgtgctttgctttagaaaaagttaacatagaaagattttattttatttttattttgagacagagtctcgctttgttgcccaggccggaatgcagtggtgtgatctcagctcactgcaacctccacctcctgggttcaggtgattctcatgcttcagcctctccagtggctgggattacgggcgtgtgccaccatgcctggctaatttttgtatttttggtggagatgcggttttgccgtgttggccaggctggtcttgaactcctggcttcaagtgtgccgcctgcattggcctcccagggtgctgggattgcaggcgtgacactgcacccggcccaaagatttaagattgctagttgaatggccgggcatagtggc

SEQ ID NO: 13468 - DNA, 132 bp, Homo sapiens
aatagccctggtacatggtacacacccccccacctcctgcaattaaacagtagcatcgccaaaaaaaaaaaaaaaaaaaaaaaaaaaaaaataaaaaaaaaaaaaaaaaaaaaaaaaaaaaaaaaaaaaaaa

SEQ ID NO: 13469 - DNA, 69 bp, Homo sapiens
aaacaccattgcactctggcctggacaacagagagaccctgcctcaaaaaaaaaaaaaaaaaaaaaaaa

SEQ ID NO: 13470 - DNA, 428 bp, Homo sapiens
agtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcggtgagtgagtgtgactgagtggcccgacggggtgcggggccgctacccagaagccccagcgtgggcccggtcctcttccccgcggccaggcccctttcccgcgtccccgccacaggtcccttctgcatccctttcccggaccccgaaatctctgggcaccacgcccgcttcccacagcgccctcgtggttccctacccacaggcccttgcggtgtgtggccttttttctttttcgtttgtct

SEQ ID NO: 13471 - DNA, 426 bp, Homo sapiens
agtgactgccgggagtcctgcaggggcggggcggcgcaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacsstgcagtctttggtgttcagagcaca

SEQ ID NO: 13472 - DNA, 461 bp, Homo sapiens
tttttctcatactgccatctgtctgaatctcagcatccagaaaatattctctgctctcaaggaattatgagattagactggctcaccaagataaacacaatctgggaaacattttataatacagagggccacaccagattgaatattgcccccaggaatgaaatraaacaggaatggattctccagtaagagggtatcacagggcgtcaaactggaaaatgtggcactgcctggagtttctacctggtgaagggtggcagacttttctcttcagaggactcttgacagggtagcatccattatcttgccaatttactacaacctaggcccaatcctcagtcttataggttcagaaatttatttttatcagcatcaacagggtagctacgttgcttagaagcaaacaaaattaaccatgcttcaatagaaatcaggatatagatgtattaatacagaatgac

SEQ ID NO: 13473 - DNA, 464 bp, Homo sapiens
  misc_feature 392: n=a, g, c or t
tccgggatttctctgtaggtgaggcgggaggctggagggagctgagcccccggggaggggcccgattccgcctcgccgcgcctctggctgctgggccgtgggtttttctcttctcctgcgagtaagaaggacgacggcccctaacccctgaattagccttctatttccattagtgacttagaagctacccggcgcctcatctgggctcacctgagctaggatcaggaaggggagggggcacagtcattgcctcgcgggcgcggcgggaccccagcggacggctttgtgcggactttcggcaccgttatgcccccctagcccgacaccacctggggctggcgcgccacgttactgttcagggccagacgcaccgccctgcctgctccgggganccggacctccgatcccggggatgggggacccgagacctcagacccaacggaggggactctgatacctcagac

SEQ ID NO: 13474 - DNA, 350 bp, Homo sapiens
tttcctgcctcagccttctgctgctttgctctctgggagatccagctccttgctctgtgtcccagtagaacatgatgtggcccatgcacaccccactgctgctgctgactgggcttctttggttccatatttgcgctctttggaatgaagtgtaccaaagtcggaggctccgataaagccaaagctaaaattgcttgtttggctgggattgtattcatactgtcagggctggtgctcaatgactggatgttccctatatgcwaacaaaatcacaacggaattctttgatcctctctttgttgagcaaaagtatgaattaggagccgctctgtttattggatgggcaggag

SEQ ID NO: 13475 - DNA, 342 bp, Homo sapiens
aattatcagatagatgtctttggagcccagccttccctgtgtagtgagctggaaactcctttagattgtattcattggtgtgtatgtatatgtacatatatgtataaatagttaaatacataaacataaaacttaacatcgcattgttgtgatgacaagaagtagtaaggtgctaggtggttacattaaaaagcacagcacagtgtataatcagtcactatgactggtggttttgtaagctgggttcagtttttgaaccacccagaatacctcatgtgtaaatacagtgttcatgacttaattgaaatacagttattgtttaaaaaaaaaaaaaaagawtgt

SEQ ID NO: 13476 - DNA, 362 bp, Homo sapiens
  misc_feature 124..125: n=a, g, c or t
ctttttccctgggttccacgcgcccggtasccgaactccgaccctgaggctccgcgtcccggcccccatcgcaggggcgcctctaggaaccagaatcccgcagatgactacacagacaagatcnncccccaagttcggcgagccgggcgcccaccgcgccccagcccacgcccccggagttcctgcgccacccacagcggccctgagcttcaatctgcactttcaaaacttcccagttgcctccagagccctgcagttgaagatcttgtctagcacatggttttgctgttttcctcagcccgaactccctccttggagggccatcgttctctgtctcagattccaccctccttatcacacaa

SEQ ID NO: 13477 - DNA, 162 bp, Homo sapiens
caaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatgggattgtttgga

SEQ ID NO: 13478 - DNA, 447 bp, Homo sapiens
tcactataggaaagcaaggaaggagaatctacagagctaatcaaattataaaagagtgatgtgaaattcaaactggaagattttgtgcttgagtcttgcttatttatctgtattttagttcatccatgaaactaacaaagataatgtgttttaaagcaattgtaagtggctatttcaagccatcttacaagagtttttagaggataatttttatattttagatctgactatattgtgatgtcagtgcctgtttttcttttttttgtgtcagacatagcttcatgtatgttcatgatagagtttaattcaacaaatatttgttgaactctgcarwtctgtacaagaagctctgtaacaacagataaaattgggctgggcgcagtggctcacgcctgtaatcccagcactttgggaggcccgaggcaggcagatcatgaggtcaggaga

SEQ ID NO: 13479 - DNA, 202 bp, Homo sapiens
cattctttttaaacattagattcccgacttaaggtgacacagttataatatttacagtatcatgttgtattaaatgagatggcccatttgtaatatatgagataacctgatacaactcagaattaaatgtacaactgaaaggtttagcattctagtcctgagccatccaaattcgctcagtgacacaggtcagatcacttat

SEQ ID NO: 13480 - DNA, 63 bp, Homo sapiens
ataaaaaaaaaaaaaaaaaaaaaaaaaaaaaaaaaaaaaaaaaaaaaaaaaaaaaaaaaaaaa

SEQ ID NO: 13481 - DNA, 495 bp, Homo sapiens
catgagtataggtccatgtttggaccatagccacactgcttgtcagctcatcgagaaaagtcaggtttcacaaaagttgcttaacagcttggagaaatcttcgggataatagatcatgttttgatcttctgcagatccagtgaacaggggtgttaagagcagagagtattatgttccctatgattaaaccttttctgagttatcctacttgctatcctaagttactacttgtgaggcaggctatgtgcttttgtttaactgttcaaaggtttggatagtgttggcttttcatgtaaagatgtcaggaatgatatgaagatttttattgttttggtctcaaggttaaattctaaattaatgatatattttatggtagaaaaacttcatttccagcctaaaaagctaatgctgattcattcattttttcttttgaaacaatgaatgttacttaatcttttaggctgacatcagggrtagccttttgtgaacwttctc

SEQ ID NO: 13482 - DNA, 466 bp, Homo sapiens
ttgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgt

SEQ ID NO: 13483 - DNA, 295 bp, Homo sapiens
aatgagctctcgccagactcgaacttgcccgtgcagctcctcaccatccgtgtggccagcaccaaccctgctgtgcrcctttgacatctgaggggcccagcagctctcctccctgcaggctgaactccactgagtacggggagctctgcrgaagctccgggcacccatccgcaggcagcccatgtggtcatccaccagagcctgggcgacctgttcctggagacatttgcctccctggtagaggtcaacccggcctactcagtgcccagcagccaggagctggaggcctgcatag

SEQ ID NO: 13484 - DNA, 374 bp, Homo sapiens
aagacttgtccagatcacaggtgcgctgctatgtccacatcatgaaagaggggctctgctctcgagtggagcacactgggactctacatggaagcaaacagacaggtgcccaaattgctgtctgctctctgtccagaagaaccaccagtccattcgtcagcccagattgtcagcaaacacctggttggagttgacaggcctcattgggccagagacacagattggagagaagtcatccattaagcgstcagkcattgggctcatcctgkctcataaaagatagagkgactattaccaattgcttctcatgaactcagtcactgtggaggaaggaagcaatrtccaaggcagtgkcatctgcaacaatgctgtgr

SEQ ID NO: 13485 - DNA, 478 bp, Homo sapiens
tcattttcattgtcatgttgtatcccattctgtgaatatgctgcaatataawttatccattctactgtttgtagacatttgggttgtttgcagcttgggctattaggaattgtgttgctgtgtattggttaacatatgtatgtattcctgttaggtatgtacctaagtgtatccatatgttcagctatatgttataaaaccagttttcaagtggttgtaccaatgtacactcccaccaacccagtatgcgagttctagtgctccacatacttgccaacatttggcattttccatcttttktactatagccattagtggtgggcatatagtgatatgtcagttttagttttcggttttattttcttgtcctccaaaccattgtagtatctccccaggatagatgagtgatggctgagacctgagacctaggcctgtdcctcacatgactgcaccattttacattctatcaatgtatgag

SEQ ID NO: 13486 - DNA, 370 bp, Homo sapiens
caaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacaatgaaaccctgtctctactaaaaataaaaaaattagccgggcgcasagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaaaa

SEQ ID NO: 13487 - DNA, 170 bp, Homo sapiens; identical to SEQ ID NO: 11644

SEQ ID NO: 13488 - DNA, 200 bp, Homo sapiens; identical to SEQ ID NO: 11569

SEQ ID NO: 13489 - DNA, 83 bp, Homo sapiens
aaacctaacttgcgcagaaaacaagatgagattggcatggctttatttgttttttttgttttgttttggtttttttttttttt

SEQ ID NO: 13490 - DNA, 200 bp, Homo sapiens; identical to SEQ ID NO: 11569

SEQ ID NO: 13491 - DNA, 482 bp, Homo sapiens
ccttacatattttaagtttggcctaaaggtttctctgtacagtgtgaactataacctaaatgtagttgtaaacagactgtagcctcctcttgtgccaaccaccaagtcttggccaatcaaaggtggccagctgttcaaaccgtgttcaaataaagcacaagccaagccgtaaccaatctggctgtttctgtacctcacttccattttctgtactgtcactttcctttttctgtccataaatcttcttccgccacgtggctgcactggagtctctgagcctactctggctcaggaggctgccggatttgcgaatccttctttgctcagttaaactttgttaaacttaatttggctaaagtttttcttttaatgttggccatcatgaaaccaataaaatctgctgagaacctaacaactagatttctttttgcctttttctgttttgtttgtctttcttttttgatctattttgtcttttctcc

SEQ ID NO: 13492 - DNA, 66 bp, Homo sapiens
attttttagacctctcccagtccttcggdactcggtctggtttatactaggtcgcgctaggggcag

SEQ ID NO: 13493 - DNA, 87 bp, Homo sapiens; identical to SEQ ID NO: 11618

SEQ ID NO: 13494 - DNA, 313 bp, Homo sapiens
  misc_feature 312..313: n=a, g, c or t
caaacagatataacactagggccgagtgaggtggctcatgcctgtaatcccaacactttgggaggctgaggacggtgtattgcttgagcccaggagttcgtgccaggtttggcaacatggccatctctataaaaaatacaaacattgaccaggtgtggtggcatgggcctgtggtcccagatacttgggaagctgaggtaggaagatcgcttgggcccaggagatgtaggttgcagtgagttgttatcacaccactgcactcctgcctgggtgacagagcaagagcctgtcgccaaaaaaaaaaaaaaaaann

SEQ ID NO: 13495 - DNA, 254 bp, Homo sapiens
tttggggggccgaggtgggcggatcacggggtcaggagattgaccatcccggctggcacggtgagaccccatctctactaaaaatacaaaaaagttggccgggcatggtggcgggtgcctgtagtcccagctactcgggaggctgaggcaggagaatggtgtgaactggggggtggaggttgcagtgagccgagatcgtgccacagcgctccagcctgggtgaaagaccgagactccatcccaaaaagaaaaaa

SEQ ID NO: 13496 - DNA, 312 bp, Homo sapiens
tatacatatataatattatatatatttggtctgtttgtagttttattactagatgattttttcggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgcsccgcccccagaaaaaaaaaaaaaagg

SEQ ID NO: 13497 - DNA, 72 bp, Homo sapiens
tatattgtttcccaagaagttctacttggtttcatttcaaacctgcctggtttttttgtttgtttgttttta

SEQ ID NO: 13498 - DNA, 50 bp, Homo sapiens; identical to SEQ ID NO: 12165

SEQ ID NO: 13499 - DNA, 82 bp, Homo sapiens; identical to SEQ ID NO: 11689

SEQ ID NO: 13500 - DNA, 200 bp, Homo sapiens; identical to SEQ ID NO: 11569

SEQ ID NO: 13501 - DNA, 354 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctascactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagta

SEQ ID NO: 13502 - DNA, 329 bp, Homo sapiens
atttttggattttctttaaaaatgcacattccaggctgggcgcagtggctcacgtgtgtaatcccagtactttgggaggctgagggcggatcacaaagccaggagttcaagaccaacctgggcaatatggtgaaaccccatctctactaaaaatataaaaagttagccaggtatggtggcacaagcctgtagtcccagccacttgggaggctgaggcagaagaatcacttgaacccgggaggcggaggttgcagtgagccgagatcgtgccactgcactcaagcctaggcaacagagtaagactctgtctcgaaaaaaaaaaaaaaaaa

SEQ ID NO: 13503 - DNA, 321 bp, Homo sapiens
taatcatttttaggccgggtgcagtggctcatgcctgtaatcccagcactttgggaggctgagacaggtggatcacttgaggtcaggagtttgagacctgcctggccaacatgatgaaaccctgtctctactaaaaatgcaaaaaaaattagccaggcatggtggcatgtgcctgtagtcccaactactcaggaggctgaggcaggagaatcacttgaacctgggaggcagaggttgcaatgagctgagatcgcaacactgcactccagcctgggcgacagagcaagactccatctcaaagaacaaaaaaaaaaaaaaaaa

SEQ ID NO: 13504 - DNA, 201 bp, Homo sapiens
actctacccaggcgtaaatagagctccctactccagaccacctgccacccacctcccaagttgagaacacaagctccagctgggctgagagtcaggcttggtgcagggtgactttggcgaagttttgtcagatccataaagcaaactggaatttgagctttcacttaccctagtatacgttcttaaaaaaaaaaaaaaaaa

SEQ ID NO: 13505 - DNA, 481 bp, Homo sapiens
aaccttaaatagatgtaatttctatttgtcaatgatgcctcagcaaagctagggagaaaataaaaaggatccttctgtgcaacrcccgcatgtccattaccgatgactggataaagaaaacgtgctccacccatgcagtggaatactacgcagccataaaacggaatgaagctcggatccaagctagaacgtaggtgagccttggaaacgtggcgctgagtgagagaagctggacacaaaataaggccaggaatggtggctcacagccgtaatcccagcactttacgaggccaagatgggcagatcacttgagtccaggagtttgaggccagcctgggcaacatgacgaaatcctgcctctacaaaaaatacaaaagttagccaggagttcatttagaggagtcatgtgactatagtcccagctactcaggaggctgagatgggagaatcacttgagcctggggaggtggaggttacagtg

SEQ ID NO: 13506 - DNA, 154 bp, Homo sapiens
ttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggct

SEQ ID NO: 13507 - DNA, 138 bp, Homo sapiens
aggtagctgcgaggaaacttttgcagcggctgggtagcagcacgtctcttgctcctcagggccactgccaggcttgccgagtcctgggactgctctcgctccggctgccactctcccgcgctctcctagctccctgcg

SEQ ID NO: 13508 - DNA, 330 bp, Homo sapiens
atagctggtgtctctatttaaaaaaggatcttttggccaggcacagtggctcacacctgtaatcccagcactttgggaggccaaagtggatgaatcacttaatttcaggagtttgagaccagcctggccaacatagtgaagccccatctctactaaaaatgcacaaaaaattagccaggtgtggtggcggatgctgtaattccagctactccagaagctgaggcaggagaatcactggagcctgggagagtgaggttgcagtgagctgagattgcatcattgtactccaacctgggtgacaagagcaagactctatctcaaaaaaaaaaa

SEQ ID NO: 13509 - DNA, 336 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccacaaaaaaaaaaaaaaa

SEQ ID NO: 13510 - DNA, 383 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaacccaaaaaraaaaaaaaaar

SEQ ID NO: 13511 - DNA, 112 bp, Homo sapiens
ctaaaaattagccaggcctggtggcaggtgactgtaatgccagctactcgggaggctgaggtaagagaattgcttgaacctgggtggaagaagttgcagtgagccaagattg

SEQ ID NO: 13512 - DNA, 293 bp, Homo sapiens
  misc_feature 18..19: n=a, g, c or t
catctttgggccgggcknngtggctcacgcctgtaatcccagcactttgggaggccgaggcgggcggatcacgaggtcaggagatggagaccatcctggctaacacggtgaaacccgtctctactaaaaatacaaaaaattagccgggcgtggttgcgggcgcctgtagtcccagctactcaggaggctgaggcaggagaatggcgtgaacccgggaggcggasttgcagtgagccgagatcgcgccactgcactccagcctgggccacagagcgagactccgtctcaaaaaa

SEQ ID NO: 13513 - DNA, 495 bp, Homo sapiens
aaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacagagagaccctgtctggaggggtggggggagaaaaaaacaccatagaaacaacccaaatgtccaataacaaattgtagtccatccatacaatggactactactcagccatgaaaaggaatacagcactcacatatgctgcatgtgaatgaaccctggaagcattatgctcagtgtaagaacccagacataaaaggtcacacattttatgattccaccta

SEQ ID NO: 13514 - DNA, 483 bp, Homo sapiens
  misc_feature 98,480: n=a, g, c or t
cataggaagtttaggtaaggcaggagaaagtgttccaggtagagggaacagcatatgcagaagccaggaaggaggtgagatcatagcgtatgtttggnaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagctaatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaangct

SEQ ID NO: 13515 - DNA, 337 bp, Homo sapiens
  misc_feature 120,129,228,276: n=a, g, c or t
tcaagaaaaaaaatttttttttttttggaagaatttgaaagctgctgatccagagtcattcctttaagaaaatgggccgggcatggtggctcacacctgtaatcctggmacttcgggarnccagggcanatggatcagttgagctcaggawtgtgagacmagcctgggcaatgtggcaaaaccccgcctctacaaaaaatacaaaaactaggtgggsatggtggcatncgcctktagtcccagstactgggraggccgaggtgggaggatggcttnagcccggaaggcaraggttgtagtgagctgagattgcagsactgsactccagcstgggcaa

SEQ ID NO: 13516 - DNA, 267 bp, Homo sapiens
atttttgtgacsagcctaggcgacatagtgagacctgtctctacaaaaaatatataattagctgggcgtggtggcgcgcgcctgtggtccaagcttctccggagctgaggtcgggggatcgcctgagccctggaggtcgttgctgcattgagccgtgaacgcaccactgcattccagcctgggcaacagagcgaactctatctcaaaacaaaacaaaacaaaacaagaaaaagaaaaaaagaagaaaattaaaaaaaaaaaaaaaaa

SEQ ID NO: 13517 - DNA, 207 bp, Homo sapiens
tgtttaatgccatttattttttaagatgggatatatattttaattagctgggcgtcgtggcgggtgcctgtggtcccagctactcaggaggctgaggcaggggaatgccgtgaacccggagcagagcttgcagtgaaccgagatcacaccactgcactccagcctgggcgaccgagtgagactccatcgcaaaaaaaaaaaaaaaaa

SEQ ID NO: 13518 - DNA, 378 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaa

SEQ ID NO: 13519 - DNA, 372 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaa

SEQ ID NO: 13520 - DNA, 271 bp, Homo sapiens
  misc_feature 261: n=a, g, c or t
aatgactagtgttctgttatggaaaaaataagaaacatggacatttccaggttgccctagctctgctcttcatagctgttcgggtcctattactttaccaccataagatatcacaagaggccaggcaggatgtctcacacctgtaatctcagcactttgggaggctgaggcgggcagatcacgaggtcaagatttcaggaccatcctggccaatatggtgaaacccgtctctactaaaaatacaaaaaaaaaaaaaaaaansggcacgaga

SEQ ID NO: 13521 - DNA, 144 bp, Homo sapiens
ctttaggtgtattaagatataaggccaggctgggcatggtggctcatgctgtaatcccagcactttgagtggctgaggtgggaggatcacttgagcccaggatttcaaggcgagcctgggacacatggtgaaaccctgtctctg

SEQ ID NO: 13522 - DNA, 225 bp, Homo sapiens; identical to SEQ ID NO: 11617

SEQ ID NO: 13523 - DNA, 247 bp, Homo sapiens
atacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaact

SEQ ID NO: 13524 - DNA, 119 bp, Homo sapiens
ctttaggtgtattaagatataaggccaggctgggcatggtggctcatgctgtaatcccagcactttgagtggctgaggtgggaggatcacttgagcccaggatttcaaggcgagcttgg

SEQ ID NO: 13525 - DNA, 243 bp, Homo sapiens; identical to SEQ ID NO: 12213

SEQ ID NO: 13526 - DNA, 82 bp, Homo sapiens; identical to SEQ ID NO: 11689

SEQ ID NO: 13527 - DNA, 310 bp, Homo sapiens
tatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgcccccaaaaaaaaaaaaaaaa

SEQ ID NO: 13528 - DNA, 200 bp, Homo sapiens; identical to SEQ ID NO: 11569

SEQ ID NO: 13529 - DNA, 170 bp, Homo sapiens; identical to SEQ ID NO: 11644

SEQ ID NO: 13530 - DNA, 337 bp, Homo sapiens
cctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtccaaaaaaaaaaaaaaaaag

SEQ ID NO: 13531 - DNA, 63 bp, Homo sapiens
gcaggttcgctttccggcggttgcaccgggccggggtgccagcgcccgccttcccgtaaccac

SEQ ID NO: 13532 - DNA, 133 bp, Homo sapiens
ctttaggtgtattaagatataaggccaggctgggcatggtggctcatgcctgtaatcccagcactttgagtggctgaggtgggaggatcacttgagcccaggatttcaaggcgagcctgggacacatggtgaa

SEQ ID NO: 13533 - DNA, 97 bp, Homo sapiens
ccttctccccggcggttaagtgctgagagtgcggagtgtgtgctccgggctcggaacacacatttattattaaaaaatccaaaaaaaaaaaaaaaaa

SEQ ID NO: 13534 - DNA, 115 bp, Homo sapiens
ctttaggtgtattaagatataaggccaggctgggcatggtggctcatgcctgtaatcccagcactttgagtggctgaggtgggaggatcacttgagcccaggattccaaggcgag

SEQ ID NO: 13535 - DNA, 374 bp, Homo sapiens
gtgagccgagatcttgccactgcactccagccagggtgatggagtgagactctcagaaaaaaattagtgccaggcacaggggctcacacctataatccccgcactttggcaggccaggtgggcaaattgcttgagcccaggagttcgagascagcctgggcaacatggcgaaaccctgtctaacaaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaarcccaaaaraaa

SEQ ID NO: 13536 - DNA, 254 bp, Homo sapiens
  misc_feature 237: n=a, g, c or t
ccgaggtgggtgtatcacctgaggtcaggagtttgagaccagcctggacaacatggtaaaaccccgtctctgctaaaaatacaagagttagctgggcgtggtggcaggcacctgtggtcccagctactcgggaggctgaggcaggagaattgcttgagcccaggaggcagaggttgcagtgagccaagatcatgcccctgcactccagcctaggcgacagagctagactctgtctcnaaaaaaaaaaaaaaaaa

SEQ ID NO: 13537 - DNA, 344 bp, Homo sapiens
taaatgatatcgtttggatgtttgtaccctccaaatctcatgttgaaatgtgatcttcaatcttggaggtggagcctaatgggaaatgtttggatcatgggggcagatcctttataaatggattggtgccttcccagcagtaaatgtgagtgagttctagctctcctacttcatgcaacagctggttgtttaaagagcttggcaccccctcttctctctcttgatcactctcttcaccttgtgacacccctgctctccttttgccttctaccaccattgtaagcttcctgaggccctcatcagaagcagatgctggtgccatgccttttttttttttttttttt

SEQ ID NO: 13538 - DNA, 200 bp, Homo sapiens; identical to SEQ ID NO: 11569

SEQ ID NO: 13539 - DNA, 112 bp, Homo sapiens; identical to SEQ ID NO: 11643

SEQ ID NO: 13540 - DNA, 354 bp, Homo sapiens
tattttattataaatcaggacctttcgtggaactgtattgaaattaattatcctgggcctggcgcggtggctcatgcctgtaatcccagcgctttgggaggccaaggtgggcggatcatgaggtcaagagatcgagaccatcctggctagcacggtgaaacccgtctctactaaaaaatacaaaaaaaattagctgggcatggtggtggtgcctgtggtcccggctactcgggaggctgaggcaggagaatggcgtgaacgtgagaggtggagcttgcagtgagctgagatcgcgctactgcattccagcctgggcaaacagcaagactctgtctccaaaaaaaaaaaaaaaaa

SEQ ID NO: 13541 - DNA, 309 bp, Homo sapiens
aatggtagagacaggktttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtactgtagtcccagctacttgggaggctgaggcaggagaatagcttggacccaggaggtggaggttgcagtgagcccagatcacgcaaatgtcactgtactccagcctgggtggca

SEQ ID NO: 13542 - DNA, 348 bp, Homo sapiens
  misc_feature 331,333: n=a, g, c or t
catataacctttaaaaaataccatacatatttatgaatgcaatrttaaaaccagctataggagtacggctggcgtggtggctcatgcctgcaatctcagcactttgggaggcagaggcgggcggatcactcgaggtcaggagttcaggaccagcctggccaacatggtgaaacctgtctctactggggatacaaaaagtagctgggcatggtggccgcacgcctgtaatcccagctacttgggaggctgaggcaggagaatcgcttgaaccccggagcggaggttgcggtgagcggagattgcgccactgcactccggcctgtgtaacagnantgagactctgtctca

SEQ ID NO: 13543 - DNA, 361 bp, Homo sapiens; identical to SEQ ID NO: 11695

SEQ ID NO: 13544 - DNA, 161 bp, Homo sapiens
ctttaggtgtattaagatataaggccaggctgggcatggtggctcatgctgtaatcccagcactttgagtggctgaggtgggaggatcacttgagcccaggattccaaggcgagcctgggacacatggtgaamcctgtctctgcaaaaaaaaaaaaaaaaa

SEQ ID NO: 13545 - DNA, 200 bp, Homo sapiens; identical to SEQ ID NO: 11569

SEQ ID NO: 13546 - DNA, 449 bp, Homo sapiens
acgcaaagcccggagcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagacttcagattttcctgtccttgatcccagctggactgctcaagaagaaatggcccttttagaagctgatggactgtggctttggaaattggcaggatgtagccaatcaaatgtgcaccaagaccaaggaggagtgtgagaagcactatatgaagcat

SEQ ID NO: 13547 - DNA, 129 bp, Homo sapiens; identical to SEQ ID NO: 11756

SEQ ID NO: 13548 - DNA, 232 bp, Homo sapiens
gacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatgga

SEQ ID NO: 13549 - DNA, 134 bp, Homo sapiens; identical to SEQ ID NO: 12228

SEQ ID NO: 13550 - DNA, 170 bp, Homo sapiens; identical to SEQ ID NO: 11644

SEQ ID NO: 13551 - DNA, 225 bp, Homo sapiens; identical to SEQ ID NO: 11617

SEQ ID NO: 13552 - DNA, 97 bp, Homo sapiens
tacaaaaaattagctgggcgtggtggcaggcgcctgtggtcccagctactcgggaggctgaggcaggagaatagtgtgaacccaggaggcggasttg

SEQ ID NO: 13553 - DNA, 162 bp, Homo sapiens; identical to SEQ ID NO: 12335

SEQ ID NO: 13554 - DNA, 78 bp, Homo sapiens; identical to SEQ ID NO: 11631

SEQ ID NO: 13555 - DNA, 338 bp, Homo sapiens
  misc_feature 14,16: n=a, g, c or t
aatggtagagacangntttcaccatgttggccaagctggtctcaaactcctgacctcatgcctgtaatcccagcagtttgggaggccaaggcgggtggatcacctgagatcaggagttcaagaccagcctggccaacatggcgaaaccccattctactaaaaatacaaaaaattagccgggcatggtggtgggtacctgtagtcccagctacttgggaggctgaggcaggagaatagcttggacccaggaggtggaggttgcagtgagcccagatcacgcaaatgtcactgtactccagcctgggtggcagggtgagaatccatctcaaaaaacaaaa

SEQ ID NO: 13556 - DNA, 446 bp, Homo sapiens
ctcttcgcttgcagatacccccgagatcggtaattctaagggctcctaaagaatgaagtctgagcgtagatcgggggacgcccgctgtactgtatccagccatgccgcgtttatacaaatagcagtgaagttagaactgtgtagaacgaatctttgcaaaaggaatcggagtataaattgaggcggtgagacttggttccttaagcttgccaaactcccaaagattcgagctacagaaagacccccctggctgctgaaaggagttgggagaggcttaggtaaataacaaggcaggcttattgggaatatacaccggctgtgtctgtaagtgcacaatcacattacataattacgttagggccgggcgcggcggctcgcgctgtaaccccggcacttcgggaggcccaggggggcggatcacttgagctcggttggagaccagcctg

SEQ ID NO: 13557 - DNA, 419 bp, Homo sapiens
gttattttgcgtgaattggtgaggacattaagtccgggtagaaagaaatgtcaggagtagaggtgaagactttaaagaaatacgttgttaaatgctgaatctttgcttgtttgggtgtgttttgtwrwwgtttgtttttgtttttgagacggagtttcgctttcgatgcccaggctggagtgcagtggcgcgatctcggctcaccgcaacctcasyctcccgggttcaagcgattctgctgcctcagcccctcgagtmgctgggattacaggcatgcaccaccacgcccggctaattytgtatttytagtmsagttggggtttctccatgttggtcagggtggtctcaaactcccgacctcaggygatccacctgyttgggcctcccaaggtgctgggattacaggcgtgagccactgs

SEQ ID NO: 13558 - DNA, 125 bp, Homo sapiens; identical to SEQ ID NO: 12173

SEQ ID NO: 13559 - DNA, 129 bp, Homo sapiens
tttaaatataaataaatgaaaataatacttctccctgatcataaagaaaatcacattcttasaggccgggcatggtggctcatgcctgtggtcccagcactttggaaggtcgaagtgggtggrtcatka

SEQ ID NO: 13560 - DNA, 380 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcactttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatcaaaaaaaaaaaaaa

SEQ ID NO: 13561 - DNA, 285 bp, Homo sapiens
aaaaagtccctgggaagckgccgggcgcggtggstcacccctgtaatcccagsagtttrggakgccgakgcgggtgcatcatctaaggtcaagagttcgagacaagtctggccaagatggtgaaaccccgtctctacgaaaaatacaaaaattagccgggcgtggtggcccatgcctgwaatctcagttactcgggaggctgagacaggrgaattgcttgaacccgggaggcggaggttgmagtgacccgagatctcgccaccgcastccagcctgggcgacaga

SEQ ID NO: 13562 - DNA, 83 bp, Homo sapiens; identical to SEQ ID NO: 13489

SEQ ID NO: 13563 - DNA, 383 bp, Homo sapiens; identical to SEQ ID NO: 12067

SEQ ID NO: 13564 - DNA, 310 bp, Homo sapiens
tatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccatcctggccttcctttcctctttcctcctcactctccccgtcatgctcsctctgcsccgcscccaaaaaaaaaaaaaaaa

SEQ ID NO: 13565 - DNA, 203 bp, Homo sapiens; identical to SEQ ID NO: 12721

SEQ ID NO: 13566 - DNA, 93 bp, Homo sapiens
ctttaggtgtattaagatataaggccaggctgggcatggtggctcatgctgtaatcccagcactttgagtggctgaggtgggaggatcacttg

SEQ ID NO: 13567 - DNA, 119 bp, Homo sapiens
ctttaggtgtattaagatataaggccaggctgggcatggtggctcatgcctgtaatcccagcactttgagtggctgaggtgggaggatcacttgagcccaggatttcaaggcgagcctg

SEQ ID NO: 13568 - DNA, 297 bp, Homo sapiens
cagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctc

SEQ ID NO: 13569 - DNA, 156 bp, Homo sapiens
tacaaaaaattagctgggcgtggtggcaggcgctgtggtcccagctactcgggaggctgaggcaggagaatagtgtgaacccaggaggcggasttgcagtgagccaagatagtgccactgcacttcagcctgggtgacagagtgagactctgtcac

SEQ ID NO: 13570 - DNA, 324 bp, Homo sapiens; identical to SEQ ID NO: 12122

SEQ ID NO: 13571 - DNA, 115 bp, Homo sapiens
ttaggcccaagaattacctgaacctgggacgtggaggttgcggtgagccaagatcgcaccactgtaccctagcctgggcaacagagtgactcttaaaaaaaaaaaaaaaaacaaa

SEQ ID NO: 13572 - DNA, 109 bp, Homo sapiens; identical to SEQ ID NO: 11741

SEQ ID NO: 13573 - DNA, 224 bp, Homo sapiens; identical to SEQ ID NO: 11519

SEQ ID NO: 13574 - DNA, 342 bp, Homo sapiens
tattttattataaatcaggacctttcgtggaactgtattgaaattaattatcctgggcctggcgcggtggctcatgcctgtaatcccagcgctttgggaggccaaggtgggcggatcatgaggtcaagagatcgagaccatcctggctagcacggtgaaacccgtctctactaaaaaatacaaaaaaaattagctgggcatggtggtcgtgcctgtggtcccggctactcgggaggctgaggcaggagaatggcgtgaacgtgagaggtggagcttgcagtgagctgagatcgcgctactgcattccagcctgggcaaacagcaagactctgtctccaaaaa

SEQ ID NO: 13575 - DNA, 200 bp, Homo sapiens; identical to SEQ ID NO: 11569

SEQ ID NO: 13576 - DNA, 161 bp, Homo sapiens; identical to SEQ ID NO: 12070

SEQ ID NO: 13577 - DNA, 149 bp, Homo sapiens
aatatgagttcatgtcctttgcagggacatggatgaagctagaagcaaccattctcagcaaactaacacaggagcagaaaamcaaacacctcatgttctsactcgtaagtgggagttgaacaatgagaacatatgggcacagggagggg

SEQ ID NO: 13578 - DNA, 312 bp, Homo sapiens
tatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgcccccaaaaaaaaaaaaaaaagg

SEQ ID NO: 13579 - DNA, 70 bp, Homo sapiens
ataaaaaaaaaaaaaaaaaaaaaaaaaaaaaaaaaaaaaaaaaaaaaaaaaaaaaaaaaaaaaaaaaaaa

SEQ ID NO: 13580 - DNA, 51 bp, Homo sapiens
astggctgctctgaaaagcsatctttgcattgttsstcatccgcstscttg

SEQ ID NO: 13581 - DNA, 272 bp, Homo sapiens
acctgtggctgccgctcgccgctctccggggcgggaacttccactcybccctcccaggagctgtaccccacccgccctacgtccgcttccggagccatgagcagctgggtgctcgcggggggcgttttcatcgattagtggcggcgctgtcaactcacctgccaattgaccttgaccgacgccggccctgtcctcttggaaggagaaatgaagagtgaaggctttgacttcctcagcttttttttttttttttttttttaaaagggrscccc

SEQ ID NO: 13582 - DNA, 111 bp, Homo sapiens
ttaggcccaagaattacctgaacctgggacgtggaggttgcggtgagccaagatcgcaccactgtaccctagcctgggcaacagagtgactcttaaaaagaaaaaaaaaaa

SEQ ID NO: 13583 - DNA, 152 bp, Homo sapiens
atcgaaaaattagctgggsgtggtgtgtgsmtgtggttccagccacatgggaggstggcgcatccccatgsttgagsmcaggaggtttaggctgcagtgagctgtgttcatgccactgcactccagcctgggcaacagagcaagaccctgtc

SEQ ID NO: 13584 - DNA, 412 bp, Homo sapiens
gactgacaactcacacggctgggtactcttctgagacaaaacttccagaggagcgatcaggcagcaacatttgctgttcaccaatatccattgttctgcagcctctgctgtgatacccaggcaaacagggtctggagtggacctccaaactccaacccacctgcagctgagggtcctgactgttagaaggaaaactaacaaacagaaaggacatccacaccaaaaccccatctgtacatcaccatcatcaaagaccaaaggtagataaaaccacaaacatggggaaaaaacagagcagaaaaactgaaaattctaaaaatcagagcgcctctcttcctccgaagaatgcacctcctcaccagcaatggaacaaagctggagggagatgactttgacgagttgagagaagaag

SEQ ID NO: 13585 - DNA, 221 bp, Homo sapiens
aaaaacgcaattctcgagtctatggctccggccgagagttgagtctggacgtcccgagccgccgcccccaaacctcgagcgggagagcgggtcggagggtctagggagagccaaagcggggtggacagggaggcagcttgtgaatttttgttttactgtttaactttattaaaaaagaaaaaaaaaaagaaaaaaaaaaaaaaaaaaaaaaaaaaaaaaaa

SEQ ID NO: 13586 - DNA, 504 bp, Homo sapiens
  misc_feature 176: n=a, g, c or t
acatatcccctcctggaaaggctgcagtgaggcagctctgtttcattctactgccaccgcctctggtcctagaaaacactgagtttctggcctgatcacttgaacggacatatcaagcaggtgcacacttctgagctgcctcacaagtgtcaggtgtgggttgggagcagcagcgncctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagaggcagcagggcctttacccagtggcctgttggctagcctgggcctccctggagagggttgacagtggaagggaacaggaggggcatttggcctgagacccctgcatttg

SEQ ID NO: 13587 - DNA, 374 bp, Homo sapiens
tagattataaaatgactatgtttaataaaattttaaaaataaaagagggagagaatgggctcaaaaaaagaaataaaaggctgggcatggtggctcgcacctgtggtcccagcactttggaaggccgagacgggcggatcatgaggtcaggagatcgagaccatcctggccaaaatggtgaaacccgtcattgctaaaggtacagaaattagttgggtgtggtggcatgcacctgtagtccaggctgctcgggaggctgaggcgggagagtcgcatgaacccgggaggcagaggttgcagtgagccgggatcgcgtcactgcactccagcctggatgacagagcgagactccgtcccaaaaaaaaaaaaaaaag

SEQ ID NO: 13588 - DNA, 313 bp, Homo sapiens
taaaaaagaaggtgggctgggcgcggtggctcacacctgtaatcccagcactttgggaggccgagacgggcggatcatgaggtcaggagatcgagaccatcctggctaacacagtgwaascctgtctctactgaaaatacaaaaaattagccaggcatggtggcgggcgcctgtagtcccagctactcgggaggctgaggcaggagaatggtgtgaacctgggaggtggagcttgcagtgagcagagatagctgcactgcattccagcctgggtgacagagcgagactctgtctccaaaaaaaaaaaaaaaaa

SEQ ID NO: 13589 - DNA, 175 bp, Homo sapiens
tatattgtttcccaagaagttctacttggtttcatttcaaacctgcctggtttttttgtttgtttgtttttatttttgttttgagacgaagttgggggtttcatgtcattgcactccagcctgggcaacaagagcgaaactccatctccaaaaaaaaaaaaaaaaaaaaaaaaaa

SEQ ID NO: 13590 - DNA, 366 bp, Homo sapiens
aaggatgtcaaaatgaaaatggtaccataaatagccaacgttgattaaaattaaacatgattactttaacaaaaagaaacttaaggccaggtatggtgggtcatgcctgtaatcctagcdctttgggaggctgaagtggaaggatcacttgagcccaggagttcaagaccagcctggagaacacagagagacccccaccatctcttccaaaaataaaaactagccaggcatggtggctcaggcctgtagtcccagctacttgggaggctgaggtgggagaattgcttgagcccaggagtctgaaactgcggtaagccatgatctcactactgcactccagcctgggcaagagtaagaccctgtatc

SEQ ID NO: 13591 - DNA, 175 bp, Homo sapiens
tgaatataattagtctcatttgaratttagtagctgaacatatactgtattaattaasaatactggtcaggcacgttggctcatgcstgtcatcccagcactttgggaggccggggcaggaggatcagtcaagaccgggagtttgagactaacctgggcaacagagcaagaccct

SEQ ID NO: 13592 - DNA, 132 bp, Homo sapiens
  misc_feature 34: n=a, g, c or t
gggagaagctcggcgcatcattgggcggtggacngcccctcggccccggggtargctgacasgggawggtcctcabctaaagccaaaagcagatcaaagtggtgggactcgcgtcgcggccgcggagacgtg

SEQ ID NO: 13593 - DNA, 235 bp, Homo sapiens
agagtggtggcatctgagaggctggtcgtggactgtggttgggggaggtgggagctgttttaaccktgtgccccctctcctgtgccggcgtgggcatsccccggggcagtggaacgcagggcgctcctccagcttccgagtccagccagcctgggcgcggggcgcgccccgtagacacccgatgagtccgttcctccctggttacgtggactgtggaggttcgcgcgtagtggcg

SEQ ID NO: 13594 - DNA, 144 bp, Homo sapiens
  misc_feature 50: n=a, g, c or t
ctttaggtgtattaagatataaggccaggctgggcatggtggctcatgcntgtaatcccagcactttgagtggctgaggtgggaaggatcacttggagcccaggatttcaaggcgagcctgggacacatggtgaaaacccttgt

SEQ ID NO: 13595 - DNA, 173 bp, Homo sapiens; identical to SEQ ID NO: 11575

SEQ ID NO: 13596 - DNA, 111 bp, Homo sapiens; identical to SEQ ID NO: 11891

SEQ ID NO: 13597 - DNA, 270 bp, Homo sapiens
aaaaagtccctgggaagcggccgggcgcggtggctcacccctgtaatcccagcagtttgggaggccgaggcgggtgcatcatctaaggtcaagagttcgagacaagtctggccaagatggtgaaaccccgtctctacgaaaaatacaaaaattagccgggcgtggtggctcatgcctgtaatctcagctacaggagaattgcttgaacccgggaggcggaggttgcagtgacccgagatctcgccaccgcactccagcctgggcgacaga

SEQ ID NO: 13598 - DNA, 306 bp, Homo sapiens; identical to SEQ ID NO: 12064

SEQ ID NO: 13599 - DNA, 225 bp, Homo sapiens
cacgagactccatctttaaaaaaaaacaagacgggccggcacgtggctcacgcctgtaatcccagcactgagaggccgatcacttgaggtcaggagttcgggaccagcctggccggcatggtggaaccccatctctactgaaaaatacaaaaattagccgggcatggtggcacacacctgtaatcgtagctggggcaggagaatcgcctgaacccgggaggcgga

SEQ ID NO: 13600 - DNA, 157 bp, Homo sapiens; identical to SEQ ID NO: 12187

SEQ ID NO: 13601 - DNA, 81 bp, Homo sapiens; identical to SEQ ID NO: 12198

SEQ ID NO: 13602 - DNA, 375 bp, Homo sapiens
ttccttccttaagtgatgagtaaaattcatcagtgttgccatctgggcttcaagttcttcttgtatgatagtctgattagagagtcagtttctttcacagttgtaaggttgttgatactcagattttctatttctcttgtattggttttaatacattggggttttttttttaaggattttgactctttcatatacgttttccaatttattgacataaagatgttaagattctatacggagaccccgttttcatttctgatattagttttgcctttgatcaactctatgatatgtctcttccctgtttcactaatttctactcccatctttattatttttgtccttattcaatatgctgttccttttctaacttct

SEQ ID NO: 13603 - DNA, 125 bp, Homo sapiens; identical to SEQ ID NO: 11934

SEQ ID NO: 13604 - DNA, 312 bp, Homo sapiens; identical to SEQ ID NO: 12418

SEQ ID NO: 13605 - DNA, 342 bp, Homo sapiens
ttgaaaaaataggacaagaacttatttttaaaaagaggccaggtgcggtggcccatgcctgtaataccagtactttgggaggccgaggtgggcggatcacctgagatggggagttcgagaccagcctggccaacatggtgaagccccgtctctactaagaatacaaaggttggccgggcttggtggcgggcacttgtaatcccaactactcaggagtctgaggcatgagtgtcgcttgaacctgggaggcagaggttgcagtgagctgaggtcacaccgttgcactctagcctgggagacaagagggaaactctgtctccaaaaaaaaaaaaaaaaaaatta

SEQ ID NO: 13606 - DNA, 183 bp, Homo sapiens
ttttaggcgtcacgcaaaggccagcctcctggccccaatacccattttggaagcccctgtggccgtgtggatgtcggtaacagttgtataaaataawttctatttatcgctattgtaaaaaaaaaaaaaaaaaaaaaaaaaaaaaagaaaaaaaaaaaaaaaaaaaaaaaaaaaaaaaaaaaa

SEQ ID NO: 13607 - DNA, 112 bp, Homo sapiens
ttaggcccaagaattacctgaacctgggacgtggaggttgcggtgagccaagatcgcaccactgtaccctagcctgggcaacagagtgactcttaaaaaaaaaaaaaaaaac

SEQ ID NO: 13608 - DNA, 120 bp, Homo sapiens
ttaggcccaagaattacctgaacctgggacgtggaggttgcggtgagccaagatcgcaccactgtaccctagcctgggcaacagagtgactcttaaaaakrataaaaaaaaaacaaaaaa

SEQ ID NO: 13609 - DNA, 108 bp, Homo sapiens; identical to SEQ ID NO: 11964

SEQ ID NO: 13610 - DNA, 399 bp, Homo sapiens
  misc_feature 94: n=a, g, c or t
acgccttgtmggchggrggtggggctgcttttgcttcctttagahrrrcgggcagggagaggaagctctagctccrgrcctgagtttccccgangctgcgtcggaagagctgcaggrcgarcccggacggctgccgtctccrccagaagccaccccggcccggcctccagggcgcagaggcgcccccctccatcctcccccatcccgggggtcacggcargggggccgcacagcrcggctgggaccgattcggtgamggcccaaggaagctgggcgcagggctcgcctctmccgcctcgatcctgcaccttcctctcccaggtcgctgctgcagcmaacccagtagcccccttarcgcmccctcggaccccgcagctccagactccgctttggcaccts

SEQ ID NO: 13611 - DNA, 377 bp, Homo sapiens
acctaatggcgcctggcaatggccggcggcccggcccttcgctgtccctcggtcctcggggtgtcagggacagctccgcgtcgccttgtctcgcttcttcggggccacgggtccagctagacacgcttagcctttaacactcaagccggattctcagaccgctccttcgctctcgcgaccacggctgcmctctccaccccaccgactcccgcccatttctcgttctcaggagttggcttggagtgccagaccctcgatcacggcacctctaggaaagagcctgcmtctcttccttcccttccccggctaccgagcgacttcaagttttcgtgcgcmggaatgamgggctcaagccccaacctcctgctccctcggcm

SEQ ID NO: 13612 - DNA, 303 bp, Homo sapiens
cccgggttcaagcgattttcctgcctcagcctctccagtagctgggattacaggcgcgcaccaccacgcccagctaatttttgtatttttagtagagaargggtttcaccatgttggccagarmtggtggtgggcacctgtagtcccagctactcgggaggctgaggcgggagaatcgcttgaacccgggaggcagaggttgcagtgagccgagatcgcgccactgcaatccaacctgggcaacagagtgagaccccatctcaaaaacaaaacaaacaaaacaaaacaaaaaaaaaaaaaaaa

SEQ ID NO: 13613 - DNA, 506 bp, Homo sapiens
atttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgcagtttaatgtgtgagggcttatgtgtaacgtatgtwcaggaaatagaaggataaatggcagagctgaaagtttaggtgggatggggagaaaagacaaatataactaaaatacaagctatattccccactctacaacaacaaatgcctgaagagagaaaaaggtaaagtctcttagggtgaagggactaattttggtgagaaaattttctctttgggaatctgacaccttagaaagtaacactgagt

SEQ ID NO: 13614 - DNA, 165 bp, Homo sapiens
tagcaataaaaactttagtgaaaacttattgttgatgttacgtgcttttctaggcacatgtcacttccctgtcaaggatgagtaatatttcctctttatagtatattgtttttttacaacatttagagtgattaactctgttcaagccctttttttttttttttt

SEQ ID NO: 13615 - DNA, 504 bp, Homo sapiens
aagggcttttsgggagtcacggtctgavggcgacccgggcgacccggtcgcccgtgcccggctgccactgaccgctccaacgccgccagggacgacccgccagctgcctccggagccgagcaggccccgaaccttcccattcctagatttccagccgcacaacagccgcggtgcccctggctcgacgcagctggccggagsgcggactggtcgttcgtccctcccgccgttccgcgcccctctcccggctcttgtttcctcgcctcttaacgaggcctttgtgaggaaggttgctgggccttgggactctgacgatcggctggaaaccaggcctggccctgtttcagcatccccgcgtgccaagccctgggccggcgtgcgggtccctgcccctgcgaggaagctgggacttttgcaggcctgggtggagacgtgtacataacagaggaagartgtggaggattggaggactcarggcagcacggcagagtagagatggagttc

SEQ ID NO: 13616 - DNA, 198 bp, Homo sapiens
ctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaa

SEQ ID NO: 13617 - DNA, 246 bp, Homo sapiens
tsggccaccgccatcccatccagcgagcatctgcsgccgcgccgccgccaccctcccagagagcactggccaccgctccaccatcacttgcccagagtttgggccaccgcccgccgccgccccccttcccggtgctcagaataaacgtttccaaagtggaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13618 - DNA, 494 bp, Homo sapiens
aattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctgttttaaaggttttaccacccttgtaaaaactataatcttaaatggttttatttgctgttacacaaacaacactacataaaacattttttcctaaatggtacaaatttataaactatcatttttcacttacggtatttgtaatactacactacaa

SEQ ID NO: 13619 - DNA, 436 bp, Homo sapiens
ccccatgtcaggcggaggcggaaggcccaccgtgccagaggctgggcaccastttaaccctcactctgctagcacctcctccctttccccaaggtagcacatctggctcactccccactcsgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttgggtgcsccccgctcccaggttcccctctggtgtcatgtcaggcattttgcaag

SEQ ID NO: 13620 - DNA, 92 bp, Homo sapiens
cacaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13621 - DNA, 522 bp, Homo sapiens
aggattaaagaacaaatacagaacaaattattcctccagcacccctactgcaaggattttaagaactctatctcaggataaagacctgagggtcacaagatgtacattgctggcctcagctggattttcccagggtcaggtgcccattcctacctaatcaaaggacacttctgctgacctgcacctagaataccctgttctgtgctgatgactcagatgtaagaatgatgaagtgcatcggctggcatgcagagaacaataagaaataactgagttgtgggaagacatgaggaaaggacatgaggctcttaataacagctgccabrgtactgcagtcgggaatctggagcaaagtgattcaattctgaccactgcctgtgagtaaatggaattttatttttcaatacttttgtttaatagtacctccttcattacatgtgaacagcactccaggacagtaaatcatgaaatgggaataaagcctgtaattttaattaacataaaaaaaaaaaaaaatgcgaa

SEQ ID NO: 13622 - DNA, 443 bp, Homo sapiens
ccatatataaatttaaggtagattcattttacatttggtatcatgttaaaatgctcccaaactacctactgtataataggtattgcaatattgttgatcaccttcaggatattattatcctgaaatgtctcccagtggtccaagctgggacagtttgagcaacaaaataaatatgagaggattggattataacctaaaaaataaagtcaatatctataaatccatgttgatttaaataaatgattgactaaataaatacttggcagaaaagaagcaaatcttccttacagaaaaattccaaataatatatgtagaacacactttcaggaggtggaacttaatttacctcttcttgaatatggactggactgctgacttttaaagaacagagtatgaagagggaaaagcagtaactttacagtgaagaggcctggcagacagca

SEQ ID NO: 13623 - DNA, 460 bp, Homo sapiens
atcaattttaggagcaaggaggcaggagaagctcaggtcagtgtacatggcccatagtyattgcttctgccacttccaaggcaacagcctaggctggggacccctcaatacccagccctgtgggscttgtggcacgggcactctgtscgtgtagggcatttgaacatcaggattctggcctaggccacctgcccacccctcaaaccatgtttcctccccagcggcttttttccaggactgcatttcagagcaggaccttgacgagatgaacatcgagatcatccgcaacaccctctacaaggtaatgccccacacaagccatgggggattggcctgtcggtgggtggggctgtgggaagtggtagggtggtgatttatgtgaggtgctgggacaggatgcagctatgtcaggctcctatcccagggacttactgcttattctctggctcccatgctgggc

SEQ ID NO: 13624 - DNA, 386 bp, Homo sapiens
ccccatctctactaaacatacaaaaaatagctgggtgtgatggtgtgtacccctgtaatcccagccacacgggaggctgatgcaggagaaatgcttacactcaggaggtggaggctccagtgagccaagatctcatcactgcactccagcttgggtgagatcactgcactccagcttgggtgagaaagtgagactccatctcaaaaaaaaaaagttcactttacaagatcctgacctttggcagcaagtaacctgagcttttgaagagatggaggaaagaagttgctttgcagcaggatgaattgaaattagagtgaagagaggacttccaggtcatcatggtagcaagttgggcagcacacatggagggactggtggcttagatc

SEQ ID NO: 13625 - DNA, 476 bp, Homo sapiens
tgaagcagacctttcattatttgatcattgagtgacctatagcctcagttccaaattcttaagatagggacaaagttacctgttttataataaagcttaaaaaaaaattccctaccctgctctgtcccacttgacctctgaaatctcctagttggtcagctaccaggaacaggtaatggttgtgttgaaatcggcccactttccatacttttgggacatgttttaaggcttcatttgcaaatgttaagatcttagacagtgctagttgccaagagccacctacaaaggtaatgccagtcctcggacccaaatcccaggggactctaggtctcaggtgcagagcctaaattaagaaccaactcagtaacaaaattctccttaatccttggaagctaaagatccagctttgaaaaatgtatttccatgtaatatattgatacttttgttgtgctcattatatactataaaacacttgc

SEQ ID NO: 13626 - DNA, 138 bp, Homo sapiens
aaccccgagaccatggggaagctcgtggcgctggtcctgctgggggtcggcctgtccttagtcggggagatgttcctggcgtttagagaaagggtgaatgcctctcgagaagtggagccagtagaacctgaaaactgc

SEQ ID NO: 13627 - DNA, 266 bp, Homo sapiens
tcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaaaaaaaaaaaaaaaagct

SEQ ID NO: 13628 - DNA, 115 bp, Homo sapiens
ttaaaagaactagagaagcacagcaaacaaattcaaaagctagcagaagacaagaaataactaagatcagagcagaactgaaggagatagagacacgaaaaactcttcaaaaaaa

SEQ ID NO: 13629 - DNA, 514 bp, Homo sapiens
taggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgc

SEQ ID NO: 13630 - DNA, 232 bp, Homo sapiens
ccccaaggtcaggcatttgagaccagcctggccaacatggcgaaaccccatctctactaaaaatacaaaaattagccaggcatggtggcaggcgcctgtaatcccagctactcgagagactgaggcaggagaatcacttgaaaccaggaggcgggggctgcagtgagccaagatcacgccactgcattccagcctgggtgacagagcgagactccgtctaaaaaaaaaaaaa

SEQ ID NO: 13631 - DNA, 471 bp, Homo sapiens
tcaaagaagttaaaatggtgtggcaggtcattaggattaggcagwatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcctttcataaaatttaaacaaaactctttctacgtagtgactcctcaagcaatatttttgatacagcaagtgtcaaacttgctatagcataaaagccggggct

SEQ ID NO: 13632 - DNA, 507 bp, Homo sapiens
ctcaaccaaatggccctaatagatatctacggaatactccactcaataaccacagagtatatattcttctcatatgaacatggtacattccctaacattgatcatcggcttgatcataaagcaagtctcaataaattaaaaaacaactagatcagatcaagcgtcttcctagactccagtggaataaaattagaaatcaataccaagaggaactctaaaagccacacaagtacagggagactaaacaaccaactcctgaataacttttgggtaaacaatgaagttaatgcatttcggccgggcgcggtggctcatgcctgtaatcccagcactttgggaggccgaggcgggtggatcccctgaggttgggagttcaagaccagcctggccaacatggtgaaacctatctctactaaaaaatacaaaaattagccaggcatggtggcacgcacctgtaatcccagctacttgcgagactgagggaagagaattgctcgaaccccagga

SEQ ID NO: 13633 - DNA, 466 bp, Homo sapiens
aactgataaagaaaagtcatggaagacaggaagaaaggaagagagggaagtaaagaggaaaacctataaatattcccacagatagacaaagtcaagcataaaactggagcttgagaaggaaatgaaaggaaaagaagtggtactttcttttaccctaggagaagacctccatacaggaagacttgtgtgtggggctgggacattagaatcatccgcaagtcactccaaaccttgaaactgtcagggtcagaggggaactaccatttattaagcatttgccatgtgccaggcactgacccagacacattataaataccacattgtttcacctgtgtgtggcatctacagaccttagatcatagctgtgagaacawkrgtaagcactgccaaagttatcagctacccatacctcatgtttttggtgttatctactcttcctagaatcaaatattaaraataattttaa

SEQ ID NO: 13634 - DNA, 513 bp, Homo sapiens
  misc_feature 288: n=a, g, c or t
gtagacactgactgatgggaccaggtacaaaatcccctgggacaaaacagaactttcataactggctgtagagttattgtttttgccttttggatcttccaccttgtgacgggaagagcactgtcagcccaacacagaaactctgccgcctggagtcacgtggatccagatgcgaagggactccaacgtcatgctaaggagtttgggctaagaatttgtacagccatattacagatttggaaaatgatgtgaagagaagctaagggatttgccactgccactcagctnmcaaggatcagagacattacttctacttctcaacgtccatcctccaaccattgtccagtgattcaggcagaattccctcctgctcaggaggtagccatcctgtgaccctggaagaaaccagcccaaggaaggtgctaactacagaagaaggacatggccagggtaatcacatagacccggagttgaagccctgactgcaccacacccgaagcttccccacctttc

SEQ ID NO: 13635 - DNA, 321 bp, Homo sapiens
aagaagggtaggagagaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgctctccaaaccactttttgcagctttctctagttcaagttcaccagactctataaataaaacctgacagaccatgaaaaaaaaaaaaaaaaa

SEQ ID NO: 13636 - DNA, 257 bp, Homo sapiens
tcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccggtgtatcmccaaatcagggtgttaaaacaccagaactttagcsaaaataaatgtcttacattacaaaaaaaar

SEQ ID NO: 13637 - DNA, 504 bp, Homo sapiens
tctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacgagcgggtgctgcttcaacccgcatttaatgctgtgtaagtagcgataaccacgtacgagtctgtctgg

SEQ ID NO: 13638 - DNA, 465 bp, Homo sapiens
ataattctgactggaaaattgggaaaggctttatgaggaatgtggcattgggttgcagctttaagaacggagaggattttgtcaggggtgtgtgtgtgcatgtatgtatgtaggggggtggaggcgatggtggtttgctggctgcaataggcaggagacaaggataagaagggaattttaggccgggcgtggtggcttatgcctgtggtcccggcactttgggaggctgaggtgggacggatcacctgaggtttggagttcaagaccagcctgatcaacatggagaaaccctgtctctactaaaaatacaaaaaattagccgggcatggtggctcacgcctgtggtcccggctgcttggtaggctgaggcgggagaatcaattggacctggggggtgaaggttgcagtgagccgagatcgtgccattgtactccagcctgggcaacaagagcaaaactctgtctc

SEQ ID NO: 13639 - DNA, 502 bp, Homo sapiens
aaaactattttaaaatgacaagagtgtggagtagaagaaagtatgaatttgttgtcaaaagggagggagggactggagtatgggaggcctttacataccagattaagaagattgtactttatctttcaagcaaaagagaactataggagcaatgtgattagagttgtgtgaaggatggactggaggttcaagactagacctagggaaatgagttgggaacaagtgaatgcccaagaaaggtagtaacagtgtgaacagataagaagcatgatgagaatgtggggaaggagagaatgggccatagagctcaggactgtcaacaggagaagcaggtctggagggacggaaagaggagtccagtgctgatcatgttgatcttgaagagcatagtggtgatttaggtgggaaatttccactgggcttctgaatatacaggtcctctatcttaggagggagggatttgggggctgtcagcatggagtggtactaaaagccatgaggg

SEQ ID NO: 13640 - DNA, 443 bp, Homo sapiens
  misc_feature 157: n=a, g, c or t
agaggatttggctctgtcacaccattcactgcctgcccttcttcccagcgcttccaagatctggttgtattaaacacgagaatgaagagaggaaaacaccttcgcccacggtgtgctctggggacatctccaggtgtgggtggtggcgtcasagggnacagatgcccactcttcctggctttgatgaagcaagttgccttgttccagggatccatattactaatgaatgagggcagcctccagccaatagccagcagggaactgaggccctcagtccagcaaccctcaaggaactgaaatgctgctaacgaccacatggatgtagaagcagatccttccccaatcaagccttgagatgagactgcagccccagacaacacctcctgagagactctgaaacagagagcctgactaagccctgcccatattcctaactcacagaa

SEQ ID NO: 13641 - DNA, 385 bp, Homo sapiens
cccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcsmgsccttgtgacagacacacggaaggcttctgacgcttgrkggccagactgcaattgcacttatgtgttatgctactaatatttgaaacagacctgcca

SEQ ID NO: 13642 - DNA, 253 bp, Homo sapiens
tcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaaaaaa

SEQ ID NO: 13643 - DNA, 328 bp, Homo sapiens
cacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatggcgagaccctgtctctacaaaaaatta

SEQ ID NO: 13644 - DNA, 362 bp, Homo sapiens
ttttccctggactgactgtcaaaggaggtggttttaaaaagcaagccaaacaggtttccatcctttaggaagaccctggaacgtgccagttgattctgacaatttctcatgaacagaaacacctaggaagggagaactggtgagtcttttcaagaggaggaagtccctcaaaaggggctgtgtttcgcaaacggcgccccaaaagggctgaaatacttcgatctggaggaaaaagactcaggcactgarggaaggggagggtgcacatctggagtaatttcaaggctttttccgtgttatctgaggtggcaacaagtaagatttgttcgttttattatttttttaaaaaaaaaaaaaaaaaa

SEQ ID NO: 13645 - DNA, 480 bp, Homo sapiens
agttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaagtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtc

SEQ ID NO: 13646 - DNA, 116 bp, Homo sapiens
ctcttccgccgaagccgctccccttgcgaagaactggggcctcccgggaggagagagggctttgcttgaaacccgggacgccaggggcgctcccgcaagtgggggtcctccgggac

SEQ ID NO: 13647 - DNA, 113 bp, Homo sapiens
ctccagggctggggaacgtccgcaagtcaatgctcatagatgcccggagctgcctcttagactcgtctggcccatctacctgctgacagagcatgacaaagatgactctcaaa

SEQ ID NO: 13648 - DNA, 269 bp, Homo sapiens
  misc_feature 253: n=a, g, c or t
tcctgattggaaatakaagacatttyyggttgakagaacagattcgttggaagcttaacttttgttgcctcttaacgccaccaaattttasggtaatttgattatgaaagagtgaatttttctggacagaaaagggagagctaccaaattgttkktttctttttaaaaggaagtttaatgtccgttgtatcacaaatcmstgttaaaacaccwgaactttagccaaaataaatgtcttacattacaacatttnamarmaaawraamgct

SEQ ID NO: 13649 - DNA, 62 bp, Homo sapiens
aagacggagtttcgctcttgttgcccaagctggagtgcagtggctcgatctcggatcactgc

SEQ ID NO: 13650 - DNA, 182 bp, Homo sapiens
tccgttactggtggcgcgcgcggggacttaaagtaggtgagttctaggggcctggccacggctccccgggagcatcttggttcccccagaaggcgggaggggcgtaccttgggtgcgactgggcggaggtgacttggaagttcgcttctcggactgtaatactcatccttacctggcgcccc

SEQ ID NO: 13651 - DNA, 486 bp, Homo sapiens
atttgttttgctctataaaaaatggttggcttcccacgtttgcttttgcagtccatctattgcagaaagctttttaattaaaacgcatcaaagaagacctgactttatacggagaagtgataagggaggagtatgttaataacctttaaagataattgtggatttttttgatactactgtaaaacttaaaagtactcttacatcgaaattaattgggttggctgggcatggtggctcacacctgtaatcacagcactttggggggttgaggcgggtggatcacttgagctcaggagttcaagaccatcccaagtaacatggtaaaaccccatttctgcaaaaaacacaaaaattatctgggcgtgatggtatctgcctatagttccagctacccttgagctgaggcaggaggattgcttgaatctgggagtcagaggctgcatgagttgagatcacgccattgcaccccagcctgggcaacagagt

SEQ ID NO: 13652 - DNA, 442 bp, Homo sapiens
atatgaattttagaaatgccgaagtaacatgtctccaaagagcgatctgcactgtgctgtttgttttgtatcgagagttctgtgagtgcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaaggtaagggttttatggtccactgcattccccccaaaagttttcctaaataaaataaaacaagccaaggtcaaataaagcaagcccagacttgaccctgtggctggttttta

SEQ ID NO: 13653 - DNA, 475 bp, Homo sapiens
ttaattattcattcatatgtttaacaaaagtttattaaatgcttactgagggcaagaaaccgtgtaggcaaaatagataagaaatgaacagcggccttcccctcaaggcatttagtttttcatggtagacaggttcataaacagctaactggaatgtattgcagtaagtgtttaaataaaggtacgtgcaaggtacttagggaccacagaataggacataagtaactgcccttcagagccgccaagggagacctccacagtggtggtgccgtctgagccggagttctgggtgagcagttcacaggcagaggcaggagtgggcatcgcaggcgggaaaagcagcaaaggcagaagggcctgagtgagcccgtagtgctgggaagagggcgatgcaccatttctggggcctggagtgcagataggaaagagattggaaatgaaattggaaaggcatcagggcttgcacagtgaaagg

SEQ ID NO: 13654 - DNA, 79 bp, Homo sapiens
  misc_feature 38: n=a, g, c or t
ctttttccggttgcggcgscggcggtkaggttgtctantccasgctcggagccatgcygtccawgggtccgctgcagtc

SEQ ID NO: 13655 - DNA, 284 bp, Homo sapiens
ctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccacca

SEQ ID NO: 13656 - DNA, 473 bp, Homo sapiens
tgtattcttttaagagatttttcacatagtggtcaacttaggatgagtttaccagtcttatttgaagcagtggtttctcatgtttatcacaatcctcattccctgaataaccatttattgggtgctttgccatgttccagtcagtcaactacatgctgggcatacaaaattgaataaatgaataagccataatctgtgcacttggggacctcttagcctgtgctcaaggggagacagacagataaacaagcatacattgtgataggtgttatgacaaaacccaacgtacagctgggtcacaaaggaggaagtaagtgattatattgaagggattgggaaggaaagaaaagcatcctagaggctacttattaaaagacagataggagattggtgcagtggatcatgcttgtaatcccagcattttgggaggcagaggcaggaggatcacttgagtccaggagttcaaggccagc

SEQ ID NO: 13657 - DNA, 497 bp, Homo sapiens
cagaagatcggcaaacgaatgtatattacacagtttaggttatgattccctactttaacctacttactttattaaatgaccaactactgatactgatcacaatagttattagagattctaatttagttggaaggttctaatcactttcattacaggcatttgaaaaatagggattcatttcgaatatattagccaggagcatagttagatgttacccaggccatttatcatcctgttaatgatgattttcccgacccttgtgagatcagcgtgacaggagtgtgtgtgtgtgtgtgtgtttctgtgggtgtgtggttttggttgggtgctgccaggtggcaaaggcatatgtaaatacatctgatctgcatctttatttcacagttaactaaaagtaaaaatgtctattctgattccatattgattttgtctaagatgtaaaaatttgagttcatctttggccaaaacctacctgaattaacatacaaaatatttga

SEQ ID NO: 13658 - DNA, 145 bp, Homo sapiens
tctgtttcagaactttagggcctttgaaatatttcctcaagcctatttcatgagatctacttggtttacccaagtcatgtttttaayagactgctaayatcaaaggagaattyttaaagccttcaacaatgcctactttcccatt

SEQ ID NO: 13659 - DNA, 490 bp, Homo sapiens
tgtgtgtgtaaccccctttggcaatggagtagtctgttgtaggcctggagaaagcagacatttgaattgatccagttccaggcatatgggagtggcaagagaaatgggatgttactagtagtgattgaaatgaatgagctatggagtctagagagagaagaaagtgaatgtgagaaaggactgataggcagaagttagaagcatcaagggaatggatgcattgaaaaattagagacgagacagtaaggaaacaactaggaataagaggcatttttttaaaaaactgctttattgtggcaaggcgccgaggctcatgcctttatcccagcactttgggaggctaaggcaggcggatcacgaggtcaggagatcgagatcatcctggctaacacggtgaggccccgtctctactaaaaatacaaaaaacttagccagatgtggtggcgggcacctgtagtcccagccactcgggaggctgaggcaggagaat

SEQ ID NO: 13660 - DNA, 481 bp, Homo sapiens
caaacatgcatgttatttagtttgttctttagtatattgttaactggcctaaatccaatgactgacatggtaaagattcaccacttctagcatactgggcactttttatttttgacttgattacattaactttttgaaaactattcagtgatttattcagccaatcttatgaggtacatctgagttgttctagatgctagaggatagtataacaggaaaaagcccctgctctcatggtgagacagataataagtatgtaatacaacttttcaaatagtagtatgaatggtaaaaaaaatagggaaaaggggtgggaggagctgaggtttgatagaatggtcatggaagatcccattaatgagatgtactttaagtagagacctaaatgaagataattttttctctagtactgaactagcactgtacaagtggattgcatataggcatataggcagaacttctctagtactgaactaacact

SEQ ID NO: 13661 - DNA, 234 bp, Homo sapiens
aaaacggcgctcctggcggatggaacagcacgggcaaaggctgggtatgggggtatgtggggatggaagtgcccagaggggcagcgcgatggggttgggggcgggaccccgcaggcctccagtaaggggctagttggggatctggtcagccagtggccaaggccggtggtcagtgagaagwtgatgcggasgggggggcggtttcagatcagtctgagggtggagaataggaaa

SEQ ID NO: 13662 - DNA, 102 bp, Homo sapiens
ctgaatgtatcacagttcagccactcacctactgaaggacatcttggttatgcccaagttttggcaattatgaataaagctactataaacatcaaaaaaaaa

SEQ ID NO: 13663 - DNA, 440 bp, Homo sapiens
ctttgggtgaaaaaagtatagtgtgcttaagtgcagaagtgttttttgaggatttttgattggatacaaaccaccactcatattttatgtcttttgcacttaaaaatttcaccataacttttgagtcatttataaaaaccactgaaagagtacttgagggacatccccgaatcctgaagaacttctggtgttctggagcagcctcagtgagatccaggaggatggcattgctgggctggcccagcctttattgattatggtgtaaagaattaatatggtggttatatactctttgttagacaccttggcttacaagacgtaagcgtaaagtgtagtgcgctttagtcagtatggccacatggtcctttggtggtaaattgtttgagatgcctccagtttttaaaaggagtagcatatcgggccaggatcagtggctcatg

SEQ ID NO: 13664 - DNA, 447 bp, Homo sapiens
  misc_feature 121: n=a, g, c or t
aggacagggctgtgggcgggcacttggagcccagggcagggttcacagagctattttcagttctcttgcaggatctccttcccagccttcagaaattgccggtctgggagttgggggcaangagaagatcctgaggtggggtttcgtcatgttgaccaagctggtcttgaactcctgagctcaagcaatctgccagcactttggggggccaaggcgggggggatcatctgaggtcaggagtttgagactagcctgaccagtatggtgaaactcagtctctagtctctactaaaaatacaaaaattagctggccgtggtggggtgcacctgtaggcccagcaactcagaaggctgaggcaggagaatcgcttgaacccaggaggtggaggttgcaatgagccgagattgcgccactgcactccagcctgggaggcagtgagactctgt

SEQ ID NO: 13665 - DNA, 471 bp, Homo sapiens
ctttattttcttcctattccagaacacaaattggttttgttttgttttgtttttgagatggagtttggctcttgttgcccaggttggagtgcagtggtgccatctcggctcactgcaacctccgcctcccaggttcaagcgattctcctgccacagcctcctgagtagctgggattacagacatgcaccaccacgcctggctactttttgtatttttttttttgtagaratgggggtttsacsatgttggtsaggctggtttcgaactcctgacctcaggtgatcagcccacctcggcctctcaaagtactgggattacaggtgtgagccaccgtgcccggcccacaaattgtttttaacaagaaataagtactgaaaaaaaattgatgtgtaaatgtcacaaattttctaaatttacacatctatttcatttcaaaataaatatgctaataaatgttttggtagactgcc

SEQ ID NO: 13666 - DNA, 55 bp, Homo sapiens
agccgtggaggaggaggacgatgaagaagctgcaaagaaagaagctcacagaacc

SEQ ID NO: 13667 - DNA, 253 bp, Homo sapiens
cttttgcgcctgcgcgagacccccagctaccgcacggttgtccagaggmagaagatccgtcttctcattgggcagcgggactggagggttctggttcggattgaccggctttgtgttccgttctagcgctgcacgccagacaccggcctttcaatatccgtctcttccctgcaggawtgacggcgttgcacgctctcgcggggaggctctggctttccaaacgctggcaccgagggtttttctgttccttttt

SEQ ID NO: 13668 - DNA, 475 bp, Homo sapiens
cagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaa

SEQ ID NO: 13669 - DNA, 456 bp, Homo sapiens
  misc_feature 129: n=a, g, c or t
tattccccaaagtaataatgttgaagtatgggtctcatcattcccatacacagaaacacaaaacactttgatcataaacttttttcttcagaagccaaactaacttgcagaataatagagccactggtntaatgtttcctcaagataggttttagtbtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttsttttgtttgaagtgcttatcagcataatgagctaagtgtcatgcatatttgtgaagaaacaccctttttgg

SEQ ID NO: 13670 - DNA, 230 bp, Homo sapiens
tccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttaa

SEQ ID NO: 13671 - DNA, 371 bp, Homo sapiens
aagtctcctcttcacgtcccagcgcgggtgggcgccggcggctcctcttaaccacaggttccagaagtcctctgcagaagtgcttccctctctcatttccaggaccacaattcccagagacttcggcttcacgacgtttctctttttgcccgatctctcccggagctagctgggcttcggccggccagaggccacagcgacgacgtgatccgtcgtgagcgggtcccagggtttcctcggcggcccttttttctctcccctcggtcgtcccccttgcaggctgtcgcggctggcctgagcggtgacctggcgggtcgcgctgcgstctgcamtgtttcctgcctggctggtggcggcggcattttgttcat

SEQ ID NO: 13672 - DNA, 173 bp, Homo sapiens
gtttgtttgtttttggggggttttcttgccttggttgtctggcaacgactttgtacatttgggagtttttatgagaaacttaaatgttattatctgggcttatatctggcctctgctttctcctttaattgtaaagtaaaagctataaagcagtaaaaaaaaaaaaaaaaaaa

SEQ ID NO: 13673 - DNA, 460 bp, Homo sapiens
catcacttgtggcttctggaggcaaagatgataggggatttctgtggaggattggatcagaagagggtgccctggagctgactggacataaggatactgtcggcacagtggctttcagttcagatgggaatttgttggcttgtggaagttttgatgggcaaataaatgtgtggaatacagctacacgaactctcaagggaacccttgagggttcgggtcaggttttgagtggcttaaatggcattctcggggacatttgataatcgcaggatcagaggattgtaatgtatggatgtggaatgccgaccataatgccattctgaatacctttgctggacatagtaacacagtgacatgtggtgattttactccagatggtaaacttatatgcactggatcggatgatgcgtctttgaggatatgggacccaagaagtgcacaaagcagacatgttgttcga

SEQ ID NO: 13674 - DNA, 447 bp, Homo sapiens
cgttctagctgcggccgcaggagctgtggcggttttcctaatcctgcgaatatgggtagtgcttcgttccatggacgttacgccccgggagtctctcagtatcttggtagtggctgggtccggtgggcataccactgagatctgaggctgcttgggagcttgtccaatgcctastcacctagacattatgtcattgctgacactgatgaaatgagtgccaataaaataaattcttttgaactagatcgagctgatagagaccctagtaacatgaattataagamactattttaaaattcatatggaaccaaaaaggagcccaaatagccaagacaatcctaagcamaaagaacaaagctggaggcatcatgctacctgacttcaaactatactacaaggctacagtaaccawaacagcgtgatacttgtacaataacagatacagac

SEQ ID NO: 13675 - DNA, 479 bp, Homo sapiens
cagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagamcccttccgggaatctcccctctcctctcgcctgctggat

SEQ ID NO: 13676 - DNA, 235 bp, Homo sapiens
caaattggggacaaaatgttccagaaaggcgggtggaatatgcttttggctctgttgacactgaagttaggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaa

SEQ ID NO: 13677 - DNA, 468 bp, Homo sapiens
tgtgtgtgtgtctacgatgtgcttatttaataattgccaaaatatttagactagagtaacttccggtgggtcaattggattgtgactttcttttgtggttttttggttcttcgattgctctctgttaaatattttcataattccccccacagaatacgtgtgtatatactgcaacttaaaaactaaaagcagtactcgaatgagttgttttaatgttgtacttttatctgtttgttttatgggttctcctgctgcctaatgacctttctgtttttataactgccggaaagccgcgaasctctcgcatggggagctaggtccccgctgcggctccgcacttgagtttattataaactctggggttctgagtaagttttgtttgaatacagcaacatgattgtctctttctattcttatcctaaaagactctgtctggcatcttttagtttgtaccctcgtatctgcttc

SEQ ID NO: 13678 - DNA, 467 bp, Homo sapiens
taatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagtt

SEQ ID NO: 13679 - DNA, 192 bp, Homo sapiens
agtggagcaagagattatacaggaagacaaggtcgggtgcagtggctcatgcctgtaatcccagcactttgggargctgaggrcgggtggatcacctgagatcaggagttggagagcagcctggccaacatggtgaaaccggtctctactawaaatacaaaaattggccaggcatggatgacatgcacccgt

SEQ ID NO: 13680 - DNA, 355 bp, Homo sapiens
ttttgtttttactaggaggtgcatggtttttatttctgtttcaaaagtaaattaaacagacctctttacagcacatcctgtatgtcctagtccaaatgtttcctaatgcacgtttgtctttttcattgtttaatatagatggccaaagctccatcagctgctcgaagcttaccatctgcstctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaat

SEQ ID NO: 13681 - DNA, 463 bp, Homo sapiens
ccacttgttctattaagtcatggttttgcaaatggtcaccatttaaatataagggacctattttgcttctttcatattcttcgacatttcctcaatgaaagaataaggaaagtttaggagtgagttacttagggtgtattctactctgaggatttcagttttactatagctgtatttaatcttatattaattgggcacttatattaatttagtgcctgtataatgttggcactgaaatggttctttagtgtgttgtgagaaaatttcaatgaagtcatttatagaaaactgtttttctcaagggaatttccctttcsccttttcagaagtcagaggaaaaaaaaactggaattagagtatagagttagagataaagcgaaacgatggcagaatatgctgagacatttgctcaggggttaaaagacagggagtttatagaactcccttttctgcttgtcataag

SEQ ID NO: 13682 - DNA, 424 bp, Homo sapiens
aacgtttccaagaatcagataaaagaggacaaaccttagggagaagaaggcagctgctcatttccagcaggggaagtagctgcatagagtacaaggactggtaggcctgttggctgttcctgtttaaggagacaagatgggcatggaacagggaccaccccctcctctgggagaagctgttacccccttcacttttcctcctctgtcattacccacaatcactctccttctttgcgctatggtaggtgtttacccatcataggaatgggcatttgaactttgaaactgaatgtggtgattacacttcatgctgaagcttttcacatgagtgctttcataagcattaagtaaaattttataatgactgcagtccaaggacattttccctggtttttggccagtctaaatattgtaagagagagag

SEQ ID NO: 13683 - DNA, 454 bp, Homo sapiens
catgatttaggaaagtttccagaccgggtgcggtggctcacgcctgtagttccggctttttgggaggccgaggccgcggatcgcggggtcaggagatcgagaccatcctggctaacgcggtgaaaccccgtctctactaaaaatacaaaaaattagctgggcctggtggcgggsgcctgtggtcccggctactcgggaggctgaggcaggagaatggcgtgaaccgggaggcggasttgcagtgagccgagtttccgaatttgtgttgagcagcattcaaagctgtcctggggcgcaasggctgtaggttggacaggtttggcctagagttttcttggcctctctaagcctgcttccttccttctgaatatsgggcaggacattctctggaataggggtcttatgacttacagtcaaacaacatgggtcagataatttaatttattcatggcca

SEQ ID NO: 13684 - DNA, 505 bp, Homo sapiens
atccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggstttttttttctttggccatgaggg

SEQ ID NO: 13685 - DNA, 173 bp, Homo sapiens
caaaatcttgcagccattaagtccttcaaagtcaaacaaacacaacgcattctctatatggcagctgaaacagccaaggaactgactcctttcctgctgaaatcaaagattttatctcccagtggtggcaaacccaaggccatcaaccaagagatgtttaaactctcatccat

SEQ ID NO: 13686 - DNA, 376 bp, Homo sapiens
  misc_feature 149: n=a, g, c or t
atggagacgggtttcaccacgttggccaggctggtcttgtactcctgacgtcaggtgatccacccgcctcggcttcccaaagtgctgggattacgggcgtgasaccgtgctcggcccaaggcaggagaatctcttgaagccgggagssngaagttgtggtgagccgagatcgcagccactgcactccagcctgggcaacaagagtgaaactccgtctcaaaataaataaataataaaggaagaagtcagctgggtgcagaggctcatgcctgttaatcccaatactttaggaggccaaggcaggaggatgcttgggtctggaagtttgagaccagccagcgcaacatagtgagacctgtctctaccaaaaaaaaaa

SEQ ID NO: 13687 - DNA, 469 bp, Homo sapiens
agccagccccttccttcccaggcttcacacacacaccccaggaagccccgcgtgcgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcagaggccagcctctgctgccagctctgtcatctttgggcagattcgatgggactttagacacttgctttgctccctctggggtctggagtagatgtagacacatcctgtgagtgaggtgaccagggtgatttaggagcaccattagaaaacctgacatcactgcttgtggttstgctgaccgtttcagccactggcttgaatggagtcattttggmttcttcactg

SEQ ID NO: 13688 - DNA, 291 bp, Homo sapiens
  misc_feature 263: n=a, g, c or t
agtagcttctcaggtgattcagatgctcagtcaggattgagaaaccaggactcttcccagccctcctgttctctgatccacttctctgcttcctccacgtcctaacgattctccagttcccgcacagcaggagcgagggaagaggggagagatggcaccgctaaggaccgcwggccccgccagcggcsgacctccccattccaggggcgccasggcggattacataacgggcctcggggcgcgttctcgsaggtttccaccgncccctcctcgctccacgtcagagggaac

SEQ ID NO: 13689 - DNA, 402 bp, Homo sapiens
taaaataacttttctattttaagatgcttttctgattcccaagatgaaaagaatagtaatcaatgtgggagttaaaaataatcatttctgttcctattaatagcttaactctggatatcatttataatagtccagtctccccatagagactgcctaaggctatagtgttatgctgctttggggtgggagcagtaggccaagttcaagtcccaactcggaatttgtgtgtgtctcttttgaaggggggaagggactctggaatatgaattatcttcacttgttaatcctgaacatgcctctgactcatgagtggcagcagtcatgggagcaactccagcctttctcagcagatgtcactattactgtgtatgttgaagtatttacaaaaaaaaaaaaccaaag

SEQ ID NO: 13690 - DNA, 510 bp, Homo sapiens
ggaggagtttagagggaaacgactggtagaaagagatgagttgggccggacgcggtggctcacgcctgtaatcctagaactttcggaggctgagatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcattcaactgtgctctgtgaggtgtgaaattaaaaacattatgtttcaccaaaaaaaaaaaaaaatg

SEQ ID NO: 13691 - DNA, 492 bp, Homo sapiens
catcttcaaaatagtggggtgtaccagttatcaatttgttatctgtgagctctaaggtacaccttgctttgcagtgttgaaactcgatgcttgtacaggtttctcctttgtgagcaggttcagtgttaggctttttcattggagggacacagtaaggcaatagcaaggggaataggsttctctttctggttctggtgtgctgttatttgattggctgccagcagattggcctgcagaaggtcagtctcacctcaacaaccttcgtaagggtggcccacaccttcctttcaagtttctctgctgcctggtaaaatgtccctacagaacacctttggcctacccagaacctccagtgattcttctaccgggtgaggtgctctgattcgatcagctctggmctttssccttggtaaatttcttccatctacagcccaagttcctgtggcaactatgccctctccaaagagttctgagtctcagccctgggaatag

SEQ ID NO: 13692 - DNA, 100 bp, Homo sapiens
cacttacctagatttacagcctcacttgaatgtgtcactactcacagtctctttaatcttcagttttatctttaatctcctcttttatcttggactgaca

SEQ ID NO: 13693 - DNA, 511 bp, Homo sapiens
acaatatggttgagtcctttgatttttgtttacataaacacttaactgttaaaaataataaaaaagcctctcttaattgaagatattttattatataatgaaacaaaacaagctcttaaatcttaagttgaactctcagaacatgtaaatagatttatatatgtgtatctgctcaaaggagggagagggcagaatgtgttaatgttttgggaggcagggggtggagcagtggtggtgatacattgattacattacagtccttggcttggatgactcatgctgatatttgtttaaatcttacttgaccatttagtatacagtcacttaataaggttgagaaggctggataaaagggtggttcaaatcasagctccatcatttagtagctgtttgatcttagacaatatttcttacccccctaaatttgtatttcctcatctattaaaacagaactattaatggtacttacatcataggattgttgagaaaataggattgttaagagtgactg

SEQ ID NO: 13694 - DNA, 229 bp, Homo sapiens
tgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaa

SEQ ID NO: 13695 - DNA, 513 bp, Homo sapiens
gtggagacaggttttcaccatgttggccagtagtgtatttagttatttaaggagggctcaatcaacaggtttaaatggtgtgctattcataattattgcaaaaataggccgggcctgtagttccagcactttgggaggccaaggcaggtgaatcacttgaggccaggagtttgagatcagcctggccagcgtggtgaaactccatctctactaaaaataccaaaagtagcgggcgtggtgacaggtgcctctaatcccagctactcgggaggctgaggcaggagaatcgcttgaacccaagagtcggaggttgcagtgagccgagatcgcgccattgcactccagtgtgggtgacgagcgaaaatccgtctcaaccaagaaaaaagaaaaaaagaaaaagaaaacttaactggcctttggggcacatgcctgtaatcccagcttcttgggaggctgaggcatgagaaaaaaaataaacctgggaggtggaggttgcagtgagttgagattgtg

SEQ ID NO: 13696 - DNA, 472 bp, Homo sapiens
cctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaracaatgattattcataagvatcatgatggtctcagtatt

SEQ ID NO: 13697 - DNA, 312 bp, Homo sapiens
tattttctagaagagttttaggtttaaagaaaattgaggtcaggcatggtggttcacgcctgtaatcccagcactttggggggccaaggcgggcggatcatgaggtcaggagtttgagaccatcttggccaacatggtgaagccccgtctctggcaaaaatatagaaaatgagtmaggcgtggtggcgcgcgcctgtggtcccagctactcgggaggctgaggcaggagaattgcttgaacccgggaggtggaggttgcagatcgtgccactgcactccagcctgggcgacagagcgagactccatctgaaa

SEQ ID NO: 13698 - DNA, 424 bp, Homo sapiens
caaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggasttgctgagtgagagatggagcctcatggtgtacaactgagggtagttaactcatcacttctcccaagcactcgatcccagcttcacccactggtgttgctttgcttgaactgttcaagccttttatagccttaccataagtatttagatat

SEQ ID NO: 13699 - DNA, 130 bp, Homo sapiens
acacacatcttttctgcaggataagaaatatcagtttccttgcacactagcagaagtggttcatttccactggaaacttaccagaggcattctccaccagatactgcatttccttaggaaaagttttacc

SEQ ID NO: 13700 - DNA, 266 bp, Homo sapiens
attttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcgcccggggcctcttaaccactgatctttgaaata

SEQ ID NO: 13701 - DNA, 466 bp, Homo sapiens
  misc_feature 451: n=a, g, c or t
ctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagactttgactcaagtcataggcttctttcagtctttatgtcacctcaggagacttatttgataggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcggaggtncaatgtcttttagct

SEQ ID NO: 13702 - DNA, 366 bp, Homo sapiens
ctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatgg

SEQ ID NO: 13703 - DNA, 446 bp, Homo sapiens
atcatggcggctcagaaagatctctgggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagarwtcaagaattaaagacaatccaggccaatctgtcgaggcagagggtagaacaccagtgtctttcatctgaggaactgaagcaacgtttcccaaatattcggttgcccaggggagaagtggggctcttggacaattccggagagt

SEQ ID NO: 13704 - DNA, 479 bp, Homo sapiens
cagaatggatgttttattagcaaacatgaaaacattaatctcccttctgcatctccatcagagcttttgggtgaccaagtgcactgtcaatgggtgtagtattttgaaaggaatgtttttttctgagcagtagttctcaacagagggcttaaaatattcagtaaaccatgctgtgaacaggtgcgctgtcatccaagctttgttgttccatttctagagcacaggcagagtagatttagcataattctcaagggctctaggattgaagcactggcttcaacttagccaccagtggccaggtgcagtggctcaggcctgcaattccagcactttgggaggcagaggtaggaagattgcttgagccaaggagtttaacaccagcctgggcaacatacagagaccctgtctgtacaaaaattaacaaattagctgggtatggtggagcgtgctatagtcccagctactcaggaggctgaggt

SEQ ID NO: 13705 - DNA, 462 bp, Homo sapiens
aggatatgagaaaggtaatattggtaaataaagaaataggaaaccattgtaacaratgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtatctaaatagacaaggatgaggtgaatgagaagacatggccccatgggtcctcctgatgagggtgttggggtcccccctggcaccccagctgcatgaaaatgaaggacaggaggtatggaaagctatgacagaagagagaaaggaacggtaaaaagaaatwacaaccaaatggataaatgggtagatccacgagaagagttaggctaggacttgtcataagggcactgactccact

SEQ ID NO: 13706 - DNA, 474 bp, Homo sapiens
attcctctcttctccctgaagctagagtgaggtccctcttggcagcctttgtatctagagagagccgtccaatagaaacataaggacatctgagtttggatgttacctttttattggaaatatgggatctgcacttagatttcactgaatttacattgaaaagagacaaagtctcactatgttgctcaggctggtcttgaactcctggcctcaagcgatcctcccacctcagcctcccaaagtgttgggattatagacatgagccactgcacctggccgaccttgggcaagttcttaaacccttcawagcctcatttttctccaatcacaaaaagggaaagatggtaatattttccccaccaaattcttgtcggatgccctcacagaattgagattatgtacgtaaaacaccaggtgcctaaacccggcacagagcaggagggctaagcgtgacatccagcacgtggtcagtgg

SEQ ID NO: 13707 - DNA, 203 bp, Homo sapiens
attgcatcattattaatttttgctattcatccactatggcattgcatatcaatcagtttaattacacttaatgttgcatgagtgatattttggtctgggtttcctcttaagattttaggtttgtctgaattaaggaaaaatgtttttagatatacattcttattttgtcccacccctccagaaataagctggaaatcttaact

SEQ ID NO: 13708 - DNA, 486 bp, Homo sapiens
tttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcag

SEQ ID NO: 13709 - DNA, 431 bp, Homo sapiens
  misc_feature 393: n=a, g, c or t
gcatgcctggaatcccagctgcttggggggttgaggcaggagagtcgcttgagcccgggaggcgaggttgtggtgagctgggatcgctccattgcactccagcctgggcaacaggagctaaactccatcttaaaaaaaaaaaaaaagagagagaaaaagaaagaawtkttcccaggagaaaccagcagaagagtggggaaaacaggacagsaaaggggaagaggagcaagaggtgayttcaggtgaagttccaacctcagcctaatcstgcagggagstccagagcacaaattaagttgtggagtctttcctgtcttgggacacatggaactgggcctttgtatctccctgtttgagcttattatagccaaacaacagaccaggctcagtggnaaacgcctgtgatcccagcactttgggaggctgaggca

SEQ ID NO: 13710 - DNA, 425 bp, Homo sapiens
gttgaggcgagtggaagcttcgagttttttttttcttccttttggcttactgcgcaagaagaagggtaacaagaggacggcggcgatggcgaagaggctgctcccatctctgaaccgggtgctggttgagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcagagagcacgacattttgggcacacttgtggactaattcagagcatcagcagcctgtcactagtcgttggttctagact

SEQ ID NO: 13711 - DNA, 468 bp, Homo sapiens
taaactgaaaatgctatacgaatgtgagattgatcttgtatttcaatagtcccaacaatatcactgcattgttatattaggtggaataaaaggacaatatttaactgttttgactctacaatagtgtcaatttagttgtgttcatctctattttataaaatagggatacgcatactgtagaaaatttcctgttaaattaagctttgacggccaggtgctcacgcctgtaatcccagcactttgggaggccaaggtgggcggatcacttgcgctcgggagtttgagaccagcctgagcaacgtggtgaaatcctgtctctacaaaaatatgtatatataaatkagtcataatctcagctacttgagaggctgaggtgggaggatcacttgattccagaggcagggcttggttgcagtaagcagagatcacgtctctgcactccagcctggctgacagagtaagaccgtg

SEQ ID NO: 13712 - DNA, 358 bp, Homo sapiens
  misc_feature 228: n=a, g, c or t
gttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagccatgagtaaggaaccgagagcagaggagtagatggtttccttattgccttctcctggaagagtgaagcgnatcccacgcggacccctttgtaattggcagggggcttccagtgaagacactgaaccctgaagccgtggtctggggcagggtggtgggagakgtgggcgggggggggtggtcccggctctgaggtgtgtgc

SEQ ID NO: 13713 - DNA, 498 bp, Homo sapiens
tcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaracacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggag

SEQ ID NO: 13714 - DNA, 465 bp, Homo sapiens
atgtttgcaagaaggatatataaccaaaattggtgaaatgttcagattatttttatctgatttaagtgtaaatggtgtcatgtacagatttggatttcacaaaaaggtttagatagaaatgagtaacattcaaggttagtatttttgcatattaggcttctaatactttttggacttgaaatcagaatgattttagcaaattcttactgaactcatgttgatatttctctcttctcagaggaagaaattgttgagcttccagatttggattacctgcgaaccatgactcatatagtctttgtagattttgataactggtcaaacttttttggtcatctaccagggcatctaaaccaaggaacatttatttggggctttcaaggtacggttaataagaaaaacaaaagaaaaccttttcccacctcttagaatatagttcagtttaaaaggctcctcttaaacctt

SEQ ID NO: 13715 - DNA, 467 bp, Homo sapiens
tttcagttgcctctcttagatgaatattaatgacttacatagcattttagatcagtggatgtttttgtgattcttttatttgagctttggccaaagataacagtacccacaggttttttccagctactcgctcttctcccttcagtggccctcgagcctggaaaatctgacatgacaatttgcttgctcaacctaccactgtttttcttttgaaaagtttggcagcctgtttctgactcctatgaaggtgaattcctcagcattcacagtttattagaaaaatactttgcttctctccaaactcgaaattcaagataaccaaacctatatataggctgatctttcaggatgcagttgtcatgttgatgccatgcttttcagtatcgtggccatcatctgttcagtaggggaggtgtacttctgtaatgggaggtggtggttatgtgtgtgtgcaagtgtttatttgg

SEQ ID NO: 13716 - DNA, 499 bp, Homo sapiens
ttagagaaaagattggccccattgccacaccagactacatccagaatgcacctggcttgcctaaaacccgctcaggaaaatcatgaggcgagtgcttcggaagattgctcagaatgascatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagttgttcaaggggat

SEQ ID NO: 13717 - DNA, 504 bp, Homo sapiens
ctcaaacacaccaaactcattcaagtctctgccttttacttcacccaaaaagcccttgcttggagcttctcgctgcctacgcagattttaccattccttcaagatcctgtgtgaagtgtactacctgttagatgcttttcctactcctactattttcctgcaaattctcgggtgatttttaatttagcaaaccaatgaacaaaaatctgtgtagtgtcttctatcacacactcttgtatcttcactaatgtaaacattttgaatacaaacaccatatcttttagctaaatctttcacagttcctagcataaggcggaggaaactgattttgaagagaaagaaaaaatagtaaatgtatttcatcatgcttatctaaagtcaactcaggccgggcacagtggctcactcccaaagtgctgttattaaagtgatatagccagctgccgttggagagatatagttttgataataacagctttccatcctatagaactatagattagg

SEQ ID NO: 13718 - DNA, 489 bp, Homo sapiens
acatttcgttagaggcagaggcaggattcagacccacagatagccttccattccaaggaagtttctttgcacttcacaccactatctggtaaaagaagacttatccgttttcttgtatgcatcagctcatctttggattgaacaacacttcagctctccaagctttatttagcagctctttctgggcactgaaggtatgaaactatatgaaatcaatcttgctgacaaaaagctctagtaataaatttagatggggaaacacaagattactacaagataataaaaataaatacacagtaaagaagaaagtcagagtgtggggtgagtagcagaagaaaataaatgtatatacatgtgaaatatatgcttagataatatttgtaagagtgagaagaaaatcagtacacaactttaaaaacatgacatcttaattctgtactttcgttatttacctaaccaaatagttttaagccacactctaaatgacca

SEQ ID NO: 13719 - DNA, 420 bp, Homo sapiens
  misc_feature 43..44,239: n=a, g, c or t
aacccagaaacatagaaggcgtgtacaccaagawgaagccggnnaaccaaccgactcccccgaccctcctgatcgatcgagggccccttgttctagccagttgtccccttccctctcgccggcgttgctcctgcctgctccaatggccgctgcctctgccgccgcccccacgaagacggcgaacatccccgcgacgatgcgggccgtgcagtacgactcctgcggcgggggcgstgggnactcaagcatgtggaagttccggtcccttcggccaaaaagaatgagcttctgctgaagctggaggcatcaagcatcaacccagtggactggaaggtgcagaaaggcatgctgaggcctttcctgcctcgtaaattaccttttatcccagtgactgatgtggcaggagtcgtggctgatgtt

SEQ ID NO: 13720 - DNA, 507 bp, Homo sapiens
taaaaaatcctgcacatgtgtcatgctggagccctattgattccaacagggatggcgccttgtccaagaagagacccagagccagtgaatgggacatagggtttatttaggacttaaatacagatgtggtccagtggcagtgggctggacaggaccgctactatttgtaaagagtatgtagtttatataacatttctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcac

SEQ ID NO: 13721 - DNA, 487 bp, Homo sapiens
atctagtcctttgcagtcgttagtctttttgatgcttaaattgtttcatctccatccagtgggagccattcaagtttgctcctttctcccgttgacatgagcctactcctgtctctgatagcttgctggcttctcggcagtgagctttcacaggcttgttttgggaatagtcagcccctagttttgaaaccacttttataaggaatctcatttactttttgttagaagatgtagttagagaacacagtctgggttctctaggattttkttctttttcttgtagagcttttcagagttcagatctgggtactattgtttcttaaaaagagaaaaattctgagtttattgatacctttccaattcagatttttttattgagatggagttttgctcttgttccccggctggagtacaatggtgcgatctcggttcacagcaacctctgccttcgcagttcaagtgattctcctgcctcagccacccgagt

SEQ ID NO: 13722 - DNA, 468 bp, Homo sapiens
aagagtacttcagatcatcctaaaagcagcatcatttccaccaggaacccagcttctaccagaaaagagtgctgggaaatggtgcttctggattatccatctgcaaaataaaagcaattgcaatttctgcatgactgcaagaaaaatagatactattccttagtatgctattttacaagtttcttaaaggttatttgaaatttcagatggtaacaagcttggaattgtctttttcttcagctatggactgtatcaaagtttatgggctataactgtattttggtttctgtcaggcatcaggatagctcatttgcatgactggtacaaaatttacttattcagtgaatcatgctcagctgctgtactgttcaatctgtaataataactgcagggtgactgactaacgataactaatcttctctcaactacaaaagcatgtaaattagtaaaataaatgtttagttgtgt

SEQ ID NO: 13723 - DNA, 372 bp, Homo sapiens
ttacaaagttcatttaggtgctatacagacagcttgaaaaatgtaagactagttttccatttatgtagtggtagatttttaaacaagtatgttttaaataaatgagtggaggaaactaagacatgtatgtggacataacagggatgatgaaggtgatatcacaaggctgacacataccagcttacatgagtgtgaaattccacagcacaatccttttaggatcctctaaaatgggtatctctttggtcatgtgcccctcgggtatggcagttgaagcatcaggaaccttcctgactgttttcattggcagttgagtgttagagatttgtatgccaaattacttcttaataatgcttatactacttcacattt

SEQ ID NO: 13724 - DNA, 116 bp, Homo sapiens
caaggcactgggtggcagcaaccttttttctagtagttttttcccagcagttttccatttctccacagtatccttttcatttagaggagcttaataaatgctttttaaaaagtaaa

SEQ ID NO: 13725 - DNA, 483 bp, Homo sapiens
ttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaratcagtagatgaaaaaratttcaaaatgtttttgtatattctgttgtaagaatttattcctgttattgcgatatactctggattctttacataatggaaaaragaaactgtctattttgaatggctgaagctaaggcaacgtta

SEQ ID NO: 13726 - DNA, 454 bp, Homo sapiens
ttcacatttaatattttaaatattaatatttraatgtktgcatttaatactttttaaattctgcatttaataatttgaatttaagacttgtaagtccattgtacttcattgttatacacattattgttctcttctctcttttggtgtttaggaatgctttgtgttaacacaaaggccagggtgagagctgcaagccagggaaagatgaaccgaggcatttagattaccacctacattggcttgccagacagaagctctgcctggggataaagatgaggataaacataaggcatttggtgtttcctttgtgtcctgacttagaaatctgaccatggacgatggaacgggaaactcacattttagggtgtattaatagctctctttagtcttgagaaatatcagtgaggctgaaagtgccttggaatgactttgcaggtttaagatatgaatggga

SEQ ID NO: 13727 - DNA, 510 bp, Homo sapiens
aggattaagtaatgaatatgttttgtggagctttctgaatctgagattgaacaaggtggagagatacaaatcatccctatttacctttttaaaaattgatctgtttattgatgtttttgttattattcaccaccgtatttggaataggactgttattaaaccaaagcctgaaaacaaaaccagtcagtatttgctgctgatattcctaagaagttcagcatctgagcacttacagtcttttcataaaatatgtgtcactttacttttcgagaatgttcaaaatgtatcatttgtagtgggttttcccttaagtttcccaatatatagaatcagaataacaattaaatacataacccaatcttggattttatacatcaggaaactaagatctgcatacttctttcattttatatattgcattttagaatagcaaaaacaatgtattaatgttataattattttgagggatgaagtctaatctcagctactcgagaggccgaggcaggagaa

SEQ ID NO: 13728 - DNA, 458 bp, Homo sapiens
cttctagtttgcaggacttgtggtagacagacagaataatatcctggacctcttgggtgtatacaggacaaactgaaataaactctcatttttagatcataatgtcatcatgaaacatatcaattcggtctatttctgaagaaaacaagcacaatgataaagtttgaatgtttgtctcctccaaatctcatgctgacatttgatccccaatgttggaggtggggcgcactgggaggtgttttggttacgggggcagatccctcatgaatggcttggtgctgtcttcatgggattatgttctcactcctacttcctgtgagatcttattgttaaaaagaatctgataccttcctcccctctcttgctctcttcctccctgatcatgtgacacacgggttcccctttgccttccaccacgatggaggcttcctgaggccctcaacagaagcagatgctgg

SEQ ID NO: 13729 - DNA, 417 bp, Homo sapiens
ttgtttgtgtatctgcctaaactcattgagagttgggactatttcacacatacagtgcctggcatgtagaagggacttaatgttgaaagaaggggaggcattttaaaatccacatcaaaaaaatgttgttctgtttgggagtggtggctcacgcctgcaatcccagcactttgggaggccaaggcgggtggatcacctgaggtcaggagttcgagatcaacctgagcaacatggtgaaacccatctctactaagaatacaaacattagctgagcgtgggggcgggatcctgtagtcccagctacttgggaggcttaggcacttgaatgagaatcacttggacccaggaggtggaggttgcagtgagcaatgattgtgccactacctgggcaacagagtgagactctgtcccaaaaaa

SEQ ID NO: 13730 - DNA, 137 bp, Homo sapiens
attatgaatatgttcaagtgaggccatttagaagactgcagcaaatttgttgtgtgatgatgaagaatcagtcatccccaaattctctcccagagatgtttacaaagcatccttattaggtgatttctggagattgt

SEQ ID NO: 13731 - DNA, 370 bp, Homo sapiens
agagtacttcagatcatcctaaaagcagcatcatttccaccaggaacccagcttctaccagaaaagagtgctgggaaatggtgcttctggattatccatctgcaaaataaaaccaattgcaatttctgcatgactgcaagaaaaatagatactattccttagtatgctattttacaagtttcttaaaggttatttgaaatttcagatggtaacaagcttggaattgtctttttcttcagctatggactgtatcaaagtttatgggctataactgtattttggtttctgtcaggcatcaggatagctcatttgcatgactagtgtgattcctatataattgaataaccaattaaaatgaatattaataaaa

SEQ ID NO: 13732 - DNA, 113 bp, Homo sapiens
aaaaaaaaaaytagstgggtgtggtggsgcacgtstgtagtccsagctgsttggaggstgaggsaggagaatcgstcgaacctgggaggsagaggttgsagtgagacgagatt

SEQ ID NO: 13733 - DNA, 408 bp, Homo sapiens
ccttatctgcacccacctcccctgaaaaagagagaaaaaaaaaaacctggttttgctttccatgtataattcaacaacacaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatsagtcaactctgggattaatgaacatatccgactttatgggtatgtgtatattcagtgccagtaccacctcccaggctaatgtgttamagtgtttyctatgattctaaactt

SEQ ID NO: 13734 - DNA, 472 bp, Homo sapiens
  misc_feature 401: n=a, g, c or t
ttaatattgaagaggctaaagaccgtctccgcattctgatgcttcgcaaacacccaaggtaccgatggtcaaatttagttggtgtgtcaggtcccatgtcccaataagatgtaactactgacctcttgagaacatcatgcctttttcctgctgttctatagggaggataagagagaaccattgcggccgggtgcagtggctcgcgcctgtggtcccagcactttgggaggccgaggctgttggattacctgaggtcgggagttcgagaccggcctggctaacatggtgaaaccccgtctctactaaacatacaaaattagccaggtgttggtggctcatgcctgtggtcccggctgctcaggaggctgaggcaggagaatcgcttgagcccgggaggcggnaggttgcagtgagccgagatcgtgccatgtgcactctagcctgggcaataagagtgaaactccatcataaa

SEQ ID NO: 13735 - DNA, 263 bp, Homo sapiens
ttctctagagaagtcctctcttccaccctcagtctgtgtcatcagwtagaaaaagccccaagcttcacaagggggagtgtgatcgaggcctggcsactgatgccatttcatcmtcctggcctccctgactggtccgtgcctgggcatatcgcccaactcagtccaatgagattaaatctcaggaatttacatggaattctttggaaagagactcgatttsmtctgggmatgccgaactgatagaatgaagtcgaaattttggt

SEQ ID NO: 13736 - DNA, 483 bp, Homo sapiens
caaatgcaagtaaggtagtttgggctccttaattccaaacatcccatgagtatatcaagatgaataagdgaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaaatgttttaagtgatcatcagtgttcctttttacttat

SEQ ID NO: 13737 - DNA, 476 bp, Homo sapiens
  misc_feature 34: n=a, g, c or t
caatattaccacacagtaccgaggggaaaatccnyscccgtgattaaatcacctcccaccagaccccacccctaacaccgagggttacaattagacatgagatttcagtggagacacagatccaaatcatatcagctactttggaagacagtatagaagtttctcttaaaactgaacgtactcttaccatatgatccagtaatgatactccttggtatttacccaaatgagttgaaaacttaacacacacacaaaaaaaaactaacccacacatggatatttttaggagtttcagtcataattgccaaaatttgaaagcaaccaagatgtctttcagtaggtgaatggaaaaataaactgtggtatatccagagagtggaatatttttcattgttaaaaagaaatgagcaggccaggcacagtggctcatgcctgtaatcccagcactttgggagttcgaggtgggtggattgcct

SEQ ID NO: 13738 - DNA, 282 bp, Homo sapiens
  misc_feature 58: n=a, g, c or t
attccgggacgagcctccagagaccaagcgggataggtaaacccgccgcgcacgtggnaccggctgggccaacgaggtctggggtcttggcgcggagttcatgggccgccggcaggcttgtgccagtggctttggatccctggcctgcttcccccaacccagcctccagaccagcgctggcctgctccacacactccgcagcaccgtcccgggaaccgagcgtcggcgggaggccgcstctccgcagtaggtctcggcgggcstgatcccttggaggcgcgt

SEQ ID NO: 13739 - DNA, 469 bp, Homo sapiens
attttcaacccagagtgtgacttccccgcagccctggcccaggccctctcacaaggaggaggcaggagcacgtgcaactgaacaagctgtgaagscagccgggcacagaacccccggggtggaaggctcccctgtgaaaatgcaagaggaaaggcgcaaagaaactgggcctctttgttgcccacgctggttgcaaactcctgggctcaagggatcctctcacctcggcctcccaaagcactggaattaacaggagtgagctactgtgcccagccaagcttgttattttcttagggagaggacatcttagtggcaagagcacatgtcttgcattggtctccagcagatttgaactcatcctacctctgtgccctcagggaatcttcccaacctctctacatggaagcatcctcatctgtgacatgaagcaaagaacagttccttcccgtgcaggctctttttgggatta

SEQ ID NO: 13740 - DNA, 348 bp, Homo sapiens
aactttttgatctgagttgcttttcataggcttttaaatttcaaaacgtttgaatgaagtactctatgagctttttcatttcatgtcagcaattctcaaacatcgcctggctttgttaacctggtccttgaggtaagattgagggtgggtgggcagggtattttagaaaacagcccttttaacttcatctgtgatcacttttcagggctgttgcttaactgtccatatgttgtgtttctgtgtaattgtttctgtgctccaccgtatgaagacggacagagggcttgcaaagacaaaaataaatacgtctcttttttttaaaaaaaaaaaaaaaaaaaaaaaaaaaaa

SEQ ID NO: 13741 - DNA, 357 bp, Homo sapiens
agaaaccctaggagacaccgcggagaactctgcctctgagctggtgggcgggccggatgtagccgagcgcggacagggctagtccggacagagtccagagccatgggagcgaaaagagactgctgcggattaaggaggcctttcggttggcgcasagccacaccacaaccaggcgaasagagatagagttttgctcttgttgcccaggctggagtgcaatggcgcaatcttggctcaccgcaacctccacctcccgagttcaagcgattctcctcccacaacctcccgagtagctgggattacaggcacccgccaccacgcctggctaattttgtatttttattagagacggggttt

SEQ ID NO: 13742 - DNA, 483 bp, Homo sapiens
ttacagtgagccgagatcgcactgctgtacccagcctgggccacagtgcaagactccatctcaaaaaaaaaagaaaagaaaaagcstgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgatcaattatttggtgttgagcctctcttccacaagagctcctccatgtttggatagcagttgaagaggtgtgtgggtgggctgttgggagtgaggatggagtgttcagtgcccatttctcattttacattttaaagtcgttcctccaacatagtgtgtattggtctgaagggggtggtgggatg

SEQ ID NO: 13743 - DNA, 396 bp, Homo sapiens
gaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggcatttttgtgcctaatggacatacactgtgggagagaacctgtcaaaatgtcgaagaaggaaggcgaagaatcaagtgatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtca

SEQ ID NO: 13744 - DNA, 468 bp, Homo sapiens
cttactattggattcactttagttccgtgcctttcaaatagttttgtttcattatgccaacctcaggacctcctcaagaagtggggttgaggcagaagaaaatgttcaaccctctgtctcctcatccagacctgttccttttgagccatctcatatagtgggggctgcatggatatgttttaagtaacagagttcctctgcctttaaaaaaatgtttgaaaactaagccgggagcggtggctcatgcctgtaatcccagcactttgggagaccgaggctggcagatcacttgaggtcgggagttcgagaccggcctgaccagcacggagaaaccccgtctctactaaaaaaatataaggttagccgggcgtggtggcgcatgctctagtcccgactacctcgggaggctgaggcgggagaatcgcttgaaactgggaggcggaggttgtggtgagccgggatcgcgcc

SEQ ID NO: 13745 - DNA, 480 bp, Homo sapiens
agttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgt

SEQ ID NO: 13746 - DNA, 449 bp, Homo sapiens
aatttcagtgcgtggtgccctcgaagcgcccgcggastacgggaggctaggcaagtacggttcagaccgcctcctcatcaaaaacagcctctctggmgacsttcctgctagatcgacctttcattccttggaaagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaagtagttagtcagatccgaagtgacatatttgca

SEQ ID NO: 13747 - DNA, 462 bp, Homo sapiens
taaaataaaatttatgttcacttaaaaacttgtacgtaactgttcatagcagacttattcaaaacagcaaaatgtgaaccaatccaaatgttgtgtcaacaagtgtaaagcaaaacatatgacatccatagcatggaatactactgagtaatcaaaaggaacaagcaagctatagataacctgcaacaccttgaatagactacaagggtaatgtgcttagtggaaaagcttatctcaagaggtcacatattatatagttccatttatatgacattctcaaagtgacaaaactgtaaagatgaagaatagattagtgattgccaggggacaggggggtagtaggtggaggggctataaatacagagaggtagcagaacagttctgtatcttgattgcagttgtggttataaaaatctatacatgagacaaaactgcttagaaatacacacacaaatgcaggtt

SEQ ID NO: 13748 - DNA, 491 bp, Homo sapiens
tagaattgttttaaataaattgactaaaagtaaaattcttagaaacatgcttgcacataataagtcctcagtaagtgttaaactgctactgttggttatagatcatgagaactgagtaagtttaagaagtccagagacttctacctgataagtggtagagccagtgattaaatataggtgatctgaatctaagtcctacttgctaatttatctagttgcctttaccatattttattatatgtttatttacttattggacataaaattattagccttctaaactttgatttaaatgtggactggctgaatgcggtggctcacacctgtaatctcaggactttggaggttgaggtgggagggaattgcttgaggccaggagttggaggctgcactaagctgtgatcgtgccactgcactccagcggtgacagagtgagaccctgtctgaaaaaataaatgtgggccagaccatagaccaagtagttatagcaa

SEQ ID NO: 13749 - DNA, 361 bp, Homo sapiens
  misc_feature 331: n=a, g, c or t
accacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaancttatcaaggaatatcgtggcaagatcgag

SEQ ID NO: 13750 - DNA, 287 bp, Homo sapiens
aataatagaggtgcttttaaggaaggaaagggcttctggagactcatgcctggattgtgcatctgccccggagcagaatggaacagggaatttccccctgccctggtaactggaagaaatgacactttaaaaaatcaaggctaggcacagtggctctcatctgtaatcccagcactttgggaggccgaggtgggtggattgcttgaggttaagagttcaagaccatcctggccaacatggtgaaaccccgtctctactaaaaatacaaaaattagccaggcatagtg

SEQ ID NO: 13751 - DNA, 436 bp, Homo sapiens
  misc_feature 18,399: n=a, g, c or t
aagtttaggctgcgctgnyccctctcakcsccccctccaggtgaccccagcccctgaaaatcctcacccagggccccaaatctcccagccccatgaccgccaaacctctcgccctrgccccctaaatgccccaggccccggagatgaccggcctcctcaccccttaacttccagtgcctcccaaatctccaagcccaccctgtcccgtggtggcaactgaggcttctcgggggcatcagcctcagattacctgagaaactgggcagcctcgtcctgagaatgacggagaaggggactggggctagggaatccctgattcaatcatgccgctccccaggagacgttcggagcccaggacatgtcgggaatgaggagatacgaggtggcgctggaggcggnaggaggagatctactggggctgtatcgataccgtcga

SEQ ID NO: 13752 - DNA, 59 bp, Homo sapiens; identical to SEQ ID NO: 13084

SEQ ID NO: 13753 - DNA, 63 bp, Homo sapiens
  misc_feature 51: n=a, g, c or t
aaaaaggaagtaggaactgtccctggctttcaggcbccaacatcctccccngtcaagatgtgg

SEQ ID NO: 13754 - DNA, 477 bp, Homo sapiens
aatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctaca

SEQ ID NO: 13755 - DNA, 461 bp, Homo sapiens
ctgtttgaggctcagcctgtcttgtttcccttgaagcctttgctacaaagcggtgccatttggatttcgatttctgcacgcagagtgatcttattgctcctaattccctaggatttcacggaaattgcttgagttcctgtttcagtgtgtttcttgttctagcagtgatttttcttttctttgagacggagtcttgctctgtcgcctgggctggggtgcagtggcgcgacctcggctcactgcatcctccacctcccgagttaaagcgattctcttgcctcagcctcctaagtagctgggattactggcgcgcgccactacgcccggctaatttttgtatttttagtagagacggggtttcaccatgttggccaggctggtcttgaactcctggcctcaggtgatccgcctgtctcagtctcccaacgtgcggggattacaggcctgagcaccgcgcccgg

SEQ ID NO: 13756 - DNA, 93 bp, Homo sapiens
aacgatccggacgccgcgagctgacccgctctgctgttgggcgatttttttttaattgcagaaaaatttattaaattggaaaatcttgcgttt

SEQ ID NO: 13757 - DNA, 493 bp, Homo sapiens
tagataaactcctggatacatccagcttctcagcattgaaccagaaagaaacagaagtctcgaacagagcaacaatgtataaagtatataataagattgaattactaataaaacaagctaccaaccatagaaagccctggataagatgagttcacagccacattttatcacatatacaaagataacctggtattaattctactgagtgtattccaaaaatcaaggtggaagtccttcctaaattatttgaaaacattattatcttggtagtaaaacctagtgaagacacaacaaaaaaggaaaattaccggtcactattcttggtgaaaattgaracaaaaattcatgaagtactagcaagttgagttcataagcaaagcaaaaagttactttgccacaatcatgtaaacttcattgtatgaatgcaaagatgtttcatcatatacaagtraataaatgtgattcaccatgtgaagataatttttaaaaaaca

SEQ ID NO: 13758 - DNA, 433 bp, Homo sapiens
gataaggaaactgccagctgtcgaaagttaaccagcagagaggggaagatggcccaggagccagcccctcctgagttttaaactacactgttttctgtccagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatggacctgaccgagacggggacgctgaagacctcgacagctggccaacatgggcagcaaggggaagatcatcagc

SEQ ID NO: 13759 - DNA, 61 bp, Homo sapiens
attctkccctcgagcccassggcaacgaaagakaagctctatctcccctccakgagsscag

SEQ ID NO: 13760 - DNA, 437 bp, Homo sapiens
  misc_feature 18: n=a, g, c or t
agtttaggctgcgctganccctctcarccccccctccaggtgaccccagcccctgaaaatcctcacccagggccccaaatctcccagccccatgaccgccaaacctctcgccctggccccctaaatgccccaggccccggagatgaccggcctcctcaccccttaacttccagtgcctcccaaatctccaagcccaccctgtcccgtggtggcaactgaggcttctcgggggcatcagcctcagattacctgagaactgggcagcctcgtcctgagaatgacggagaaggggacctggggctagggaatccctgattcaatcatgccgctccccaggagacgttcggagcccaggacatgtcgggaatgaggagatacgaggtggcgctggaggcggaggaggagatctactggggctgtttctactttttcccctg

SEQ ID NO: 13761 - DNA, 60 bp, Homo sapiens; identical to SEQ ID NO: 12480

SEQ ID NO: 13762 - DNA, 207 bp, Homo sapiens
  misc_feature 16,24: n=a, g, c or t
gccaggagtgggagcnrgcggcgnggccagctgcgttctgagcctgggcgcmstgccatctgctkctgggaagcaccagggtgtccccgccgccctcagctcgaagtcagcycascatggaggcgcaggcacaaggtttgttggagactgaaccgttgcaaggaacagacgaagatgcagtagccagtgctgacttctctagcatgc

SEQ ID NO: 13763 - DNA, 335 bp, Homo sapiens
  misc_feature 274,289: n=a, g, c or t
aatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaaagttataaatatcgagtagctctnaaacaaaccacctgnccaagagggragtgagcttgtgcttagtatttacattggatgccag

SEQ ID NO: 13764 - DNA, 493 bp, Homo sapiens
gtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgtta

SEQ ID NO: 13765 - DNA, 115 bp, Homo sapiens
ctgtatttatgtgtgaggagctgctggcttgcagtgcgcgtgcacgtggagagctggtgcccggagattggacggcctgatgctccctcccctgccctggtccagggaagctggc

SEQ ID NO: 13766 - DNA, 459 bp, Homo sapiens
csacctakctattaccatgaatattttagtatacttgstttatcacatatctstccatttatccatcccacagttctgggtgatttttaccatttttctcagcccccassatcccttttttttagctagatgatgctcacttttataatctctcattatatagatagcsacatcaatattgtgatcttttgggtagaaaatttaagattgataagtttttagaaaacagcttttatggctaatggggcatttaggatatagttaagctagatgtggcttrgtttcacttaatgaagactaagaagctttaattatacctacaatataattttratttcatgtcatcccttaaaakcaaccattttkttcctctccagctgttttctgacaccattttctaaattttctagaaacatgaatgaagattgagaaagawttttgctgtgcagccttccatat

SEQ ID NO: 13767 - DNA, 543 bp, Homo sapiens
acatggggcccgagctcggaggcggccgggcggcgcggagtcctcctggatcgccaatgggcagacacagagcagaaagtkggcggacttgggcggccacagagcctttatgaccgaaagatggraactgaaatgccatcctgttatcaagaarggagcataagramcagctagaggagagatgcaagattgaaatatcatgggawtkggmywwtggtttatcctctcttctggtcgtaaaacaccatcaggttgtaattgttcagatcagaaattcccaagcttttaataaagcctttcagggagcctcatccaggggcaactgccctgtcattgggaataagtagagtgtgtgggaaatatgttgtccttggtaaaacctccccttaggaaagaaggcaagagaattgagtaagagaatgatggccccaaaaggagaaaatagagaaagaggctgcatgctacagagaacaagagcaaaattcaaaagcctggcacagttgagcttgaaccatctgtgtaaaggggactaataatgctgac

SEQ ID NO: 13768 - DNA, 392 bp, Homo sapiens
acatgaagagctggggccaggtcctgatggatccgtaccagcaaaatgactcgcctgaaccactgagaggtgatgggacttcaagcccagatcttaagagatctagagcttttgctttctctctgagaacccaactgccttgtaaagaagttcaggctgtccagctgtagacagcagcaacgtggagaaagawgccttgaaggttgagtccacatggaggaaaagagaggcatcccagctaagagccagcaccagcgtggcaaaggaggccatcttggatgcttcggtcccagttgaactgtcccagcagacaccatatagggcagagatgagctggccaaaattctaactcgaaaagcgttgtggttttagatccccaagtgttttcttca

SEQ ID NO: 13769 - DNA, 97 bp, Homo sapiens
  misc_feature 86: n=a, g, c or t
agaagccgcacttgttagtgtggggggaggtgggggcgggggacgcgacaccgtcaccgtcacccagggacgccgaggagaagrsnggaggggggtg

SEQ ID NO: 13770 - DNA, 178 bp, Homo sapiens
aaaaaatacaagaagtagccgggcgtggtggtggcgggcgcctgtagttccagctactcaggagcctgaggcagagaattgcttgaacccgggaggcggaggttacagtgagccgagatcgcgccactgcactccagcctgggcgacagagccagactccatcccaaaaaaaaaaaaa

SEQ ID NO: 13771 - DNA, 463 bp, Homo sapiens
taggacagtgtggttcccaaactggctgtataccacaaacaggtacggcattctgggccccggccctaaaacattcattaagtctggggtgaagatttggaatcttgaatgcttataaaggttaccacatgactagggtacagccagatttggaaaccatagcttgaaggcagtgagggagccatgaaatgtttttaatagggggactccagatcagatgtgaacttaacctgtttctggctggctagcaaccagcatggaaaacagattaggttagatgttcatgctgtatgtgcccgtgcctgtagcttccctgttaatcagcttcttacactactatatttgcttattttgtctctgaataagctttaggcaccacaagggtgggcctggggatattttgcttaccagtatagcccctgcaaaaaagcacagtgcctgacacaaaacaggcacccagtaa

SEQ ID NO: 13772 - DNA, 396 bp, Homo sapiens
cataacttctacttccttttaagtgtcattaaaatatctcagaaaaccagaaacattatttgatatctgccaaatactttcagataaaatacagtctttaaaagagtgacaaggccgggtgtggtggctcacgcctgtaatccagcactttgggagactgagacaggcgaatcacaaggtcaggagttcgagacctacttggccagaatgsgaaatcccgtctctactaaaaatacaaaaattagctgggtgtggtggccggtgcctgtaatcccagctacttgggagactaaggcaggagaatctcttgaacccgggaggtggaggttgcagtgagccgagattgtaccactgcattccagcctgagtgacagatcgagacctcatctcaaaaaa

SEQ ID NO: 13773 - DNA, 313 bp, Homo sapiens
ataaatatttaaaaacaaattaaaggccgggcgcagtggctcacacctgtaatctcagcactttgggaggctgaggcgggcgaatcacgaggtcaggagatcgagaccatcctggctaacatggtgaaaccccgtctctactgaaaatacaaacaaaattagccagacctggtggcatgcacctgtagtcacagatactctggaggctgaggcaggagaatcacttgaacctgggaggcggaggttgcagtgagccgagattgcgccactgcactccagcctgggtgacagagcaagactccgtctcaaaaaa

SEQ ID NO: 13774 - DNA, 582 bp, Homo sapiens
atgtaccaggccctgtgcccgagtaatacaacaatattaacatcaccttttggtagataaggaaagtctaagaccggacaacttgttcaaggacacaaagccaacatgtgttagaaccaggacctgccggatcagtcacataaggcttagaggatcaaggatcctgcccagatgacttaccgaaatgttacagattaagttggtgtggtaacctgggctgagcactctgggagaggaagagaagagagaagacaggaaacaactgaactatgaccaatcccagcacggaggcccagaaaactttaagatttgagtattaatgtctcaaggtcaggagcaacctcaaggctaaaactcagatctcaggactcaatttcacagaagttccactataaaggcaataatctaaagctttaaatgatatgaaaattttgtaataagagttcagtatttctgccaacattggcgcatggattgcaaagttcacaggattgaaaacaccatcgacataatggaaattgaacagcatctgattactgagtgctatatcagcaagttaaaaggatcttttgcatacctttt

SEQ ID NO: 13775 - DNA, 507 bp, Homo sapiens
cttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattca

SEQ ID NO: 13776 - DNA, 342 bp, Homo sapiens
ctgatacacttggggggacataaagggaaacccacacacccaaggaggagggctctggccatgcaaggctgaaggccagtgtactgatatgaaaactgaagctcagacagaagaggcgacgttgctttcttaaccactggatttgcagtgctgtggttctcagaagaggccaggacaggttaatccactcgcttgggagaaggaaatctttccatatcacccaggctgatcttcaacgaactggactcaagtattcctcccacctcggcctccagggttgaatgtacagctggtataaaaatggtgctttgtcgtcatgaagaaggtgtattctgggatcaa

SEQ ID NO: 13777 - DNA, 407 bp, Homo sapiens
ctgagggtggtgatcccccatcacggagttcctggtggcggtgtacggtttcgaatctacataacacgcctgtgaccctttcctggacacaatgcagacagttgctcgcttccgcacctgtaccaccacacaatctagtataacccttatgtaatttattgacctacgtttgtcttccctactagacctaattccttatgtggtcaaggactgttttttttaatccacactcaactagtgattgttgagtgaataaatgaacttaccctcacctccctgtcttcgctaatagcatgtcttcgctcttaagtcggttccttcaaccagtgttcaagatcccatcccctcgctagtctattaatagatcccatgggaaaaatgaaataaatttttaaaatcacaaaaaa

SEQ ID NO: 13778 - DNA, 475 bp, Homo sapiens
aaaaccttgtctctactaaaagtacaacaattagccaggtgtggtagaggacacctgtaattccagctactcagtaggctgagacagaagaatcggttgaacctgggaggcggaggttgcagtgagctgagattgcaccagtgcattccagcctgggtgacaagagtgagactccgtctcaaaacaaacaaacaaacaaaaaaattagtgggccgggtgcaatggctcacgccggtaatcccagcactttgggaggccaaggcgggcaggtcacctgaggtcgggagctcgagaccagcctgaccaacatggagaaaccccgtctctactaaaaatacaaaattagctgggtgtggtggcacatgcctgtaattccagctactcaggaggctgaggcaggagaatcgcttgaacccaggaggcggaaattgcaatgagccaagatcacgacattgcactccagcctgggcgccaa

SEQ ID NO: 13779 - DNA, 534 bp, Homo sapiens
aggagtactgggacgattccgcggascgggcagaggttttaggggtgcgcaggagtcaagtggtggttcagtggggacggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaasagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatg

SEQ ID NO: 13780 - DNA, 348 bp, Homo sapiens
ctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatatttkatttattctttagattttagccttgtaagttaaagtgctttacatga

SEQ ID NO: 13781 - DNA, 454 bp, Homo sapiens
gttttttgcttaggtatccagctcccgtccgcctgtgtgtggcggastgctgggtaacggtgtcgaatagcaaaccttgggggctggcgggaggtggcttatcttgtgggtagatccctctcgagcagccgtatccacctctcggctctgcttatctctaagtcccacttgctttgaagcatatctctaggaatcccccttctgcagtcaccgaagtgtcacctgaccttgcgcctaggggacctaatttatcttttatgtatcttactgtaagaggtgtggagtttggcctactaattgaacccccagttcttggataaagtccaccgacagttactgggcaagaaatttttcagtgatcagtggaatcaattttcccaaatcttggtcttaggcagtgtcgtgggagtcttccttagaattgccttgtgattgtccaaactatcccaagaat

SEQ ID NO: 13782 - DNA, 485 bp, Homo sapiens
ctctctcactggcagcaacccagcgcttccattgctgacctctaccgacctctacctgtggtccttcctctactgcagcagagacactgttttcttcctttgttcttccaaccccatggcacagaaacactctccactgcggccaaggattgcaggagaggtggcatcagtgattcaagacttcttttcctacctcttcagtgtttctttcagtgatctgaagttaaagccagggggaatatcacagaagtgaagtgcaattctcatcatgtcatatcaagagcacacactaacaaacaacatgacttattgctgaatattgaacttgatcacctggctgaggtagtgtttgccagatttctctgtaaaggtgaataaactgacactggaacattcaggaacttcttcatggtcatggtcacccagctagagtgtggaagccaggctgtctgattccaggatctgtgttcttaatcctatacata

SEQ ID NO: 13783 - DNA, 134 bp, Homo sapiens
aatttatcaaacactccggctgacagaagaatgcaagttaagctctctgctgccttggcattatcaaccagcccaagttccattctataaaatctccagcaagcctttgtctccttgcagtcagctcctcttct

SEQ ID NO: 13784 - DNA, 266 bp, Homo sapiens
taaaaaacttttattatggccgggcgcggtggctcacgcttgtaatcccagcactttgggaggccgaggcgggcggatcacgaggtcaggagatcgagaccatcctggctaacacggtgaaacccgtctctactaaaaatacaaaaaaattagccgggcgtgatggcgggcgccmtgtagtcccagctactcgggaggctgaggcaggagaatggcgtgaacccgggaggcggasttgcagtgagccgagattgcgccactgcact

SEQ ID NO: 13785 - DNA, 417 bp, Homo sapiens
cttaccaggaagcagatacatatgagtgtggaagccggagggtgtttatgtaagagcaccttcctcacttccatacagctctacgtggcaaattaacttgagttttatttattttatcctctggtttaattacataatttttatttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacc

SEQ ID NO: 13786 - DNA, 499 bp, Homo sapiens
gctgttccctggtcctggcttttgagaaaagagccagcagcctctggtcttgttgacaccatcatctgagagtggcaggccaccagagggaagggctaaggacagagccagatctggctgggccatctcaccttctggaggccgaacttgacccgggatggaaataatgaagcagccactggctttcccaaggcctgtgatcctcctggtcaccagaaatcccaagttcttatctcctgctcttccagtctcctctgttagggtactggttcccagcgcagagcttctgtgattaccagaagaacactgaaggagtcttcttgtctgtctggagccagctgagatggccctgagatccacagagcctcctccacgcccctggatggaggcgctcctgctcttccaccctttgtatctctcacttggcacccattcccgtaattaatcacaaactccgtctgagctattcctttctaagccatgccctctgtactctgac

SEQ ID NO: 13787 - DNA, 478 bp, Homo sapiens
ctctgaaatctacccttgcaagcttcagacaaatcagttgatctccctgagccacacggcctcattctgtgagggagggaaagattagccaaagagttaattttcattccaaatcacttagctgttagactgatctgtttgtagcagttgtttgtctcatttttgctctgtgcattttttgagacatttgttgagaatattctatttggtgctctactgtatttttctttttaatatctacttgatatcttgttctttaaattttcttcacatatggtttgcctgatacaactgatttttataactgaaatttaaggaatctaacagctaaaactcagtaagtgcatctatttccttataacatagacccgttgctactctcagcaccctctcctcaattttttttcctgtagcatgtgatgcctgattaaactcattttcatttgcttttatttctaatatggggacaatgagagtg

SEQ ID NO: 13788 - DNA, 605 bp, Homo sapiens
aagggatacccaggcaatccccgaaactacaatgcccaaaatgctccaagtgggacgcgcccagagtgaaggagcaaaggggactcggccgccatgttaggagtactgggacgattccgcggascggggcagaggttttaggggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaaatagatccttataacaaagaaaaggcagatagaatgattaaaaatgaccaaaacatgttagaaacagtctctcaggtgtatgcagatggtaa

SEQ ID NO: 13789 - DNA, 472 bp, Homo sapiens
arattttcctgaaaccatacatttctagtgaaataagtaattctagattaggamcaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaadagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttga

SEQ ID NO: 13790 - DNA, 239 bp, Homo sapiens
aacagtttggcctttcaaggagcagactgggtttgccctggggactcccaagtttctctgggccccagctctgggctaggagccgtgggcacgagaagacagggctccttcctacctgaggtgaacaggactatggccttgaggcagctgtactcggctgagtcaacgtgcagcgccttgagcttctccacttgctcttggaagatccgtatgtggtccataaaggcgaccacccggtc

SEQ ID NO: 13791 - DNA, 500 bp, Homo sapiens
  misc_feature 493: n=a, g, c or t
taaaagaataaatacttaaacgtgaaaggtgactaaatgcggggaagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatcccagcactttgggaggccgaggtgggcggatcatgaggtcaggagtttgagaccagccagtttgagatcagcctggccaacatggtgaaattccatctctactaaaaaaatacaaaaattatgggcgtggtggcacctgtctgtaatcctagctactcgggaggctgagagaggngaattgc

SEQ ID NO: 13792 - DNA, 449 bp, Homo sapiens
  misc_feature 418: n=a, g, c or t
cttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccanaacaccaaaaatgtgaacaagataagagatt

SEQ ID NO: 13793 - DNA, 433 bp, Homo sapiens
  misc_feature 32: n=a, g, c or t
awatcgcaaatatggcgcsggagcggctgcgnascgggcgctctccgccttcaagttgcggggcttgctgctccgtggtgaagctattaagtacctcacagaagctcttcagtctatcagtgaattagagcttgaagataaactggaaaagataattaatgcagttgagargcaacccttgtcatcaaacatgattgaacgatctgtggtggaagcagcagtccaggaatgcagtcagtctgttgatgaaactatgtatgtgggtacagttaactttttwcctccttggagtgttattgagcacttattttkaattattgtcttggaaaattattagtgatcaacgtttctacagtgattactgttgttatttctgtgtgtctttttaaataatggctttctttgcaaacctcattattaaatgactcatctt

SEQ ID NO: 13794 - DNA, 394 bp, Homo sapiens
acaggttgaggctactaaggtacattttgctgggccaggctgggcgggtccccgggatgggcagccctctcgacgagcggcgacgccgtggttgagtctagaaagctagagttgctggacagctatcgcgggagscggagggaagtgggaggtctggacggagtgtgcacgtgttggcagtctcgctccgccgtcggagccaccaggtcaaacctgtgctggccctggccaaagaaacttctgcgggtcaggctgctgttgccggtgcagttcccagtacttcctctggggcgtttttcaataaaagccaaacgcccttgctcattttcagggaaagacctgtttcctcctgctctttcctctccacggatactctccccaccactaaaagggt

SEQ ID NO: 13795 - DNA, 507 bp, Homo sapiens
gtggggctgctcccctgctggccagcctggcccgggagtggtgctggccacaggctcccgagatttcctgtgcccagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgcctggcctgaaggccacaacccccacccccaggactgctgctggagcctggacacgtcctacttaagaaaatgccttttactcagggaatctcctgctacttaatgtggaaagacacgcccatgtsccccttcggcccactctgggggctggaaatgctgcagtggggagcaggccccaggctggacctgccctgtcctcagcamgcgtgtgsaaaagtgaacaa

SEQ ID NO: 13796 - DNA, 363 bp, Homo sapiens
atgttaggagtactgggacgattccgcggascgggcagaggttttaggggtgcgcaggagtcaagtggtggttcagtggggacggaatgattaacaaaggcgtccgaagaaatcgttgttggaaggtgaccaaggtggaaagagacgttgctttggccctgcaaagtctgtcacactaagatgagaaatgtcctttcttcctgaaggtgtctgatgtgtaaaaatatgatatactttgtgctgtttcctccctttcccttttgcatattattctgaaacaacattaactagttactttgcgtcattgaagaactcactttgaggccaagcgtggttgctcaggcctgtaatcccagcactttg

SEQ ID NO: 13797 - DNA, 146 bp, Homo sapiens
ttacaaattagccagatgtggtgacacatacctgtagtcccaactactcaggaggctgaggtgggaggatggcttgagcccaggagctggaggctgcagtgagctatgattgtaccactgcacttcagcctgggcaacaaagggaa

SEQ ID NO: 13798 - DNA, 518 bp, Homo sapiens
catagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgattt

SEQ ID NO: 13799 - DNA, 294 bp, Homo sapiens
ttataggtacttcacagcaggataactagttgatatagctactaatttaatcaaataaagattttattttttcagtttgtacaggagaaaaaagacattaccattgaactgaaagagaaacatgttttcgaattattcttcatagcacactaaagacactgccaaacaacatctactgccttacacatggtattagtttaagaaatatttgttgaatgaatgaacattgaatttaaactgctatcatcagtgtcaggracctacaggtgaagtctcatgtcatttattgacagg

SEQ ID NO: 13800 - DNA, 343 bp, Homo sapiens
attacctaggaccattcagagcctgactgacatcttcttagactagttctccatcactgcttgtccttggggaaggtactatctagtgccctacccagagaaagtgtatatgttctaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtgagtgatttggatggggaaaggtggaatttgttgtctccctaactgcgaag

SEQ ID NO: 13801 - DNA, 420 bp, Homo sapiens
atgttaggagtactgggacgattccgcggascgggcagaggttttaggggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaggcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatcctttataaca

SEQ ID NO: 13802 - DNA, 465 bp, Homo sapiens
tcacccctgaggaagagctttaatgtcactagggattcacccttatgacacaaacacctcctgcaagtggacccaacattgggatcaaatttcaatattagatttggagggaacagacatctaaaccatagcagaaggaaagaggcaagaaagtagctgcaaaagcatatgggctcgaagaaggagttgaaaacaaacatgtttaagattgtgagaaggtgctagctgacagagaaaagtcgcatatgcaaaaaacacaaagcactaatggaaagttcctgagaaggttgtgacaagggaggaattttgtgacttgaagcccagttaggagaatgatgagagatggtgtgaggacagctcctgccttttcacctgacagcccaagatggtgtcttcatctgctagtgcaagatctagggagggtcttatttttatatctttcttcctacttggaagggaggcagt

SEQ ID NO: 13803 - DNA, 369 bp, Homo sapiens
  misc_feature 148: n=a, g, c or t
atggagacgggtttcaccacgttggccaggctggtcttgtactcctgacgtcaggtgatccacccgcctcggcttcccaaagtgctgggattacgggcgtgasaccgtgctcggcccaaggcaggagaatctcttgaagccgggagsngaagttgtggtgagccgagatcgcgccactgcactccagcctgggcaacaagagtgaaactccgtctcaaaataaataaataataaaggaagaagtcagctgggtgcagaggctcatgcctgtaatsskcaatactttaggaggccaaggcaggaggatgcttgggtctggaagtttgagaccagccagcgcaacatagtgagacctgtctctaccaaaaa

SEQ ID NO: 13804 - DNA, 477 bp, Homo sapiens
tatttttagaaattcatgggaaattggatttttgtaataatcttttgatgttttaaacattggttccctagtcaccatagttaccacttgtattttaagtcatttaaacaagccacggtggggctttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatgggtattt

SEQ ID NO: 13805 - DNA, 312 bp, Homo sapiens
ctttttgtttttaggtcccttgggtagaacctgcagcaggctaggtgaccgacgggcctctctagcctttacagaaaaaccattctccttgctcaggccacaggacttcagtcaacaaaaaggcctgaacatactggtgctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagc

SEQ ID NO: 13806 - DNA, 383 bp, Homo sapiens
tgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaagagggtgtatgaccatgccaggagggctctgtacaatgctggcgttgtggacctcgtttcaagaagcaaccagagcccttcacactcgcctctgaagtcctcagaaagcagcwtgaacacagcagctgcgagggcctcagctgccagcagacccgggtgctgcaggagaagctacgcaagctgaagg

SEQ ID NO: 13807 - DNA, 348 bp, Homo sapiens
tagatagatagatggatccaactgtgtgaatagccagcaatccctgaatcccagagccgggcactcctccccatgtgtcagtctcatgaatcaaagtcttatagtgtatattttatggatatgctgtaaatatttctcagaaatcacagaccatcttttcagttataagaatgtccaaacttggcacggtggctcactcctataatcccagcactttgggaggccaaggcgggcagatcacaaggtcaggagttcaagaccagcctgaccaacatggtgaaaccccgtctctactaaaaatacaaaaattatccaggcatagtggcatgctcctgtagtcccagctac

SEQ ID NO: 13808 - DNA, 72 bp, Homo sapiens
atgtatgatttctgcttggactgtattgttaatacatacatacatcttttggtctattggcaaatgaccctt

SEQ ID NO: 13809 - DNA, 471 bp, Homo sapiens
  misc_feature 454: n=a, g, c or t
aagcctaacccttcaggtttgcttcaggtggggtcgtgggcgccaggttctttctcgagctggggggctctgtgtgcccagggcgctcctgcgctgggatctgcgaggagatacccagagccctgcgtcctctcctattcagcgcccgtgtatgttaattgtgttataccatttaattctaacatcggtctcaaaagagctcttaatgagaaaagcatatacaacatggatcactttgctattcagcttagccagatggacaactgctaaccttttttttttttaataatgaaaatccccctttgacaaaggggctcggatgaataggctccaaataacacctcaaacacttctaattgttttgaggacaatatgctaatccgcgggtttcggctttggtgtctgttgacaacgtttcccgtgcacttcgagccacsgastcctttggaaacansggaggcaagsgtacaa

SEQ ID NO: 13810 - DNA, 505 bp, Homo sapiens
agaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgaacacaagtagatgcctgaacttgaattaatccacacatcagtaatgtattctatctctctttacattttggtctctatactacattattaatgggttttgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgat

SEQ ID NO: 13811 - DNA, 466 bp, Homo sapiens
tataacaaggtatgttaggctttttctgtatgtgttctcatgtgaaatgttagagttgaacattttctgtaaaattgtttaatatacagtcatgtgccacataatgacattttggtcaatgatagactataaacaatgttggtttcataacattataatgaagctgaaaaatatctattccctagtgatatagctgtcataattttaaagtgtattacatgactcatggggttgtgttgatgtttgtgtaaacaaactttctgcactgccagttgtataaaagtataagtacagttatgtacagtacacagtacttgacaatgacagtaaacaactgttactggtttatgtatttagtatatgataacttttattatctttgagtgtgctcctccatataaaaaggtaggccgggcatggtagctcacgcctgtaatcccagcactttgggaggccaaggtgggcg

SEQ ID NO: 13812 - DNA, 320 bp, Homo sapiens
tttttaaaaagattttgaatttaggctgggtgcagtggctcgcgcctgtaaccccatcactttgggaggccagagtaggtggattgcttcagcccaggcattcgagactggcctggacagcatggcaaaaccctatctctgcaaaaaataaaaaattggccaggtgtggtggcatgcgcctgtggtcccatctacttgggaggctgaggtggatggatcacctgagcctgggaagtggaggttgcagtaggctgaagtcatgccactgcactcaaacctggcggacagagtgagaccctatctcaaaaaaaaaaaaaaaa

SEQ ID NO: 13813 - DNA, 294 bp, Homo sapiens
aaaaaagagtagggccgggcgcggtggctcacgcctgtaatcccagcacttgggaggccgaggcgggcggatcacgaggtcaggagatcaagaccacggtgaaacctgtccctactaaaaatacaaaaaattagccgggcgcgatggcggcgctgcagtctcagctactcaggaggctgaggcaggagaatggagtgaacccgggaagcagagcttgcagtgaggtgagatcgcgccactgcactccagcctgggagacagagtgagactccgtctgaaaaaaaaaaaaaaaaa

SEQ ID NO: 13814 - DNA, 475 bp, Homo sapiens
agaaaccctcataaagtagatgcagagggcagtaagatataactcaactttgaaaatgtcagccgttatagttgaagaaatctgacccaagagacttcgctccgctgcaagatggaaggaagcttaagtaagacataaatttgtaatgaacttgctcacaacatccgccgccactgtgacttgcagtcatcatccattaccacaaaattagttgcaggatggctactcgtatccctccacacatgatcatcagtatttgcctcctgtgtcccaaccggcctgagtcaaggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactggg

SEQ ID NO: 13815 - DNA, 481 bp, Homo sapiens
ccatggtcaatggcctggmacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggcgagcccatttctgcccaggaggccctgctccacgggctgcttagcaaggtggtgccagaggcggastgcaggaggagaccatgcggatcgctaggaagatcgcgtcactgagccgtccggtggtgtccctgggcaaagcaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagt

SEQ ID NO: 13816 - DNA, 109 bp, Homo sapiens
agggatgtgacagagcgcgagacccagcctaaagagagcccggagccagcgtgggaggccgctgccgtcgcgcgccttggtttttctgttccttttttttttttttttt

SEQ ID NO: 13817 - DNA, 472 bp, Homo sapiens
  misc_feature 56,337: n=a, g, c or t
tattgcactctggcagaagtatttcccacatttaattattgcbkccccaaactctncccacccctgctgccccttcctccatcccccatactaaatcctagcctcgtagaagtctggtctaatgtgtcagcagtagatataatattttcatggtaatctactagctctgatccataagasaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttrngattgaattttgatgtacttatttttttatagatatttatattcaaacaatttattccttatatttaccatgttaaatatctgtttgggcaggcatattggtctatttatttttaaaatatgtatttctaaatga

SEQ ID NO: 13818 - DNA, 443 bp, Homo sapiens
  misc_feature 405: n=a, g, c or t
ttttccgggcaggaccccgcacccaaaggctcacctgtgggaccgcgttgtcagtctcggcgcctgcgctccgctccaggaagaaagcgccaaggcgaggcatggcggtctccgtgcgcaccggcagcttctcgtgggacatcaggatgtcgtccaaagaaagaaagttctcctcaggccccagcgcacccgactccactcggaaataagcctctgacatggcggccacttgagcttctccgcttccactcgcgtgattcggaggagcctcaggagttaggggtgtacaagacggggaagcggagactgggcaggatggttggggtcaggaaagtggattgaaactcgtttcccgcgcccggggacgcatcagacaggagcagtcaattcgggcggtaccgccangcagaagcaatcgatcaagtctgcagatttagagcagc

SEQ ID NO: 13819 - DNA, 372 bp, Homo sapiens
aaagcctcctgcagactcggggtttgacttgcgggaggtggagcattttctgaaggctgagcctgagaaaaacggggaggtggttcacaccccggaaacaagtgtctgagtggctgggcggggccggcasacagggaggaggtacagaagccggcaacgcttgctatttattttacaaactggactggctcaggcagggccacggctgggctccagctgccggcccagcggatcgtcgcccatcagtgttttgagggggaaggtggcggggtgggaacgtgtcattccagagtggatctgcggtgaagccaagccgcaagttacaaggcatcctcaccaggggccccgcctgctgctcccaggtggcctgcg

SEQ ID NO: 13820 - DNA, 105 bp, Homo sapiens
agcgcctgcgaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13821 - DNA, 428 bp, Homo sapiens
tttaacagttctacttgtgtacctctggcaatgaggaactcactctctaggagccactctttccattgtggatagctcttctcattggaaagctctttcccgctgatctgacattcgtgtctggaactttcatccatttcagaggataggagcattcttgacggtacagtttgtccaaccagtcaacacattactcttccttttgttctgacataagtggtataaaatgaggtaatagatgcattttggaaaaagtaatggcattatacaaatgcaagaratgttattgataggcttttatggcttagatgaatctgacttgaactttcagcatcatatactccattagtcgagaacattgcagtgaccttttttaggaagcagtttcctggagatttaatcagtgtagaaaaataccatattcagcc

SEQ ID NO: 13822 - DNA, 485 bp, Homo sapiens
gtccttatcccgaagctggggttactaggtgaacacggccggaggagagcgctctgaaatccattcttcagccgcacgtggaaaatggacagctgtgactcttaaagagaattaaagcaacaaagcatctcagcctgctctatgagctggatatttcgtaggaaggagccgatttggcgaaagttacgtaaacaatggaattgtctcagtttgcgcctttgtttcgtttgacagccctccagggagtcatagtgattgctggagacggtgaactaacactgtggggacccttgtgctaaacgtgtcaagtggcacaacaaggataggaacacgggtcctttggactccacagcttctgctccttccagattaagccacactgctttctccaagttgttactgtagtaacatcattttggctgcagtttgtggatgkgttggaagatgggaagtcaatgcagaagcaccgttgaaagtattccact

SEQ ID NO: 13823 - DNA, 257 bp, Homo sapiens
  misc_feature 11: n=a, g, c or t
gcgctctgssnctgacggcgcttttgtctccggtgagttttgtggcgggaagcttctgcgctggtgcttagtaaccgactttcctccggactcctccacgacctgctcctacagccggcgatccactcccggctgttcccccggagtgagcggccctgtggttccccggctccccacccccatcgctagagtgctcgccgcgctagagccttcgcgttccagggctgggggtgcgccgccgggatcctctctgatcg

SEQ ID NO: 13824 - DNA, 139 bp, Homo sapiens
gctcacgcctgtaatctcagcactttgggaggctgaggcgggcagatcgcttgaggtcaggagttcaagaccagcccgggcaacgtggtgaaaccggtctgtactaaaaaaaaaaaaargaaaaagaaaaagaaaaaag

SEQ ID NO: 13825 - DNA, 477 bp, Homo sapiens
taaaaaaatcagtgtggacttccattcctctttcttttgattccccccctttgacttttcatgtatctctcctgccttccttccccagagtggaggagttagacttgcctcgtgggatgagaggagttgtggctttgtgtctgctggcaccaagagggctgagggtgaggtgtggaagggacagggggaggagatgggcagcattgttgagagattggtaacactgagcaaataaatatgttgagaatgatgacagcaagatttctccattagagaaggtatttataaaaataggaatgaggagagctagaaaacctggagtgtggcattagaatagaactcatatcttttaaatatataggaacaaataaataaattgttgtgtgtgcacatatgcatatattttgtgttcattctactgagaggacctaaacacaatgacacctcagtaacagtaagcacaccaactgccaagtt

SEQ ID NO: 13826 - DNA, 460 bp, Homo sapiens
ctatactttcagggatcatttctatagtttgttacaaacatatgccattaatagcttgataggtcatactttaatactttttctttctaataaatagatatgctttttaaaatttggctaagttacgggcaaatctatattctcttacccaaatcagataatagactagacagtaagcccacaaaaccataaaccaggcaccaccattcactcggtagccagtacctgagttataaatacagtgactcacagaaaataataaattttcattaggctggcctcccccaagttaaatctgtaacatgaaacagccattttaaagtggtgtctaggcagggcatggtggctcacgcctgtagtcctaatactttggggggctgagacaggcagatcacctggggtcgggggttcgggatcagactggccaacatggtgaagcctatctctactagaatacaag

SEQ ID NO: 13827 - DNA, 481 bp, Homo sapiens
tatttaaaattgggacttatacagattatttaaaactgggatacatgcatctaaaacactgtaatatttataagaraggaagataaacttacggggaaatacagtaacagtaactacatacgagtctgtacccattaaattgcatatctatctcctttaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttktttatcttaaagtcactgtctattt

SEQ ID NO: 13828 - DNA, 52 bp, Homo sapiens
aaaaaaaaaaaaaaaaaaaaaaaaaaaaaaaaaaaaaaaaaaaaaaaaaaaa

SEQ ID NO: 13829 - DNA, 471 bp, Homo sapiens
aaaaatgagccgaggtcatggtggttcggagatgacagaaggcaggcactsaggtgcacctcctggatgataggagactggagctgctggttcagcccaaacttctagcaagagagttgctggacctagtggcttcacatttcaacctgaaagaaaaggagtattttggaataacattcatagatgacacgtaagtcctttaatagttttagtttctttaccttttgcctgggctacctacttgctgtcttccataattaacaaaaaaggaaataagtcctccagcattcagaacatgtcctgcttagctaaaggttttttaatatgcgatttttctcctaggattatggcaaagggagaagaaagggatactgaccattttaggaactcaatattgttctaaatgttttagaaatgtgtagtaatgagtttgttattcccaattacagtgtatcttctcatgtcttttga

SEQ ID NO: 13830 - DNA, 428 bp, Homo sapiens
atttcctttaagtctcattggcttcagagctttctgctgcaacaccaaacatcagaagacaacaaatcaatttctacagagaacaaggagcagcatcatccaaggctcttaagtctcactattatccttcctctgtgaagacaaccagatggtgttacacatgatagaaactaatagtccttcttggaaagaaataatttgaatatttacttcaatccactggtagttacatttttttaaagggccgacaaatggtggtagtaagtactgggacaagtccaaagtttaaataattattgcattctggtttaaaaggtgaccaaaagtggtgtctttatcaaataatattttgtaattgcttgttgtttgttcatatgtatgcaactaatttttgtgtatgaatcttatatatatctaaattaacaatc

SEQ ID NO: 13831 - DNA, 84 bp, Homo sapiens
  misc_feature 2,53: n=a, g, c or t
antcttctggtccccacagactcagagagmsacccaccatggtgctgtctccngccgacaagaccaacgtcaaggmcgcctggg

SEQ ID NO: 13832 - DNA, 496 bp, Homo sapiens
gcggtttctgcggcggctggagaggtggtcggagaagtaggaacctcctgccgggctcgtggcggcttctgtccgctccgscggggaagcgccttccccacaggacatcaatgcaagcttgaataagaaaaacaaattcttcctcctaagccatggcatatcagttatacagaaatactactttgggaaacagtcttcaggagagcctagatgagctcatacaggtgggagactgaattaaaaatcaaacatttttatcttgatgggtttacagtaattcttgtcatatcacttaggcaaagagatatgaggtaaaatatcttggactgtttgacccagcaagtcagtaacactgattaaattacctcaaattcttgtttattacactgtcctgacaacaggacacaaaacatgattgaatgatatcattaaatatagctaaatctgggtacatgcagtgtttcatgcctctaatcccagcactttaggaggacaa

SEQ ID NO: 13833 - DNA, 402 bp, Homo sapiens
ccaaaatatttttttcaataccaagcgcatagtgacgaatgatgtaatcaatggacttaatctctgtgcctttttaaaggcttagatttgcttaaataaacaaatcaaatgttagcagggaccaggtacaggtggctgacacctgtaattccagcactttgggaggccgaggcgggcggatcacttgaggtcaggagttcaagaccagcctggccaatatggcggggccccgtctctactaaaaatacaaaaattggccatgtgtggtggtgtgtgcctgtggtcccagctgcttgggaggctgaggcaggagaatcgcttgagccggggaggtggaggctgcagtgagctgagatcacaccactgcactccagcctgggcaacagagtgagactttgtctc

SEQ ID NO: 13834 - DNA, 479 bp, Homo sapiens
tttctgtactcagatatgcagtcactggcacacatcctgttactgacgggaagctggacccagcactggagtatttctgagactatgacactctggtgtattcctgaaactatttatgacactattaagctcttttctgtaattttacaatatgtttggtaagatctcagcgcsagatttttttaaatgatgtgtttatttcttttaattgacaaatacacattgtatgtgtttatgtggttgcacatggtgtcttgatgtatgtatccatagtgagatggatttaaatatgcatgacctcacagactttgcagcacttttttgtgtgtggtgagaacacttattcagaatgggctcctttagtcgttttcaaatattcaagccattgttactaattgcagtcgccatggtgtctctgagctttcctgaagttatttgtcctgtctcatggacgctttgtgccctgtgaccgatcgtct

SEQ ID NO: 13835 - DNA, 487 bp, Homo sapiens
agcgccgcgcaaagaaacaggccgagggagacaacgtgcgtggaaaccatagcaacgtcctttctggcctctgttgactgcctctcttccccgggcctggactctacacctgacaaagcaaaatactcattgacttaaattcccccgaaacacgtttctcgccctctcatggagtcgaagtccttcggcctctgagaaggtcagcccaatttcataccccttaatcctgtgaaatccttgataaatatttgagccatttctctttctcgatggaaaacaagagaagtaggcgcttcctgaggatgcttcctgttttctctttggaaaggacagactctttgagatctgctctccggacgaaaaatagattgattcatacacgtcatctgcctaagtgctaaggaaaagaaataaacatactgtgagtttcctatatcatcttcccactaatttaactacataaagtgaaatcaataaagatatatgg

SEQ ID NO: 13836 - DNA, 100 bp, Homo sapiens
ccggagcccggggtgctggagggaggcggcaggccgggtcaggggctcgagatcgggcttgggccagagcatgttccagatcccagagtttgagccgagt

SEQ ID NO: 13837 - DNA, 537 bp, Homo sapiens
gtcagattcccagagagatccgtgtgatagccgtggcccaagaaaggttaacagttacagacttagaactaaaagaagtcaggtacactgaaagccttagaatgccaacgattggccaagcgtggtggctcatgcctggaatccctgtgttttgggagaccgaggcaggcggatcacctgagtttgggagtttgagaccagcctgaccaacatggagaaaccccgtctgtataaaattagccaggcatggtggcacacgcctgtaatcccagctactcgggaggctgaggcaagagaatcgctttaacccagcgggcggaggttgtggtgagccdagatcgtgccactgcagcctctgcctcccagattcaagcgattctggtgccttggcctcctgagtggctgggacttacaggcacgtaccactataccctgctaaaatttgtatttttagtagagacagggttttgccatattggccagggcttaggtcgtaatgtctctttttwaacactgaatatgttaggtggtttttcc

SEQ ID NO: 13838 - DNA, 481 bp, Homo sapiens
cattaaaaagtgtcagaggtaaaaaagataggaagaatgcatgggaaggggagaacaaagaggattagagtcaaacagtcagaatggggcagcaagttcaactgtgcagtcagcctgagttttaaattttgtccttagaaaagcatgtgaactcccagggtgttagtgttcgagtagacaggcaaggaattctgtttgtcagcttaaccacatcttgtagcgtttgacctgagcacgagtgtccaggtatattttgagtggtacatttatctcctggcttaaagcccttactttgtttccataaaattaggacagaggcaaaaaggcattacgggatagcaccagccaattgtacatcaccttttgaatcattttcttgaaggattgtcaatattctctgacatatatcacctgacaaaaagcgaacaagcctagacaaactgaaaaaggaagcattcagtggttggagctgagcactact

SEQ ID NO: 13839 - DNA, 452 bp, Homo sapiens
  misc_feature 422: n=a, g, c or t
tattatacaccctgtacaagactatatgaaggaacttggtatttttggttttataggtttgggcacagcacatcaaaggaagctaaagaatactttgcagatatgaaaagacatcgtatccagttcaaatattctggtcctgaagatgatgctgctatcagcctggtagrtttgagttgtattttatatacattctaattttagaaatcactactttagccagttgaaacatttacatttttgtataagactccgtatcaaaaaaaaaagaatgttttatagaatagaatgtttccagtaagcatatcccagagaaggaatcagatattttagaaaattttgatttttggctgggcttggtggctcatgcctataattctaggactttgggaggccaaggcaggtggatcacctgagatcangagttggagaccaacctgtccaacatggtg

SEQ ID NO: 13840 - DNA, 284 bp, Homo sapiens
twttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattcacttgtcctgaggagcactttccaggcatagttacagcttccccactgtatttacaagccagaattgtgcaactcttctggatcattaataaagtagcaagatcctcaa

SEQ ID NO: 13841 - DNA, 353 bp, Homo sapiens
aaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaaccttcaaaaaaaaaaaaaaaaa

SEQ ID NO: 13842 - DNA, 63 bp, Homo sapiens
aaaaaaaaaaaaaaaaaaaaaaaaaaaaaaaaaaaaaaaaaaaaaaaaaaaaaaaaaaaaaaa

SEQ ID NO: 13843 - DNA, 494 bp, Homo sapiens
aataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcatt

SEQ ID NO: 13844 - DNA, 429 bp, Homo sapiens
  misc_feature 129: n=a, g, c or t
taaatttaaatttcttctaaaatctatggtaataaaattattattataataacattgcaagataatgggagcatgacattacaacatcaagaataaggaatagccaggtgctgtggctcacgcctgtantcccagcactttgggaggctgaggggagaggattacttgacctcaggagtttgagaccagctatatataaagaactcttaaaactcaacaaaagtcaaataatccaatttaaaaattggcagaagacttaaatagaaactttaccaaaaatgacatacaaatggccaaaaagcgtatgaaaagacgctcaacatcactgactaccatagaaatgcaaatcaaaaccacaatgggccatcacctcacatttagtgagctattacctacattgtagtaaacccaattttttattccgtattg

SEQ ID NO: 13845 - DNA, 472 bp, Homo sapiens
tccttaaatattgggttgccttgtgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaat

SEQ ID NO: 13846 - DNA, 317 bp, Homo sapiens
gagggtggtgttgcgtagatatgggattgagatggagggatgagggaattcaaaagaatggagatggagaagtaggggaggggagggaggtgagagataaacagagagagagatagagaattatatagcagtatgcgaaaaaccagtttaaaacccatgaagcaaagagaaatggatgtataagctagacaggcatgaggagtgacagagtttccttttcaaggagatggtatccctcctgttgatatacacagatgatccataattgctgtgtattattgtgagcgaataaacagagagacgctaacaaaaaaaaa

SEQ ID NO: 13847 - DNA, 316 bp, Homo sapiens
tttctgaatacaaattccttatcagatacatgatttgcgaatattttctctcattctttgagtgccttttaactcaaacagaaaaaaataaaacaattacctagaattgctatatgtatacagtggtatttattcactaaaatatttttkaaactttcttattgaagtatggcttatatacacaaaggtacaggccaggtaggccaggtgtagtggttaatgcctgtaatctcaacaccttcggaggccaaggcaggaggatcatttgatcccaggaattaaaccagcccggccaacatagcgagaacctgtctct

SEQ ID NO: 13848 - DNA, 390 bp, Homo sapiens
atgctccttaagttccccgtactccctcggagaccctagctacacgccgaatccgttactccgggttttcgcagtggctcggtggcctaccccgatcgaaaccgtgagcttttgctgagggagggcaatgggagaggggaggatggacgcagagtttagaagtagtttgccgaggtgcagtcgcacgaatggatttcatcctcactggtgtatttaatagtttgtaatctaccaaacagcaactgccagaagccagtcccagctaacctactggcgtgcacgaaagaacccagcgatgctgatctcgtttcgttatttttctgacttaaacggttaaatctaaacgcgattactaagaaaaaaaattttatacctatcattgtacacaaa

SEQ ID NO: 13849 - DNA, 181 bp, Homo sapiens
tgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaa

SEQ ID NO: 13850 - DNA, 544 bp, Homo sapiens
acctgccgcgcgcttccgctgctggccagtctcttctgcccctccccctcctgtacggccgctactctgcgcccggcttccttctcacaacctggttctgcccacacctgttcttcagccctgtgaacagtggctgtagaacagtctcaggccctgcagacccacctccctcgctcccgtggtggcggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagaaggtgttgagctggcgagttcgcggaggctactattcaggaaatcttatccagatgagtacactggaagctacacctctccattactctgtccaggtgcatggctgcctcctaatcccatagtccagaggaggcatccctaggactgcgggcaagggagccgggcaagc

SEQ ID NO: 13851 - DNA, 234 bp, Homo sapiens
ttcttagggtccaagttgaaaggcagtggttcttttgtgaacaccactaactacattcgaaaagcctctccaattccacattccaagtctataacagctttggaaatgagtaacaatgacctctcatgtagtagattaaagcagaggcctttgccatatgattgttttttggcttaaatgtttgcttgccctgtaactgtaatactttggttaccagaatcacttgaaaacaaa

SEQ ID NO: 13852 - DNA, 52 bp, Homo sapiens
taaagaaaatatgatacatgtacactatggaatactatgcaccataaaaagg

SEQ ID NO: 13853 - DNA, 304 bp, Homo sapiens
tgtatttaaagtgatatttagggccgggtgcggtggctcatgcctgtaatcccagcactttgggaggccggggcaggcggatcacctgaggtcgggagttcgagatcagcctgggcaacacggtgaagccccgtctctactaaaagtgtaaaattggccgggcatggtggtgcatgcctgtggtcccagctgctcgggaggctgaggcgggagagttgcttgaacctgggaggcggaggatgcggtgagctggggtcgcgccattgcactccagcctgggcaacaagagtgaatctccgtctca

SEQ ID NO: 13854 - DNA, 486 bp, Homo sapiens
catcttctagcctgggcctgacttccattaaaacagggttttgtgcgttttttagattcctgttcgtttttatgctatttcatccactcagtaaattacctgagtaaagtgcatctccctgccaggcccccagtatagacactggggatgcggcaaggactaagcggtccctgctgtttggagatacttaagatggggctccactttttgagccccccgactcccttatttggtcttatactgcctgtgtgcaagtcaggctctgtggatatggcaccagtatgaaatgcagggtctcttggtttttccccttttctagcagacaggtcattacttagttcccaactcccactctaaagctctggttagcgggtgatgaaaatcagcacaagtgatcacatacagcaatcccaacctttagaccacttcctagctgcctctccaaaatatgtagtaaacggtcattcagaaactctccctcctggt

SEQ ID NO: 13855 - DNA, 354 bp, Homo sapiens
  misc_feature 57: n=a, g, c or t
atagccccccacccccgctgctgctggagawaagagaagggtgggtgggtgggagrngcgaacaaaaactcaagtagctagagagagaaagcaaaggcagcaggctcagctagctccgtgtgagtgagtgagtgaggtatagagagagagagagagagtgaggaagggaagccattgattgcagttgcacaggaaagaaagaaggaaggaacgagcgagagtggaaaagttggtggaggaggaggaggaggaggatggaggagagagcgggcgagccgtcggwggtggaggagcagggctgcgcasgaggccagccaaaagtagattcggcgccgtgggcccgccgtcctccag

SEQ ID NO: 13856 - DNA, 464 bp, Homo sapiens
gataccactgtgtgacaggaagcgagagtcaacgcagggagcctgcaccctgcaaacagccacagcccttcactgaacggggagcataaatcccaccctagttagaaccatggcttttgtgcggaccagaagtgccagagccacaatataggggtgagatgtcttaccgttttgcggtgttgagtgtgtggattcccttttaagatagaaagtaggaaaactgccagtaagggagacgactcactaaaagaggattcagtctctggttgacatgttttgctgagtgtagttggttacttcaggtacagtatcacattaataggggccacagtctatatccctgtttagtttgttagttaccactcaagagcagacagatattgtccactttatcccaaatcccagccagactttgttgtatgctgtgcttcattcatggggctgtgaactactgattatattct

SEQ ID NO: 13857 - DNA, 475 bp, Homo sapiens
gtttttcctaagtttggtacatagtaggcactcagatgcttaaaggaatgaatgaattgtgctttaattccactttactaaacccaaatctccctttggacattgttatctatgtgttttcaaagaagtataatcataatttgacagaaatccttgagaggcagaactaagtgagggattgggcagggttcagatgttaagaacagtaagctcagcagggtgtgattgctcatgcctataaccctagcactctaggaggctgaggtgggatgattgcttgaggccaggagtttgaaatcagcctgggcaacatagtgagaccccatcactaccaacaaaataaataaataaatgtacatggtggcatatgcccatagtcctagctacttgggaggctatagtgggaggatagcttgagtacagaagtctgaggctgcagtgagctatgattgtggcactgcatgctagcctgggc

SEQ ID NO: 13858 - DNA, 451 bp, Homo sapiens
ctattaatggcccatctgagtacttatcatacgcggtcaccctatctttggatcagaaggtacactcagagctcctagtgtcacatcccaggcccaacctgctgagagcagtcgaggaaggtctggaggatggatttgggaaaccagccggagcggagataaggagtctaccttgcaaagacacgtgtgaaagcagagagagcatcgcccagatgggctagattcttctcacaggctcactgctagaacgaacattcttgagactttagatctaagtcagcctgattcctgaaagccttggaccgtttccaaaatcaaatcaatactccaggaacaagatctgcctcgactttgtctccatccaaggacgctatggcaacgcagttttcaaacgtgctttgagaataaatggaacagggtcccctgtgtcctcaaaaaaaaaaaaaaaaaa

SEQ ID NO: 13859 - DNA, 667 bp, Homo sapiens
ggtcgccatcttgggtccgctgtcggcgctgccgggggcgaaacgtaagaccggagcggasacgggaggcggagatgcaaagcgcgacaacttctgttgcgtcacttccgcgcgagttcaagttagtttctgagattaaccttttcggtgacgcggggagccatattgaaacctggaaacgatgaggctgcacggctcaccgtcwggataatggcaaagatggcctgcaagtgcgtgactctcgttatggaaatctctgtcctggagaggtgcttacgaaaagcgccatcttactctaggcaggtgcctggagtgtcctacgaggacgaggaccatattgaatcgtgacggattttcttacaggagtcacttcctaactgtagtctcctggcagaaaagaggcaacctccagccggtagtcccagacgaggtacctgcagagaatgatgtatgatctggtcatagacaccgtggatttcaactctccagagtctaaacgctgaaaacacccaacttgatttagtgccttacactctttatctccgatttttcaggacgacacctgttaaaattttttgccacactttcggcgtgtattccgattatctttttggaaaatttgatcctgttaaatagactatacgtgggatcaacccaattcctgata

SEQ ID NO: 13860 - DNA, 353 bp, Homo sapiens
  misc_feature 93: n=a, g, c or t
tttaattcaaaatttccagatttgggctatttctgtatgatccaataacttattttgtcacagggcttaatttgccatttttkgggatttgtngactcattttgtctgaattttcacaactggtattatgtcactagctacctgataccagttgtgaaaattcagacaaaatgagtcgacaaaccccgtatctactaaaaatacaaaattagcccgggcctgaatcccagctacttaggaggctgaggcaggagaatcgctggaactcggaaggcggaggttgcagtgagccgagatagcgccattgcactccagcctgggcaaaaatagcaaaactccatctcaaaaaaaaa

SEQ ID NO: 13861 - DNA, 498 bp, Homo sapiens
caggggactgttctcaccttaactcagccagaaagatgccctagttgtgatcaaaggtaactcgaggtggagggtatccctggggcccctcgacatcaccgtcattgatggagcctgaaccgtgtgctcctcggcagatgctgttgttgttacttccctccaagaggctggaaaagggctcagagctgctgagcaggaaccggaggtgacccatttcaggaggtgccggtaccagcctgactaggtacaggcaagcttgtgtgggcccaacaggccttggtagagctggtgccagatgtgggctcagatcctgggcatgatgggccgagccacctcggatcccactgattggccagccgagcgagaaccaggctgctgcatggcactgaccgccgcttccagcttcctctgagccgcaggcctgctacgcgggcaagcgtgctgcctctcttctgtgtcgttttgttgccaaggcagaatgaaaagtccttaaccgtg

SEQ ID NO: 13862 - DNA, 506 bp, Homo sapiens
taaatgaatgaatgacagaaaaagaatattctgtttaatccctacattactaccagcattatttttctaaaattcagatctgtttgtgctgttccttgtttagaaatattgtgtgacctcacawtgcctttagaatctggtatgaactccttagatggtgggcagaccttccctccatctgttctcatgctcagcccccacatggtacagtagaaaagtggcttcagctttcatgtaccttggtcaaataggggcaatagacactacctcaaggattgttgaaaggattaaatgaggccgggcatagtagttcacgcctgtaatcccagctctttgggaggcagaggtgggcagatcacttgagctcaggagtttgagaccagcttggccaacatggtgaaaccgatgtcaactaaaaatacataaattacccgggtgtggtggcacgagcttgtaatcccagctactcgggaggctgcgacaggagaatcgctttgaacccagga

SEQ ID NO: 13863 - DNA, 480 bp, Homo sapiens
cttctgtctttgtcctgggtgcttctgctttacaatgaacatgcagtcgtttctgtcacttggggagatttgaatgggagtaatctaaatcaggtcagcaaactgtggttccgtatgccagatctagcccacagcttgtttttgtgtgacctgacttaaaaatgatttttatatttttaggccaggcacagtggctcatgcctgtaatcccggcattttaggagactttgggaggcagcggatcatttgagtccaggaatttgaaaccagcctgggcaacatggtgaaaccccactctactaaaaacacaaaaaattagccaggcatggtggcacacacctctaatcccagctacttgggaggctgaggcattagaatcacttgaacccaggaggcagaggttgcagtgagctgagatcacgacactgcactccagcctgggtggcagagcaagactgtctcaaaaaaaaaaaaaaaaag

SEQ ID NO: 13864 - DNA, 378 bp, Homo sapiens
gagtgtgactcccatggtccccgtggggtctgtgtggttggcaatgagctctgtgctgtcagctttskatgagggagctccctggctggttcctgttctttggggtcttcctccccgtgactttgctgctgctcctcctcatcgcctacttcaggatcaaactgattgaggttaatgaagaactgtcccagaactgtgatcgccaacataatcccaaggatggctcttccctgtaccagagaatgaaatgacgtgaagttggggactttccaataactaaagcacaatgagtttctactggtcatcaagcaatggccaacagttcagctaataaagtaggttgataaactagaaccatagcaaaaaaaaaaaaaaaaa

SEQ ID NO: 13865 - DNA, 516 bp, Homo sapiens
atattcaaaaacaatagaagatggaatcctttgtaagggtaaacatttgacctattataaaacgtgactaagatgagggagagaggaaatacattaagagagtttcgatctttcaaaatgccatacagttttctgcttttctctctgatattaggtatgaggttaatttccaaaatggaatagaatgtggtggtgcctatgtgaaactgctttctaaaacaccagaactcaacctggtatgtaattcccatttctggaatgtggctggacacccactattaccttgtaagaattttgtaattgggccgggtgcggtggctcacgcctgtaatcctagctcccagcactttgggaagccaaggcaggcggatcacgaggtcaggagattgagactatctggctaacatggtgaaacccatctctactaaaaatacaaaaaattagccaggcgtggtggcaggcgcctgtagtcccagccacttgggaggctgaggcaggagaatggcatgaaacctg

SEQ ID NO: 13866 - DNA, 491 bp, Homo sapiens
gaaaataagtattaaaagatatggtttccacttccagtagttttcaatgctctttgctgtttcaggggtataaactaaataagtaaagcaagatggaaaaaaattagcaaatgacaactttaaataataagcttttaactagaaaattgataaaccaagagtaaatatttaaggattataaatatgcatactaaacaccctttcatgagatcagatggtgggtttcaattttacataaaaattatggtaactggaaaccgggcggattaagtagtgtagatgaacagacaagatattgcatatgtgtagaggaaagataaatatttgtattaggtgccattcaaatatggtagtcttttcactacatagaactatgccttgaaagcaatagatactacactgtataacttaattattaacttaagctctgattaagcaaactcagtaaaactttcaattgtccctcagacttgaaatgtattactgcatca

SEQ ID NO: 13867 - DNA, 479 bp, Homo sapiens
aatgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaraacctcagcatgattagtgttggagca

SEQ ID NO: 13868 - DNA, 468 bp, Homo sapiens
attctccatcccacgtcctccagtgccggggtcacggtcgcagcacccggcgttcccgttggctcttttgccgctgcgcgagccggcggtttttctgtcacagcacttgtacggagtttctcggcggccgaacgtctctttttttctcagagacgacggtttcttggtgacagtaccgttggttgcgccgtaacgaatgttctcctttacagccccaccagctggcgtcactcgcaggctccagacgccgccatttcgccgagccgaggtctcttggttgcggcactgcttctggctcggtgcctgtattttctcggtgcctacagcgcccaggtcaccgatctgagggcttcggagtaccggccgggcgcggtggctcacgcctgtaatcccagcacttttgggagggccgaggcgggcgggatcaggaggtcaggagatcgagaccatcctggctaacacggtgaa

SEQ ID NO: 13869 - DNA, 382 bp, Homo sapiens
tgctcggcattgagggtagaaagacttttcgaaggtggcagggtgtttcttaagatcattgaaccttaaaatgaaagtgtaggccgggcgcggtggctcacgtctgtaatcctagcactttgggaggccgaggcgggcggatcacgaggtcaggagatcgagaccatcctggctaacacggtgaaaccccgtctctcctaaaaaatacaaaaaattagccgggtgtggtggcgggcgcctgtagtcccagctactcgggaggctgaggcgggagaatggcgtgaacccaggaggcagagcttgcagtgagccgagatcgcgccactgcacttcagcctgggtgacagcgagaatccgtctcaaaaaaaaaaaaaaagggaaa

SEQ ID NO: 13870 - DNA, 268 bp, Homo sapiens
attattattattactccaatatcttaccaccctaacgcagggaagttcttcctgttatatcacacaaatcttcctcagtgcaacataagcttcaatttcctctatgactacattattgacttgacctactcacttggatccctgcctcctgcactgactgattgactgattaatcaggagagaggtcagaagagctaaaatttggaaacaacctaagtgtccatcaacagatgaatgaataaagaaaatgtgatacttaaaaaaaaaa

SEQ ID NO: 13871 - DNA, 534 bp, Homo sapiens
ctcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaataagccacgacatgaaaatgacaatccctttcgtctccttcctccgctgcttccacctaacgcagcctcctgcctccgcctttgtttcatagtgaggattttattttgcacggsgccctccctctaaatacctaccctagatgatttcatcctgccctcacttcttaacatattc

SEQ ID NO: 13872 - DNA, 278 bp, Homo sapiens
ataagtgtactctgttgatctaggcaacagggcatggaggagagtatggaaacaagaatttcattatcacttggtcaagaccaaccattacagataagaatcttggtatgagtcatttccactgtccccccaacccatctgtgtttaaaaaatggagactgctattgaagatcttggtgatgttatctttcagcatatctgctctttgaattgcagtgttccagtcaagactggttaccctctgcttctgtacagctgttgttttgaaatataatgat

SEQ ID NO: 13873 - DNA, 386 bp, Homo sapiens
taagtgaataatataggtgcacagaaataggactgaaaagctgaaggtaaggaaggaaagagataagaataacaaatgggccaggcgtggtggtggctcacgcctgtaatctcaacactttgggaggctgaggtgagaggatcacttcagcccagaagttcaagaccagcctgggcaacaaggcagaaccctgtctctacaaaagataccgaaaaagcacaattagccaggtgtggtggcacacgccttcgtcccagctacttgggaagctgagatgggaggattgcttgagcccaggaggcccactttgctgtgagccaagatcatgccactgcactccagcctgggcaacagagcaataccctgtctcaaaaaaaaaaaaaaaa

SEQ ID NO: 13874 - DNA, 379 bp, Homo sapiens
attaattatatcacaaatttataagaggctggaaatgcaagatttacatctgagtttttcacctttaattaaaaatattstctgggtcgggtgcggtggctcacgcctgtaatcccagcactttgggaggccgaggcgggtggatcacgaggtcaggagatcgagaccatcctggtgaacatggtgaaacccgtctctattaaaaatacaaaaggaattagccgggcatggtggcgggtacttgtagtcccagctgctcgggaggctgaagcaggacaatggcgtgaacccgggaggtggagcttggagtgagccgagatcccgccactgcactccagccagggcgacagagcgagactctgtctcaaaaaaaaaaaaa

SEQ ID NO: 13875 - DNA, 502 bp, Homo sapiens
  misc_feature 498: n=a, g, c or t
cagtgtccttcatgtctcagctcctgtcttccaataattttctgaaaaaggtaatgtgttctttaaatgtgtttataaaaaggtattctgctgtctccaaggaactgttctcaaccagtagaagtagcttggtaaatggctcatgaaaatgggaggcacgcctttaaagataatagaacaagaaagtacgtttcaccatgaaaagccgttcgtcatgatctactgagatggaacataatgtaaactctgtgactcagtggtttcattcttaagtgttgtgtacccatcagaagtttatgaacctgtacaccaaaaaaactacaagaatctttataatattcataacattcttcatggtagcacaaaactggtaacaactccagtgtctaccagcagagtagataaattgcctgtattttattttattttttgagacaggtctcactccatgtcccaggctgaagtgcagtagagcaatcatggctcactgcaacctgnaact

SEQ ID NO: 13876 - DNA, 239 bp, Homo sapiens
  misc_feature 136: n=a, g, c or t
aatggccgggcacgtggctcacacctgtaatcccagcactttgggaggccgaggcaggcagatcgcctgtcaggagttcaaggccagactggcaacatggtgaaactcatctctactaaaaatacaaaaattagtngggcatggtggcagagacctgtaatctcagctgctcgggakgctgmggcaggagaatggcttgagcccaggagctggaggttgcaggtctctgccaccatgcc

SEQ ID NO: 13877 - DNA, 75 bp, Homo sapiens
cttcctctcctgggccgtcctctgagcagcagacggggctaagcgttccccagctcgccttcacacacagcccgt

SEQ ID NO: 13878 - DNA, 248 bp, Homo sapiens
aaaacaaccgactcctttccaggtgaagggtgacttgggtacgttggggctttgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagaatcactttatgtgaaaggagacctttttgcatgcccgaaaacagact

SEQ ID NO: 13879 - DNA, 480 bp, Homo sapiens
gaaaaataggatcctgccatcccaaagacagctttcgtctaagagccatatgtgagagagtatttaagccagccctgatacgaaacggagctctaaatagaacaaatgctcaaattcagaatgttctatttaaagtaaaatgctgttaattggcaagtgtgacgcttcctgccaccccataggctgtgggctcatgggaaagatccaagcagtttggagaatacctacctgaccagcactaacctaaggagtttgtataaatctaaattacaatgtagcaatttatagtcaggaatattttgattaggcaattcagaatccttgtaccagcctgttaatgccttcttccatctgcagcaaagccaacaagcagagcaaatgtataagagaatggtgcttggtgagtgtggaattggagcattgcagracaccacacattctcactttggagcccttttccaatactctgcatgcacgact

SEQ ID NO: 13880 - DNA, 481 bp, Homo sapiens
caaatcattaaatcattgaaatatttctaagcacccagctacttgacatcattcagatagaatgtgttcatgaaagaacttgctccatttattcagaaatcgttattgtataaacctagattttgtccattcattcagtgttgaatatgcccaaaggtgtcactgatctagaagtggagtaagttgaatctgctagaatgcttagagatgtttgtttccttttatggtcagctaaagaagatatttctaaatatttattagctgtgcaggtaggttataaactaggttttcagcagttttttaacttttatctgaaataattatagattcataggaagttgcaactgtagtacagagaagtcccttgtacccttcaccagtttcctccatggttacatcttacataatatgctataatgtgaaaaccaggaacatgacattggtacaatatgtgtatatagttctatatcattatatcaca

SEQ ID NO: 13881 - DNA, 433 bp, Homo sapiens
aatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtg

SEQ ID NO: 13882 - DNA, 242 bp, Homo sapiens
gtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgct

SEQ ID NO: 13883 - DNA, 387 bp, Homo sapiens
taagtgaataatataggtgcacagaaataggactgaaaagctgaaggtaaggaaggaaagagataagaataacaaatgggccaggcgtggtggtggctcacgcctgtaatctcaacactttgggaggctgaggtgagaggatcacttcagcccagaagttcaagaccagcctgggcaacaaggcagaaccctgtctctacaaaagataccgaaaaagcacaattagccaggtgtggtggcacacgccttcgtcccagctacttgggaagctgagatgggaggattgcttgagcccaggaggcccactttgctgtgagccaagatcatgccactgcactccagcctgggcaacagagcaataccctgtctcaaaaaaaaaaaaaaaaa

SEQ ID NO: 13884 - DNA, 85 bp, Homo sapiens
agcgaggaggaggaggaggcggggyyakgwarrgmtatggttgcttggagagtgcatccggcccggtacttgtgatcggaggaga

SEQ ID NO: 13885 - DNA, 403 bp, Homo sapiens
catggttaaatcagcagatggagtaatcgtttcaggagtaaaggatgtagatgatttctttgagcacgaacgaacatttcttttggaatatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaat

SEQ ID NO: 13886 - DNA, 343 bp, Homo sapiens
agtctatgatgttctgtgacagcagcctgagctgactgaggcagaggggaagtactgttttaccagctccagacacaggcccaagagcattgtggatttctgcttgctctcttggctcctcttctccttctccaagagaacaagcccaagctagtctgctgtaggatgggaggccacatggaggagctgatcctgacatcccagctgatgcctcatacgtttgagtgagccccaatgacaacagctgaggttggcccagactggaagaactgccctctgagcccatttaaattactgccagcagaattgtgacctgaatgtatgctgtcttaagccactaatt

SEQ ID NO: 13887 - DNA, 211 bp, Homo sapiens
cataggatgggcctagatgaggggtccaggctgttacgtcagtaattgcatcaagggcctgagttcaaagttaaaggaaattcaaagtcaaagttcaaatttcaaaggaaattgatggaatctcaacagagatcctgagctctggatcaaagccccaggagcactggtggttaaaaaaaaaaaaaaaaktcaasagrggcccaggtttaag

SEQ ID NO: 13888 - DNA, 513 bp, Homo sapiens
attgagcacctactacatgccagacaccctactgggtcacagggagacagcaggaagtggaagaaacaaaaatccctgtccagctggagcatttgttctcaggaaggagacagatgacaagatgcataaggaaaagatgtgatattaggtagtgacaagccctaagggaaggggggttggtatcagggtggtggcctcaaagttcattaagtcactgcctagtagccaggcacggtggctcatgcctgtaatctcagtactttgggaggccaaggtgggtgggccacctcaggtcaggagttcgagaccagcctgggcaacatagtaaaaccccatctttactaaaaatacaaaaattagccgggcatggtggcatgcacctgtaatcccagctactcgggaggctgaggcatgagaatcactccctggtggccccatcccccagttcctcacgatatggtttttacttctgtggatttaataaaaacttcaccagttaaaaaaaaaaaaaaa

SEQ ID NO: 13889 - DNA, 447 bp, Homo sapiens
attggtgtatggctttgcagcaataactgatggctgtttcccctsctgctttatctttcagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaac

SEQ ID NO: 13890 - DNA, 488 bp, Homo sapiens
ttaagacaaggatggtgaaaggaagccctttaaacagttaagtgtagaaaaattcctgtttctttaagaaagttccagcatttcatcacagcagattataatcctctttttaaaaaacactaatgttcagacctactagttagtggcataatagaacatttagccgtcacctggctaaacatttttttatttaaactttttttttaaatttctgtgcatatgtagtagatgtctgtatttatgaggtgcatgagatgttttgatacaggcatgcaacgtgaaataagcacatcttggagaatggggtatccatcccctcaagcatttgtccttggagttacaaacaatccagttacactcttttaaagttatttttcaatatacaattaagttattattggctgtagtccccctgttgtgctatcaaatagcaggtcttcattctttctattttgtttgtacccaagccgtcacttggtattgatgtg

SEQ ID NO: 13891 - DNA, 574 bp, Homo sapiens
atagtaggaccactcgtttctaacatgagagaatgtgcctggctgctttggacaccatcttgcttggacatgcacatgtgagcagaggttacctaaattccgttgctggtttcaatatggactcctctctagcacttttctatttaagtaactgaaatttaatgacctagaggaaacagaggcagttgaattaaaagatttgtaactatgcacagtcaattatgacctctgctgttagctatggctcactaaaggctgattattttcatttatatgttctgcaaacactttaacttcagagtaattaaaacctaaacttcaaatttttccggaaaaccaggactctttccaactgtcccattttttaaaactaatggtggcaaaattaaaccacctgtccaaagctaaaagacagttataacttatcaagccctacaaatatgtgttaatgccagccatttttttccataagttaccagcattctccagaatttcatcagcaagaatggagtgagaagtttataagtggtttttctcactaatctttatcactcccatacattttatctgcaat

SEQ ID NO: 13892 - DNA, 487 bp, Homo sapiens
cttctgtgtaaatggtactagagaaaacacctatattatgagtcaatctagttagttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtatt

SEQ ID NO: 13893 - DNA, 503 bp, Homo sapiens
aaaagagactgtcaggtcaccaaacagctaattaaagcaataaagagtcaggaaggctaaatggcccctttcttcctcaggagcctaaggtcccttgtaggaacctgcatggttcttcttccctggaagtgcagtccaagatggagaggatattggggaatgtcccagcaagccctcggatcagaaaaaggatgaagagggcctgctgatgctgaaccaaagagccgcactgcaagataatgaatcataacagcagagagaggaggaagtgactccaatcagcaccctccatccggaaggcattccaccttgaattatggcctggtgtaagaaggggaaggaatcagtattcccatttgacggatgtgaacattgagaaaaacagagtgaatttcggcaagtgtaactggggtggcattgaatcatcaaggtccagtcctttagctgggctccagggagaaggtgaaaaattcacccagagacctcttggagatagtaataca

SEQ ID NO: 13894 - DNA, 100 bp, Homo sapiens
atttttgaggattcctgtattctgtatcctctcctcgcatctcctcacatggaaagaaataatgtatttgtgccttctgtgaggaatggggggaacaagt

SEQ ID NO: 13895 - DNA, 138 bp, Homo sapiens
acctgtcattcgttcgtcctcagtgcagggcaacaggactttaggttcaagatggtgactgcagccatgcystacagtgctgcccagtgcttgcccggggccccacaagcctcctaggcaaggtggttaagactcacc

SEQ ID NO: 13896 - DNA, 388 bp, Homo sapiens
  misc_feature 11,28,30,33,45,47,179: n=a, g, c or t
atcggtgtgtngcarggtcatgaaaaancndmnhmhgcrggaganangargawgcggcggcggggcagtgaaactacggtagctgccccctragctggtggtgtggctttrtrgggagggcgtagttcctaatcccctttccggrcagccgccggggctcggggctgtragcrgccgtnagstgcctccccgggccccctgcctccgccatgttccgcaggcacgccttagcgtgaagccgaatgtcatgcctggtgtaggcrccaggggctccacagcttccaatccccagcgtggacgggagtctcccaggccgccggagcctgccacggactctgcttccaarcccgcggasccacagatgtrcccacagtcgatttcggtggag

SEQ ID NO: 13897 - DNA, 543 bp, Homo sapiens
tttttttttctctctcgctcgctctccttctgcgtctcttctctccctcctgccctcactgtctgggcctccttctctcttgctcccgtttctctttctctcctcctctcaatatatactgacccttttataaacccaccctcaccgcacccagctgaggtcggctgccagtgggagggcccaggcactccggttcctctttctttgggcccccacccaatccctccagacagacatcatctggggctccctcccagggttgagatgagaaactcttggaatggggttcttggggggggcaagcgtcaggggtgggagggcccgattctcaggacccttgagttttgaggtcttgccctggggccggatgtctgctttccctgatggagcttggagctggataggagtctgggaaaagaggccagatttctgtggcatggacttgagattgggctggtgaagttggccccgtggtggggggtcagaggatgggagatgaaatttgtgaaactcggcagggcgttgtggctcasgcctgtaatc

SEQ ID NO: 13898 - DNA, 521 bp, Homo sapiens
atacattttacttttcctgcatggactgttttcttcacgttgagttgtattttaagtgtttcatggtaaactttcccgagatgtttgctaatgttaatctgcttaatagtttttttttaaattgaggtgtatgtacatacaataaaatgtgtatatcttggctgggcatggtggctcacgcctgtgatcccagaacttcgggaggctgagacaggtggattatggattcttaatttactacagtttagtttatgttagttggttttattacttcccaggaaatgcaagaactgtacatttagctctttacctccttcttgtcctttgccctattgatggtatattttcttataaacctctaaagcaacagtattattgttttacatagttgctgaggtctggccagtcgtggtggttcacgcctgtaatcccagcactttgggagatgaaggcgagtggatcacctaaggtcaggagttcgagaccagcctggccaacatggtgaaacccgtctctactaa

SEQ ID NO: 13899 - DNA, 133 bp, Homo sapiens
  misc_feature 26: n=a, g, c or t
gtagtggtggtacgggtccgactgangggtactcgccaccggctgcgtccacccgadcrgctgcgagadccaaggcccgarggggtrrgcgtrrcggccgccgaaacacaaccccctctgttccctctcttcr

SEQ ID NO: 13900 - DNA, 127 bp, Homo sapiens
actgtggctaagtgtggggaccagacaggactcgtggagacatccaggtgctgaagccttcagctactgtctctacccactctttgctacaataaatgctgaatgaatccgaaaaaaaaaaaaaaaa

SEQ ID NO: 13901 - DNA, 103 bp, Homo sapiens
gatggcgtagtttcctggggacccagctgggtggraaaagtggctaggagttagcttgggagccgctggtgttctgagcrmwcccctctctggccactttttc

SEQ ID NO: 13902 - DNA, 131 bp, Homo sapiens
cwttttttttttttgtccgacatcttgacgaggctgcggtgtctgctgctattctccgagcttcgcaatgccgcctaaggacgacaagaagaagaaggacgctggaaagtcggacaaaaaaaaaaaaaaaa

SEQ ID NO: 13903 - DNA, 176 bp, Homo sapiens
ccattacgccccatctcgctctgtgcccctccccaccagggcttcagcaggagccctggactcatcatcaataaacactgttacagcaaaaaaaaaaaaaaaaaaaaaaaaaaaaaaaaaaaaaaaaaaaaaaaaaaaaaaaaaaaaaaaaaaaaaaaaaaaaaaaaaaawtaaar

SEQ ID NO: 13904 - DNA, 74 bp, Homo sapiens
atagccctggtacatggtacacacccccccacctcctgcaattaaacagtagcatcgcaaaaaaaaaaaaaaaa

SEQ ID NO: 13905 - DNA, 259 bp, Homo sapiens
agacgaacggaagawrgmagmrgcggcggcggcggagtgtaggaagaggcactgctgarggggcgcgargggaacggaggccagagctgcgaggttagctgggcatggtggcatgtgcccgtaatcccagttgcttgggaggctgaggcgggagaatcacttgggcctgggaggcggargttgcagtgarctgggatcgcaccaccacactccaacctgggtgacagagcaagacttcatctcaaaaaaaaaaaaaaaa

SEQ ID NO: 13906 - DNA, 159 bp, Homo sapiens
tacaaaaattagcttggtgtggtggtgcattgcctgtagtcccagctacttgggaggctgaggcaggaggcggaggaggttgcagtgagtcaagatcatgccactgcactccagcctgggcaacagagtaagaccctgtctcaaaaaaaaaaaaaaaaa

SEQ ID NO: 13907 - DNA, 276 bp, Homo sapiens
ttctcagcaaactattgcaaggacaaaaaaccaaacaccgtatgttctcactcataggtgggaactgaacaatgagaacacatggacacaggaaggggaacatcacacattggggcctgttgtggtgaagrgggagtggggagggatagcattaggagatatacttaatgttaaatgacgagttgatgggctcagcacaccaacatggcacatgtatacatatgtaactaacctgcacattgtaccctaaaatttaaagtaaaaaaaaaaaaaaaa

SEQ ID NO: 13908 - DNA, 181 bp, Homo sapiens
actaaaaatacaaacattagctgggtgtggtggcacgcgcccgcagtcccagctactcgggaggctgaggcaggagaatcacttgaacccaggaggcagaggttgcagtgagcggagactgcgccgctgcactccagcctgggtgacacagtgagacttcatctcgaaaaaaaaaaaaaaa

SEQ ID NO: 13909 - DNA, 69 bp, Homo sapiens
actaaaaatacaaacattagctgggtgtggtggcacgcgcccgcagtcccagctactcgggaggctgag

SEQ ID NO: 13910 - DNA, 186 bp, Homo sapiens
aactcgccgcagcctgcgcgccttctccagtccgcggtgccatggcccccgcccgtctgttcgcgctgctgctgctcttcgtaggcggagtcgccgagtsgatccgagagactgaggtcatcgacccccaggacctcctagaaggccgatacttctccggagccctaccagacgatgaggatgtag

SEQ ID NO: 13911 - DNA, 600 bp, Homo sapiens
cagatagagaaaacacccattatagagctgtggagcccttacgatatagtgctatgctgcaacaaattagacagaagagtatttgttgaataataaaagttttccaataataacatagaaaaaaggaagaatttgagagtttctcagattaggcaattccttgaagaatctgagaacacagaagctcccctccctactttccatgattgaaatcagtgattcattggtttctttgtgtgggcttttgaaagatcattagaaaccaacctgaagatcatgagattcttgtggacacaggagcaatgagtggcaatacagtgctttctaatccaacctactttaaaagttgctggaaggcagttcaagtaactgccttagtatcaattgttattatttcgaattggttatgaagttgaataagtttggagtatccttaaccatactttttctaatccaacctggagatgttccatgaaggaaattctggaaattatggttctgacttctttgcaatgtagaggacaccacggaaggggatgacaaggactttgagtgatatttcccaaaacatgttctccaagctgttaatattctatgtaa

SEQ ID NO: 13912 - DNA, 183 bp, Homo sapiens
actaaaaatacaaacattagctgggtgtggtggcacgcgcccgcagtcccagctactcgggaggctgaggcaggagaatcacttgaacccaggaggcagaggttgcagtgagcggagactgcgccgctgcactccagcctgggtgacacagtgagacttcatctcgaaaaaaaaaaaaaaaaa

SEQ ID NO: 13913 - DNA, 473 bp, Homo sapiens
acagcaagtctggctagagtttctcaagggtgtgcccatggggattagtggaaagagctctgtgcttgggttgggtggtttgcccactccaccttttattctccttgggtaagtggcttgggacctcatttgccctttccaatgggatagcaacatgtttmtttttggaagctacwgtgaaagatgatgatctgggagggacttgggacacaggcttatttgttacacagatgctaccggccttgcatctctcttgtgagctcagaagttgcttgacatcactgcctttttcatcaggtggttcataggaagaggccaaaagagagagaaggatgctgtatttatgggaaaaggctaccagaatttccatccgaggttggtggtccattcctctacctatgtggaaggcaggttctccttgacaatagccaggtctgcatgtgtcttccactcaatctacaacgtacccacgg

SEQ ID NO: 13914 - DNA, 254 bp, Homo sapiens
agagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccct

SEQ ID NO: 13915 - DNA, 75 bp, Homo sapiens
atagccctggtacatggtacacacccccccacctcctgcaattaaacagtagcatcgcaaaaaaaaaaaaaaaaa

SEQ ID NO: 13916 - DNA, 181 bp, Homo sapiens
actaaaaatacaaacattagctgggtgtggtggcacgcgcccgcagtcccagctactcgggaggctgaggcaggagaatcacttgaacccaggaggcagaggttgcagtgagcggagactgcgccgctgcactccagcstgggtgacacagtgagacttcatctcgaaaaaaaaaaaaaaa

SEQ ID NO: 13917 - DNA, 67 bp, Homo sapiens; identical to SEQ ID NO: 11909

SEQ ID NO: 13918 - DNA, 108 bp, Homo sapiens
tacaaaaattagcttggtgtggtggtgcattgcctgtagtcccagctacttgggaggctgaggcaggaggcggaggaggttgcagtgagtcaagatcatgccactgca

SEQ ID NO: 13919 - DNA, 437 bp, Homo sapiens
caaaattgcatatttaacagtgtctctcccctgctaagctctctgagaagagaatcttttttaagttttgttttgcattgacacataatatttgtgcatatttatggggtacaataatgatgtgagtcttcacattaaccttgtagctgtgcctgacttatagtaaatgctcagatwtttttttagggggaatgagcaaagtttttttaaaaatcagtaaaacataaatatacttgttgggcaaaaggaaaaatgttatatgtattttttckgggcatgcttatttctgatttatcaatatttaacaaatttcagccaggcacagtggctcatgcctgtaatcccagcattttgggaggccaaggtgggaggattgcttgagcctaggagtttgagaccagcctggggaacatgtgaaaccctgactgtacaaaaaa

SEQ ID NO: 13920 - DNA, 64 bp, Homo sapiens
ctggtgggttcaggcttctctgggtcactgcatcaaggcactgtaccttgagagtgccaaggac

SEQ ID NO: 13921 - DNA, 463 bp, Homo sapiens
tccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggracaaatagatgctaaacatggcacttaaatatttatttaaaaacttaaattattattggcaagcaaatcttagtatctttcttccagtaatatggcctggctgagggtcagaccacaggacaggagcgacctccggscttgactgtctgggaagcttgatggattataaaacttcctcmtgsctggccaagcagcagcatcatttccaggacccaacaaaggcaacatcaaaatctgttttgstttgtcagtctgggcttccagaatgttgaatttgcctcaa

SEQ ID NO: 13922 - DNA, 691 bp, Homo sapiens
aacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtgaaaaaaaaaaaaaa

SEQ ID NO: 13923 - DNA, 381 bp, Homo sapiens
tacttgctagagtttgcagcggtcaataataaagtattaactaacctgagagaattgagaatatgyaactaacctaagaacagcaaggtattttacatwcagttttgcattcatgtagtattttgaacttgtttaacaaacaaaatttgtgctaaccatgatagcttctattaaaavaaaaaarttctaacctacsctaaaagctagggctgtatttagaaggcattacttttttmatcctcctctcttgccttaaagagggctctgggccgggtgcagtggctcacgcctgtaatcccagcactttgggaggctgaggcgggcggatcacagggtcaggagatcaagaccatcctggctaacatggtgaaacccatctct

SEQ ID NO: 13924 - DNA, 450 bp, Homo sapiens
  misc_feature 34: n=a, g, c or t
actcctaattcttgtttctgccttttattttbvnaracagggtctcgctgtgtcacctaggctggagcacagtggtgtgaccttggctcactgcagcctctgtctctccagttcaagcatctgctagcctcagcctcctgggtagctgggactacaagtgtgtaccaccacgcctggactaattttttaaatttgttttagagacaagatcacgctgctgggcgcggtggttcatgcctgtaatcccagctctttgggaggctgaggtgacggatcgcttgagcacaggagttgggaggccgaggtgatggattgcttgagtgtaggaattcgagaccaggctgggcaacatgacgaaaccctgtctctacaaaaaatacaaaaaytagccaggtgtgatgctgagcacctttggtcccagctgctcaggaggatcgcttgagccaggtg

SEQ ID NO: 13925 - DNA, 356 bp, Homo sapiens
caacattggtttcccaatatttaatataaatataccatataatatattgtttgtgaattattgagaaatgtaacattcaaatttctaaaattgtctgccaaaggcttattcattctggttttgtttgctgttgggtgtttggggcagagttaaccatttctccatggtgtctttawactttactggtttgtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcag

SEQ ID NO: 13926 - DNA, 447 bp, Homo sapiens
tagacattttcatgatgtgcctacttctaacatttccttgtagacgttgtttgaggtttctttgctgtattagttattaatgttttaagtacataggtgaggctctttaggggatatcaaaaatgtaagattaggtcatcctctttaaacccgcccacttaagtatgaatttttgaaaacctcagatcatctgtgcatgaattttagatactcagtgggaacaactagaaaaagggaatggatagagaagaataaatcacatagcagcaggaatagaagattttgctaatttttcagcatatttggaatataaactgaggtgtgatgtggcataaagttaccatgcatagatctggacacaaaaagtgtacagcaagtaaacttgacgagtgtgacatgaaaagttgtatttgatctcatagattaacagtacgttttaatagagta

SEQ ID NO: 13927 - DNA, 477 bp, Homo sapiens
actcctaattcttgtttctgccttttatttttgagacagggtctcgctgtgtcacctaggctggagcacagtggtgtgaccttggctcactgcagcctctgtctctccagttcaagcatctgctagcctcagcctcctgggtagctgggactacaagtgtgtaccaccacgcctggctaattttttaaatttgttttagagacaagatcacgctgctgggcgcggtggttcatgcctgtaatcccagctctttgggaggctgaggtgacggatcgcttgagcacaggagttgggaggccgaggtgatggattgcttgagtgtaggaattcgagaccaggctgggcaacatgacgaaaccctgtctctacaaaaaatacaaaaattagccaggtgtgatgctgagcacctttggtcccagctgctcaggaggatcgcttgagcccaggtgttcgaggctgcagtgatctgtgatggtg

SEQ ID NO: 13928 - DNA, 109 bp, Homo sapiens
ccattacgccccatctcgctctgtgcccctccccaccagggcttcagcaggagccctggactcatcatcaataaacactgttacagcaaaaaaaaaaaaaaaaaaaaaa

SEQ ID NO: 13929 - DNA, 388 bp, Homo sapiens
  misc_feature 19: n=a, g, c or t
ctccgcgctckctctccknctctcctgcgccaactgggcgaccgcgacgccaacgccgacgacctacgccaggtgctgggatttttgtcggttccttcggcagctttcgtcgcgtccttcgccggcgacgagcactcaccaggtccgctcctgaagaagactgggatattttrgcatacacagaggatcatctgtgtagaggacattcagttttctccagttctccagttcctggatagcaatggcaaatgagtttcctgatgaagttcttaagtctgtttttccattgctggatggtaaagatctagtattctgcatgcttgtatgccgtcaatggcatgaaatcgcaaaggatgattacttctggaaatgcatttgctcacggaag

SEQ ID NO: 13930 - DNA, 221 bp, Homo sapiens
tttacctgacaaggaaggaagagctgctccacgtgcagagcaaggtttcagaatgagaggagaagagcaggcactsagagggtgagggaaagggcagcagtggactgggaagccctcaggtggaggtcagcattgcttccctcagatcatgggtgaatttgaggaactcagttaatatctttgtatgttcctccctccataaggtgagaacaagcacatgc

SEQ ID NO: 13931 - DNA, 463 bp, Homo sapiens
gagggactggccgtmrcatgtgaagctttattgccaatcttcattgaactcacacttcaaaagtcatggttttctctttgttttattgtaattttctgttttattataaagaagattgcagaaaagaggcagaataggagagctgaaagacaaaaaaagagtatctaaacaacagaggacacatactggaatctctggagctcatcccttcagagggcccttcccagaagaactgtatctccacttcctcggttctctggaataaattacaaccttatgactcatgagtccaaacaggacagtctttacgtctacccatcttatgactgatgtggctctcaaggaacaataaaacctaagcaaattatgggaacaagcatttatcaaccacgcaaatgaagccattctttgtatgtattatgcatctcaatctcccatatatggttatcaacgtaataattca

SEQ ID NO: 13932 - DNA, 457 bp, Homo sapiens
ttgcagaatctgaggaagattttttgacttcatgagatagcatcacaggagtaagtgatgcagcagtttaggcccagatcataggtcaagacttcaataaacatttgtatagggattgtcgtcccttcatctggtacagaatttttaataacagcctcatagccctgtgacagaataagcctaattctaggataagcagtaggtatatcatctggagagaggagagaagcaagtgcattcttcaacctttgtacccagtctggtggcatttttctttagtctcaaaatgaagatctgatcttgtgggattttggcagcttagactgattagcccacaagtagtccccatgtggatacaggtacattttagcactgaaggtatctatctcccacagcagccactccccacttccagtagacaactatgaagacctaattcataggaatatgacctcac

SEQ ID NO: 13933 - DNA, 127 bp, Homo sapiens
ttggcttggctgctccttgttcacaccttggtaaatgacccttcacaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13934 - DNA, 154 bp, Homo sapiens
agtctactggtcacattctgtcaggttgggcttcaagatggacctccttggaatgcttgcaagaaactagtttttttttctcttgaacagctaaacctttcaggttgacacagctgaaggagtgtgagttaggagagtcgttataagcttgagc

SEQ ID NO: 13935 - DNA, 173 bp, Homo sapiens
agataagttctggaactctctcactgcagactggaggctgaccctccctctctttggagaggatctctttcctgccattcatattggagagtgataccacctaccaacttctgcctggaataaatatgttccatcattttattttattttattttttaatttaatttaattta

SEQ ID NO: 13936 - DNA, 261 bp, Homo sapiens
gggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaatcgcgcacttgcgstacccccccccacccccttttttaaacaagtgttacttgtgccgggaaaattttgctgtctttgtaattttaaaactttaaaataaattgg

SEQ ID NO: 13937 - DNA, 57 bp, Homo sapiens; identical to SEQ ID NO: 11970

SEQ ID NO: 13938 - DNA, 340 bp, Homo sapiens
attcagtgtgtggttccaactgtaactggcagatgctttaatacaatctggattttatttttctgtgagaaggttttctgtatagcttgtggtgctaacgatgaaacagagaggtatgtgttctgtggcttcattttaagtgtcacattgtcaatgcttcaggttaaagtaagcttgcaaagggaataatttgaagcataattcatcagatcttttctatttaacttttcacatttattttttcatattcagttttaggaagtatgttgtatggattacatttccttccatcttagggaagaagttaaataaatctcaagctcaaaaaaaaaaaaaaaaa

SEQ ID NO: 13939 - DNA, 451 bp, Homo sapiens
  misc_feature 386: n=a, g, c or t
ttaaggtggggtcccagacacctagaataaataagcttagaatatccaagaagtgccaggggcggtagttcacgcctgtagtcccagcactttgggaggccgaggcaggcggatcacctgaagtcaggaggagaccagcctggccaacatggagaaagcccgtctctactaaaaatacaaaaaatagactggcgtggtggcgcatgctgtaatcccagctacccgggaggctgaggcaggagaatcgcttgacccgggaaggggaggttgcagtgagccgagatcgtgcctttgcaccccagcctgggcaataaaagtgagactgtcccaaaaacaaaacaaacaggctgggcatggtggctcacgcctgtaatcccagtagtttnggaggccgaggcaggcggattacctgaggtcaggagttcaagaccagcctggccaacatggtgaa

SEQ ID NO: 13940 - DNA, 413 bp, Homo sapiens
cccgtgtccggttcttcctcccaaaatctgcccgagcttctttgcccagcagatccccggcagttgcatccccaagcgcccctccccagtcgacggttctcacccaattccgccgccccatcgacgggttcgcaccaaatcagccgcccccgcagcggtgcgggagmggcgccgtttggaagctttcccgctgaaatctcccgacagtgtctcgtcattttgacgcctgagctttatccgggtggaaagtttggatcttggtgcttgcggagatggcgagtacgggggcgggtgctgttcttgctgtggtagttttggcttgtgcactgggagccagagctgatggctctgatcataagtacaaggaaggggatcatgttcctctctacgccaacaaggtcgggcctttccac

SEQ ID NO: 13941 - DNA, 426 bp, Homo sapiens
aatccaaatactttgggaggccaaasccgagatcacttgggcccagaagttctagactagcctgggcaataaagtgagaccgtgtctctaccaaaaaaaaattagccaggcttggtggtacgtgcctgtgatcccggctgcttgggaggccgaggcaggaggataccttgaatccagcggagtagaggctgctgtgagacatggtggcatgtgcctttagtccctgctctttgggaggccgtgacagaaggatcccttgaggccaggagtttgaggctgcggtgggctgtgatcgcaccactgcactccagcctggatgacatagcgagaccctgtctctaaaggaagaaaagaaagaagtacggttagggttataagatattcatgacatgctgttaaaggggaagcgcaractgaagaatagca

SEQ ID NO: 13942 - DNA, 218 bp, Homo sapiens
ttggaagattcaagattattaaaatactattctccccaaatggctctatagattcaacataatcccaatcaaaatcccagtaggctttggtagaaattgagatgttggttctaaaatgaaataaaatgcagaggacctagaatatataatttcccttaaatttgacaaagaagaaaaacatgattgggaagctcacctaatttcagtgtaatatttac

SEQ ID NO: 13943 - DNA, 395 bp, Homo sapiens
  misc_feature 27: n=a, g, c or t
aatgtccgtttctcggagcgcavacancctgtcccatcgagaagcctcgggtggacatggactccatggaagcctgagctgccaggggcttccctggggcagcactgcttcgcgtaggctcacgagaaacttccagggttcctggcgccastttcaacagagcagcacattatgcctggataagactcaaagagcagcttaatatcaggttctctggggctgtaatcatcggttcaggatggagcagacacagccgcagcaaggcctctgtgcagcccccggcttaaaacacatcaacgcatccgtgggcacttttgtgagttaaagctcaacttacacatctgcctgtatccataggaaatgaatgaaaataaacaaacaaattccttgcaaaa

SEQ ID NO: 13944 - DNA, 507 bp, Homo sapiens
  misc_feature 411,458,461,485: n=a, g, c or t
tgcactatagaacaactggacctaatagatatttacagaacatttcatccaacagctgcagaatacatattcttctcctctgsacatggattattctcaaagatagaccatgtgttaggtaacaaaacaagtcataaaatatccaaaaattggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccaaaacctataggatacaatgaaagcagtaggagagaaattgtagcaatatgtgcctacatgaaataaaaacaanaacaaaataacttcaaataaataaaacctgtatcttaaagawccagnggncaggcaccatagctcatgcctgtnatcccagcactttgggaggctg

SEQ ID NO: 13945 - DNA, 487 bp, Homo sapiens
  misc_feature 118,132: n=a, g, c or t
atttctcctgtcaacttccacagccctttatctaggcttctcttcaaatatactatttttgtgccctgaacattatttttatgcatgttcctatgccttcccctctcacacacaactntaatagtcccttgntacataacaggctcataatatagattaatgaatccagaagtgaaagtatcagggactaatttgtaacgtaagactgaagaataagagcttgaggaaacggcagggaaaaaaaacaacagaattgcattatatctttaggaagaagcactaattcccatgtttaccattactctcatctgccaattttcttgtttaagtagaaaaacatcaggttcatttttctgttctcttttgttgattaactatatctatgatatcccatgaggactcttacttctttaaaaaactggtttcctcaaatcactgaagccgtaacacaagtttctaaaagtagtagtgccggccctaaagctgt

SEQ ID NO: 13946 - DNA, 223 bp, Homo sapiens; identical to SEQ ID NO: 10080

SEQ ID NO: 13947 - DNA, 456 bp, Homo sapiens
ggagagaggcgccagttgggggtccggtcggccacgccacctacgccgggacgtgcctccgcggcgcgacgctcccacggacttagctgggatgcagaatagaagctgggcctttgtctgactaccctgcaacagtcagccacagacgggaaggcagcgcaggaaactgaggccaaaggagccgcgcttcctcatgagcatgaagcggcaaagcctgaactagaagcttctaacgcctaaccgtcctcttgccgcaccaggacctacctctgcaaggcccttcctgactttttccttagaatgtgtgtatatgtgtctttttccttttctgatgctaagacacctcagaaacaccaatgttaagcagatttccatcgttggaggttaaaacacccgaatacaagtgttttcttgagtgtggcatctggtcagatgttttatgggttggtttgtttt

SEQ ID NO: 13948 - DNA, 395 bp, Homo sapiens
cttgccgcatagstttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaact

SEQ ID NO: 13949 - DNA, 488 bp, Homo sapiens
ggaacgttctggaaggttgaatggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaac

SEQ ID NO: 13950 - DNA, 508 bp, Homo sapiens
ataagtagatctgtgcagttcaaatccatggttcaagggtcaatgtagtccctaaacatgtctagtaaataacatttaatttcattgttttctttatctccattagccggagcaacttggaggcaggaaacgtatgcattggcatttccaatacctagtagagagccctgtgcaaattggaatggcaatattttttgagtgaataaaagccaaaccagtttcctttgtgtttccatccagaagttcgttctcctttcaccttcattctcataatctagtcatccttatagaagccctttcttcccaacactctgatagggaagcaattgttttattctcttccctccctttatcaagtagagctttctcagagtttgtgggagaaatgattaacataccttgccttcatatagcaaggacagatgtggtggggttgaggtatgaactttgctcccataaaggtctgtatctgtatccaggtcttccatcttctagcttgatcatcatg

SEQ ID NO: 13951 - DNA, 443 bp, Homo sapiens
acctctggtacaggtgggcaagtttttctttgaagaaatgggttattgactcatatgtcataaccttgagtgttactctcccggtgtccagaggtcacattcatgttgcggggttggtatgaaattaaatcttggtgatgtgaccctacattctcttctggtccctagaatcggcttctggtctcctgataactgaagtaagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatg

SEQ ID NO: 13952 - DNA, 449 bp, Homo sapiens
attgatctgttcacagatatgcctgcctctatagcacccattcagaagtctgccatatagaggcttttttgaatgagcacacatgcttttatagttatattgttatctggaatccagttcataatccatgtattttgatattgagtctgaaatttaaaaatttttgtttgcagcattgatggcccatgtagaagacctgatcattaagactataatctctgctgaactagctattgctactgcctgtaaaacctttgttcctcatcgcagcagttgttttgcaagttactctaatcctgtttcctcaactataaaatggcagtaatggtggtgtctacctcctgagaataccatgaagatcaaatgagatgatgcacgcaaagcacttgacacaatgtctggcccttacgttgtactcaataaaaattatttgttatttttgtaaaaaa

SEQ ID NO: 13953 - DNA, 89 bp, Homo sapiens; identical to SEQ ID NO: 10118

SEQ ID NO: 13954 - DNA, 511 bp, Homo sapiens
caatacaggaaagtagctgttaaccatatctgcttaagaggtcagagtctgaagtaaasagctttgtgtatgtgataatcaggatttgcttgtgagcaacttgttcattttttttttaaggaaggcataatcaaggagcattttcttcataaatgttgagatctgttgactttaaaattttgagtttcacatgccttggtgtatggcagaaagaatcagcactcgtaagctagtgtattttatataagaaatgtaacggggttgctgggagcggtggctcacacctgtaatcccagcactttgggaggccaagacaggcggatcagctgaggtcaggagttcgatactagcctggccaacatggcaaaaccccgtctctactaaaaatagaaaaaatttagctgcgcgtggtggcaggcgcctgtaatcccagctactcgggaggctgagacaggggaatcgcttgaacccaggaggcggcggttkcagtgagccaagattwgtgccactg

SEQ ID NO: 13955 - DNA, 347 bp, Homo sapiens
  misc_feature 70: n=a, g, c or t
ataaaggggccttcggaaccccaccagagtcacagccagggagggcagcggggcgcaccaggccgamkcnacgccacagggagggcagctaggacatggggggaagcgcgttaaaccagggagtcctggaagggacgacgcccccggccagtccctgtacgagcggttaagtcagaggatgctggacatctcgggggaccggggcgtgctgaaggacgtcatccgagaagtagctggagacctagtggcgcctgatgcttcggtgctagtgaaatactcgggatacctggaacacatggacagacccttcgattctaattactttaggaaaactcctcggctaatga

SEQ ID NO: 13956 - DNA, 200 bp, Homo sapiens
  misc_feature 133: n=a, g, c or t
gtgggatcgctcccgggggccgctcctctctcgggcactggggtcgcgggagacgtcgtcggagctcggtttctggaggcccttccccacccggcctctgcctcctccactcccccgggctggacggaacggngcccagcgcgggatgcgagaggtatgatttcgctctgtcgcccaggctggagggcagtggcgcaatc

SEQ ID NO: 13957 - DNA, 330 bp, Homo sapiens
atcttagatgcgtgcaattaagggctttggcgggattggctccgcgtttgggctggtccgctgctccccacctaccagggtcggatccggagcccttccccgcggggcggacctccaaacaaccgactcctttccaggtgaagggtgacttggctgaagaaacacttaaattctggaaatagcgactcagtatcatggccagcagccttaatgaagatccagaaggaagcagagtgcgtaacaactattgacttattggtgaactgaaattcgtaataatcgaggtcaaaagcataaacactttttaattaaattaatgattgcacaaaa

SEQ ID NO: 13958 - DNA, 94 bp, Homo sapiens
aaacatgaaacaggataatagaatgtggttgttgacaggaaccatgaaagtcatccggtccagctcccccttaaccaaggaaacaaatcctatt

SEQ ID NO: 13959 - DNA, 399 bp, Homo sapiens
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgccaacatggtgaaaccccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcaaaaaaaaaaaaaaktycgggttttaaaaatttaaaaaaaaaaa

SEQ ID NO: 13960 - DNA, 441 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttasccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaa

SEQ ID NO: 13961 - DNA, 512 bp, Homo sapiens
aaagatagaggagaagacacctaagaaatgtgtttttctggagttatattagtatttttgttgccagtatctaatagtgtttccagaactattctggaagcaagccagatctcctaaacaataattaacagagctttttacctagctttattcattagagtaactaacaggagtttctatataaacaactccaaaaccctagtggcttattaaactgtagatttttttcctatataaagttcagtgcagataaagggggtgtttgttccataaatttattcagggacccaggctctttccatcttgtggttctgtcctcccgcactcaattcattcaagctggtccatggggaaagaatgagattgggccaggactacaccaggaagtgcacatcacttccactctcatttcattagccaggattgagtcacaagtaccacacctacctacaaggagggctggacaaaggtatagttggggactcaggaagaagagagtattagtgactgtt

SEQ ID NO: 13962 - DNA, 526 bp, Homo sapiens
  misc_feature 289,443..444,449: n=a, g, c or t
aaaagaatggaagataacttccatctcagctaaccaatggacttttccttagatacaaattagtcgtgttgctgtttaatacagacctcacatctgtattagtaaacatacttgccagctctctcaattagtcagactttcctgccatatttaaagaagagagtaattgacttgtttgttattctcaaaaataatgtgtctgatttagaatatgtagtttctattgatggtttttaagggttggcacgtatgcgttaagatttttataatagcatcaaactgtcagctnaaagataattttcagctctttttaaagccgaaattcatatttttatggtatttatgttgttgttttcattaagaaaatgctaatcgttgggtgtctatttcaccagttaaatttttgatatatggcctctgcgtttaatgaagacataacaagnnawbcnaaaagtctgattcacggcttgcctttggttcttgtagtctaagtttaaaactgacaagtgttacagttggtcagcac

SEQ ID NO: 13963 - DNA, 62 bp, Homo sapiens
aatgagaaaaacaataaagaaattcccatcactggcaaaaatattacagatttaaaattcca

SEQ ID NO: 13964 - DNA, 510 bp, Homo sapiens
aacgctaaagagaaatctcttctagaatgaaaaaccatggatacaggtaactataacccaaatcagactacctgatttggatcacaccagatctattttataagcatcaaagggtattttttttttaggtgaggaggctccgtggagtgtatttgtcatcactacctccactgatgcctgtgagtggcasattaatttccctgaaatccasagcccagacccacctgcstcactcaggcccastggggaagggctgggcccatctacctcagtaggtggttgccagcatctaggcagatccastgcctggcctggcttctgaccagaataagactttgctacaagccagtgagtaattcctggtcctgattgcacatcagaatcacctgggggccttataactaccaagggccagagccccacccagatcaccagaccagatagatactccatggatcgggccagggtatcagtatttttaaaagcttccaggttgttttctatgacgtt

SEQ ID NO: 13965 - DNA, 112 bp, Homo sapiens
aatttttataaacttttgttctttcttgtaactttttatcagtcagctattccaatgaagcaaaatctgataatatattgcttttatactaaaaaaaaaaaaaaaaaaaaaa

SEQ ID NO: 13966 - DNA, 288 bp, Homo sapiens
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatyaggctggagtgcagtggcatgatctckgctcattgcaacctccaccttccagattctctt

SEQ ID NO: 13967 - DNA, 422 bp, Homo sapiens
  misc_feature 77,131: n=a, g, c or t
ttctgtttgggatgaacaaattctggaaatggataacgatgatggttgctcaacattttgaatgttaatgccactanattgtacccataaaaatggttaaaatggtaaattttgttatgtatattttatcntaatttaaaaaatatatstagaatgggcaagaaggattctcctcattcstctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatata

SEQ ID NO: 13968 - DNA, 512 bp, Homo sapiens
agatacgaaggcacttgtcagtttaggctcctaggagacttgattctggctgacgtgctgcgactgtcatctttcagatcagagtaactctgagtctggtgggagtgtcttcccccgacaccccgtatacctccgctttaagatgagagaatcttctgtcggtgctagcgttcagcgctaacggaggaggcttgactcaacctgccggacactaaaggacatcactctgagcctgagggaggggctctcctttggtctccctcttttgtccagccttgccccaggatatttttctaagctgagttagccactaggcactccacatcgctgcccgcatcaccacgctgcggcatctgctgttgcatctgcgatccacaaggcctacaccattcgccatcgcacctggctgtttgttgcagatatttctcaggaggctaactcatcctgccaaccccgattgacgtcactacaccagtgatagcgtctcatccatcgatctttcaccattagat

SEQ ID NO: 13969 - DNA, 485 bp, Homo sapiens
ataagaagccacagtaaatgaaagaaacggttatttaaactgctcccttgatagtcataattatccagttgaggtgtttctttgagagaagaatatagacaccaggcccacgagggtctccgcatttattttcaaggccaaaggaagtgacccctcggaaaacaccctcgcacaacaaagggcttccagaatctccctggaggaaaacaagaggggtagggtgtggggtcagtgttcagcattaccactagtgaaatggaagaaattctgcagcatttaatatgcagttaagaccaaccttgacttaattgaagatagtgctttaattttaaaaattaaaatgtttggaaatattttaatatttttgaattggttcacttggtttatttatgagccagtgaaaatcgaagtgaaacttgtacatgttatcagctaattttgagactattgctctgcttttggaaaggaaagtctcctgtttattt

SEQ ID NO: 13970 - DNA, 178 bp, Homo sapiens
atttaggggcggttggctttgttgggtgagcttgtttgtgtccctgtgggaggacgtggttggtgattggcagttttcgcattttttttttttttyctttttttttaaagttgggaaataatttwataagtttttwaakgcataaatccaaacatatattkkgtactgaatatttaat

SEQ ID NO: 13971 - DNA, 435 bp, Homo sapiens
aacaactactcaaggacatgtctgaatgagtcactgaaccatggctctgtgaggtcagctgctctctgatccactcgctcctcagcttaaagacatggtcaaagatagtgagacaaaaaggaattgctcaaatactgagatgcatgtcaactcttccaacaacctccagaatttactgagcctgtaacacagcttttgtaatccttttctgtgaaatccagtactgtgtcagcttcgttagggtctaaagtgtacctttcataaaggacctcaagatttattttcctgagctttaaatgagtgaaaatgtgttttgttgaaacttcccaagaagtaactgcattttctatggaatcttccattgtttatgggcctgatgaaagcatttggcacttaatgattcccagactatttcaactttataaaaaatcaaga

SEQ ID NO: 13972 - DNA, 542 bp, Homo sapiens
  misc_feature 484: n=a, g, c or t
aagaccagatgagctggtttcttgggacttccaccaatacaattcttgtaggatttttaatcccatcttggcatctgcttttgggaggacctggtctaacagaatttcttaaagtttagactaaagttgccattgtctttgctatttaatctttgtagacattttttcaagaaacttaaaaatgcatttactatatagacagacacatggcataatatttttattgtcatttcaacatgcatgaatgttaccaaaagattctacagaaaaaaattccggagagtgatatgctctatggcaacgacttcagtggttcttagcctcatttcttcagaattaagagtcagaatattctttttcaataatatcaattaacttttctataagtttgttttgatttatttttaactaccagtagtttcccctgaactaattgccctcaggaaaaaaaatacctggcataatgtcaaatgataaagtggtngtctcaagaaattagttcatttgacatttaattcctacctattcataggcatctcagt

SEQ ID NO: 13973 - DNA, 491 bp, Homo sapiens
ccgaatcagatcaatgaaatagagtttctagcagctgcactgtgaataacgtcctgaaagatgctgctgctggaactcgattccacagctatgagtgtttgttggaaggcacccaaaagggattccaagggccctgcctctactgactgccgtttattcttaaagcactaggctcaacagttgagctttgtgtggtattgagtgggttttatgattacttgtttgccattgttagtgtcagcctgtcaacaccttgaagggcagagcatttttgtttgttttgaaaattactcaatagcaaatccttaattatacagcagtatggctttttgaaaggttgagtgatgtactgctgttgttttagatttctttcatgctaaatcttatgaggtgcatagccttcaataactaaatgcaaataatgcaatcgaatcccacttgagcctgccattaattatctcacatttatctcattccaggctggtgatatg

SEQ ID NO: 13974 - DNA, 55 bp, Homo sapiens
actgggttttggacgcagcttgagataatttgggaagtgcatatgctgtgtaggg

SEQ ID NO: 13975 - DNA, 180 bp, Homo sapiens
atataaaaaattcgccgggcgcagtggcgggcgctgtagttccagctactcgggaggctgaggcaggagactggcgtgaactcgggaggcggasttgcagtgagtcgagatagcgccactgcagtccggcctgggcgaaagtgcgagactccgtctccaaaaaaaaaaaaaaaaaaaaaa

SEQ ID NO: 13976 - DNA, 77 bp, Homo sapiens
tttggcaacccgctcgagtccccttccacgctgtgaagctttgttcttttgctctttgcaataaatcttgctactgc

SEQ ID NO: 13977 - DNA, 296 bp, Homo sapiens
  misc_feature 54: n=a, g, c or t
acttcctgcgaggcccctgcagcagcagcggcgtggtcagagcgagcttcgganavagtggtgggttccatgtgatggtggagtaggaggcaggtctccgcggaaagaaaaaagaagaaaacaaacctccatacgagaatgggtctaaaggaacttcccaaacctccatgattttgcaggaaacaagataaagctggttggtggagaatttgaactggagatgaactctattataggatgctgagagtataatacgcatgacagagcttttagagcactgtgatgtaacatgtcaa

SEQ ID NO: 13978 - DNA, 327 bp, Homo sapiens
gtagaacactgggaactgtcaccaggaaggatgtgatacacactgcccagtgaagggtatgggcagagagtggtatgaagtttgtctacaaaattgtgggtagagtcttctaggattaactcctgacagaagaggagaaaaggaggaacaatttgaatcaagtcctgaaagaataggtaggctggaaatctatctactcatctgttgcaacatctcagattccagataggaaaactgccctcagtgttgcattttgagctatgcaaacatttgaagaacattcatttttcaattagaaaagtaaaatggttgctctcattaaaaaaa

SEQ ID NO: 13979 - DNA, 387 bp, Homo sapiens
tgtagtccctcctcaagaaactggagagagaagagtcagttaaatctaaggtgtggggaaggttgaactgctacccagggtccagttcaaaccagaggctgcgtgttcttccctggacgctgccacaccacgcctaattcaggaggaaagccacaccagaaggacgcagcctcagaccgagagccttgctaggctgcaaascatatttttcaatcagtaaagtatccaaaaagaaaagtcacacgtgccgtgaaaatataaaagaaacacttgtcaaagaccaactcaacagtctgcgaggggagcagtaagatgttacgaccgatggagagagcggaggagctggtggtcgcaggcggtgggacaaggctgctgggtcaggtgccg

SEQ ID NO: 13980 - DNA, 339 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaattg

SEQ ID NO: 13981 - DNA, 58 bp, Homo sapiens; identical to SEQ ID NO: 12458

SEQ ID NO: 13982 - DNA, 417 bp, Homo sapiens
ctattaaaaatgcacttgttccttaaaggaaagtttcatttggccgggcgcggtggctcatgcctgtggtcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaamcccaaaaagtacttaaagtttcatttacttagctaggagaaagasttgattctcaaaaataataccttttaagatt

SEQ ID NO: 13983 - DNA, 481 bp, Homo sapiens
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasactgtgcctagcctgagccaccacgccggcctaatttttaaattttttgtagagacagggtctcattatgttgcccagggt

SEQ ID NO: 13984 - DNA, 241 bp, Homo sapiens
ggaggaaagaaaagccagagtgaagcagaccattagcagataattgtcataatcttgatactaaatggagaccagaattaagggcaccagcagtgtaaggaaggctatttgtaagggatttggcattgtgcctgtcagtggacttcagtgagtgacagcagggtcagtggagtgacaggtagtgagggctttgtagataaaccaggctttcaaagaattgaatgaagcccatccacactgg

SEQ ID NO: 13985 - DNA, 447 bp, Homo sapiens
aaaaagaatgagaacataatgatttcatacagcccatacgtttcccaaataagtaaagggaagctgacttacggcaatgagaggcggtgtggtaacccggagaaactaggctgtcggtgggacacatgggtgtgaatcagctctgctacttacatgctctgtgtgtctccgcagacacttaacctctttgagccttactttcgtcatctggaaatcaagagggttgccctagataattctaaggaccggcccagctgaagggcctggattctgtgctttcagagtatctttgctcttgttctgtgaccttgtctataccctcagcaaacccagaagctccataagacccagcaattgcacttctaggtgtatatccggaagaattgaaagcacgtgttcactcaaaaatatgcacgtgaatattcatcttagcattgctcataatag

SEQ ID NO: 13986 - DNA, 145 bp, Homo sapiens
attcctgtaatcccaacactctgggaggctgaggtgggagggtcacttaaggtatttgttattttttgcgtacaaatatttaactaacttaaagtaaaataaagattaaccgcacacaccaaaaaawaaaaaaattgcgaaaggc

SEQ ID NO: 13987 - DNA, 100 bp, Homo sapiens
atttttttccaaagccatggtgaaacatctctgtgctaatttcttttgttttgtttcctaattttttttttttttggsaggtggtaggaaataatctttg

SEQ ID NO: 13988 - DNA, 499 bp, Homo sapiens
atcatttgatttctaaaaataccatgacctttaaaaattcttttaatagatcatgttattggcagtatttatataaaaaccatggatttagaaaggtatatttagctttattataatagatacgttactattttggaaatatatatattttcacacctgtagtactcttccccatttcctctgacactcatgcagaatgagatcaggcatatttgtggttgacatactctagatagcttttccaacaaatctttgaaaagcaatcttggaaaggaattcattaactaaatggggtaaaaggtttctttttctttgagagttaagtccttcctcaaaaaattttcttatgctccataaaattgaggtagaatattttcattattcttgcagctaagcaagacagccatatgatgcaggttatgcagtgccttcatatctaaaacttttgtactgcactttttaaagcttttatgttgaggaaggtaaagggcatttgtct

SEQ ID NO: 13989 - DNA, 150 bp, Homo sapiens
aatcagttcccaagttctaggcggaagaggcccaagagacaccactttctcgctttcagacgtgtctacataagaccacaaaagaaaccgaggcaaaaacaaaaaaaaaaaaaaaaaaaaaaaaaaaawaaaaaaaaaaaaaaaaaaaaa

SEQ ID NO: 13990 - DNA, 459 bp, Homo sapiens
ctgaatgtttatgtccctcccaaaactaattatgttaaaatcctcaccatcaatgtgatgttacttggaaatgaggcatttgggaggcaattaggattagatgaggtcatgagagtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaacccgtctccactgaaaaaaaatacaaaaaattagccaggcacagtggcatgtgcctgtagtcccagctactcgggaggctgaaggagaagaatcgcttgaacccaggaggcggaggttgcagtgagccaggataacgccactgtactccaccctgggcgacagagcgagactacgtctcaaaaaagacatcag

SEQ ID NO: 13991 - DNA, 501 bp, Homo sapiens
aacagagtgaagagacaacctacagaatatgagaaaatattggcaaaccatgaatatggtaaggagttgatatccaaaatatataaagaactcaaaagtaagaaaacaaaatacctgattaaaagtaagcaaaggatgtgaatagacatttttcaaaagaagttatacaaatagccaacaggtataaaaatgctcaacaccacctatcaccagggaaatgcgaatcacaaccacagtaaggtatcatctcacatttgctagaagggctattatcaaaaacttgaatgacaacaagtattggtgagaatgtgaagaaaagggaaatctttttaactgtttgtgggaatgtagattggtacggtcattatggaaaacagtatggaactccctcaaaaattaaaaatagaactaccatatgatccagtaattctaccacttggatatatttccaaaggatatgaaattggtatgtcaaagagatatctgcactgtcctgttcaa

SEQ ID NO: 13992 - DNA, 132 bp, Homo sapiens
aagaagaggaaagaggaagaagcgctcagatgctccgcggctgtcgtgaaggttaaaaccgaaaataaaaatgggctagacaaaaaaaaaaaaaaaaaaaaaaaaaaaaaaaaaaaaaaaaaaaaaaaaaaa

SEQ ID NO: 13993 - DNA, 376 bp, Homo sapiens
caaacaaagatttctggaagtattttgccaaccttctggttgagctgcaagaaaatatttatggtgagaacttttctgtttcccgttattgggtttttggttggtttttgtttgtbttttactatgctttggtctgtaaaaatatgcaactggactacattcagaaggaaatattgtctacatagaatattatatgaagttggtacataattctgatgaggaaaaaaatctttgcaattctttaagccatattgttgtttttctgtgttgttttccctggatgaaaatatcagtattaagtagacagcatattattcaagtgtttagacttattaatatgttcttgtcctgtatttatacatatgtgtatttttgg

SEQ ID NO: 13994 - DNA, 480 bp, Homo sapiens
  misc_feature 19: n=a, g, c or t
gacsattacstagaacawntaatcgaaactcattttttcttttatcaatgaacattattccgttatctggatgcaccacagtttgtgtcttcattcacataaagaagaacttcttggttgcttccaagttttggcaattatgaataaaactgttataaacatttgtgtgcaagtttttgagtggacatacgttttcaactcatttaggtagataccaaggagcatgattgttgaatactgcaagaataggtttagttttgtaagaaactgccaaactgtcttgagtggctctaccattttgcattcttgtcagcaatgaataagagtttctgttgctccacatcatcaccagcacttggtgtttttattgttctggattttagccattataacatacgtttggaggtatctcgctgttgttttaatttgcagttctctaatgatgtttgatttggaacatcttttcatacgcttatttgc

SEQ ID NO: 13995 - DNA, 485 bp, Homo sapiens
tatcagtgcccttttttaagtttcatcatccagaggattgagaagcatcctaattttctttagcagttttgacagttacaggagtcattttgtattgttttaatgtaaatttaaatcagtattttctgtattatggattccttaaagctatcactagtcagtattactatctgaatatttctgatttccaaaaagggaacattggaggcccagaaaaattaaagacttgttgaggtcaggattaatcagtcaagtacttctctttttagctcaaaactttttccattagattacaatacttcctaacaatgctgtttgcaggctggtctcttatttgtcaaaaacagtatcagatcttgtatttgcagttaatgacatggtaatgtttgaatatttaacattttcattgatgcttattttcagtaatcaactaccacatatttttagaattaacatagacaagtagatagaaaacactttccatt

SEQ ID NO: 13996 - DNA, 343 bp, Homo sapiens
ataaaaaatgttatattaggttggtgcaaaagtaattgtgttttatttatttatttatttattattttttcctttgagacagagttttgttctggagtgcagcgtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaawtgcgaaa

SEQ ID NO: 13997 - DNA, 466 bp, Homo sapiens
atcatctggaatggtgggtccctgagaacagggattctgtctctccggttcactgccagtcctgagacacaaccaggatggatggagggaaatggacgctgaaggaggagtctctcattcctttattatacaccatgaacaagagagcaagaaaatgaaaaagacccagaactttgagcttggagaaatctagaaggagcatctgctgcaactgatgagatagctgagtttacctgagccgaaggaatttccaagagagaggatggtggtgcagtgcatattgcaaccccggatcagccagaagtccgtggatttgggaaagcacatgtaacaatgtcgtccagggtacactgcaaggaacacaggcttagagtcacaagggtctgtgcttgaacccaggaaggtaaggaccttgacaagagatgaaggtctgttatcacaagaagagcaagaacaaaccagctga

SEQ ID NO: 13998 - DNA, 499 bp, Homo sapiens
aacccactcgagtctccttccacggtgtgaacctttgttcttttgctgtttgcagtgagtcttgctactgctcactctttgggtccatgctgcttttatgagctgtaacactcaccacgaaggtctgcagcttcactcatgagccagcaagaccacgagcccacagggaggaccgaacaactccagacgcgcctccttaagagctgttaacactcaccgccaaggtctgcagcttcactcctgagccagcgagaccacgaacccatcagaaggaagaaactctgaacacatctgaacatcagaagggacaaactccagaggcgccaccttaagagctgtaacactcaccgcgagggtctgcggcttcattcttgaagtcagtgagaccgagaacccaccaattccggacacaatagtataaagccccccaaatttaaccatttctttggatcttcttttctatgaaaacctttgtgcatgtaaatattgaataaaattg

SEQ ID NO: 13999 - DNA, 479 bp, Homo sapiens
  misc_feature 364,430,437: n=a, g, c or t
atacagcgatggcccccacacctggaagactcaagctctgaatccagcaccttcaggaagcaagtgatggcatcccagaggccctatgcttgagacagactgacgaaaacaggtggatctaggtaaaatcagtctctgctaccctcctcatctaaaccctcagtgcagggccaccttggaagccatgtgttaacactgagtgatcctcctcagccaagtccctaatgcatggaaaagaacctcctgacccagtccccaaaggctggacttttcctttgcaagaaataaggagggtaaagttcaccataaatrcaaagtcatggagtcaagctgtcacaattggccaccgttcctaggcatttgnattgtatgcattgacaggaaaaagcaggaaggagtgaagacagaacaaggggagtatgtaacctgngttgganggtgtaatatttaaratgtatttgcaaacmtgttttgggcca

SEQ ID NO: 14000 - DNA, 467 bp, Homo sapiens
aaagggaaaactatagaaaatccaaaggcatgatttattaataaataaattcagcaaagttacaggatacaggattaaatatgcagaaattggttatctttcaatatagtatcaatgaataaatcaaaaatgatgttaagaaaacaatttaattttcaacaatggtcaagcttggtggcttgtgcctgtggtcccaacactttgggagtctgaggcagaaagactgctagaggccaggagaccagcctgggaaacagtgagatcccatctctacaaaaacaaacaaacaaaaaacaacaagcaaacaaaaaactctggatgtgatgacactcatctgtcgtctcagctactcagaggctgaggtgtaaggatggcttgagccccaaagttcgaagctgcaatgagctataactgggtcactgcaatccagcctggatgacagagttggaccttgactcaaaaaaaaa

SEQ ID NO: 14001 - DNA, 368 bp, Homo sapiens
actcctgacaatgcagcaggaatcacaagccttttgaatcaaatcctgtgattcaggtcttaaaacctgaacttgactgcctccccatgggagtcacaagttcagaactactggcttttgtaaaattagatcaatgaaaaccttgatacaatccttgtccacatcttcaaaaccagaagacctcatattccagtttgcctagaatagtccaggtttatgtctattgtccaagtttgcttaataagaaagtccctttactctcaaaattatctcagcagggataatacattatatggtcatgctattcagaaagagacaatgtgagacatggcatatgtagtagtacagagctgaacgagctcacaggg

SEQ ID NO: 14002 - DNA, 325 bp, Homo sapiens
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcag

SEQ ID NO: 14003 - DNA, 115 bp, Homo sapiens
  misc_feature 12: n=a, g, c or t
cccccgcaaganacacgaagcatcaatgttcagaagcagcaaataaataaaataaatgaataaaagttaaaaaaaaaaaaaaaaaaaaaaaaaaaaaaaaaaaaaraaaaaaaaa

SEQ ID NO: 14004 - DNA, 447 bp, Homo sapiens
aacaagggcatgaaccccaagaggcaaggwtgacaggdgccatcttgaaggctggcgaccacagatccacacctaactccaaaccaccaaattactcggagtgtgtgtcgggttgcagaaaatgaaatgacccataataactccaagacagagcagaaggttcatctgagtcataccaaataacttcattgctgctaaagtaaaatttgaaaatgattgaagtgatttttatgatcagccttttggaagtcattcaaaagtgctgcaatgctacttcaaagaagataattcaaatttaaatgtcactcttcagtgttgtttatcaacagctgagtattaaaattggtgagcttgatttgtgttatttcacttcaccagcttataatttaaacactcttatacttattatttgaataaatggaataaacacaagtcaaactttaaaaa

SEQ ID NO: 14005 - DNA, 418 bp, Homo sapiens
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatcaggctggagtgcagtggcatgatctcggctcattgcaacctccaccttccagattctcttggaggctgaggcaggagaatcgcttgaacctgagaggtggaggttgtggtgagctgagatcttgccattgcactacagcctgagcaacaagagcaaaactcctaggccgggcgctgtgactcacatctgt

SEQ ID NO: 14006 - DNA, 492 bp, Homo sapiens
actggataaatattgtcaggttccctttaatttagggacagataatgttctaatgaaagaaatattacctgtcctaaattaggagggatctgacagatcttctcctggggagtgcttccacagtttgttttactcttcagttcttaactgtgtccttgggcctcttgattttactgtctgagatatctgtactatttcataacaaataaaccttgtttacaatgaggtaaaatatttagcctatttcctgtctataggatgttgaaggcttagagaactttcacaaacctaaaacatctcagttccttttagttcaagttggcggtccattgttgatacagctctctaaaaagctttatgaactttctatgtatcaaattatagtacagttcactttacagaagccacagatagtagttttttagcattcctctctacttaagccctgttttgtgtgctatactgttgttgagaactgccctttagatactg

SEQ ID NO: 14007 - DNA, 447 bp, Homo sapiens
ttcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagcactttgggaggccgaggcgggcggatcacgaggtcaggagatcgagaccatcccggctaaaacggtgaaacccgtctctactaaaaatacaaaaaattagccgggcgt

SEQ ID NO: 14008 - DNA, 478 bp, Homo sapiens
gatatacattctgtatgaagctcagcatttgaatatcctgctgttcttgaatatgcaccttggttgtatgactttgatcaacattctcagatcctttacttctcagttgtctcccaaacatgacgaagagcacctcccaaggttgtcctgaggagtaaatgagaattaaacctacaggaggccgtcgcccacggaagtgtttcaatagccagcatagggttcaatgctgtcgttcagttggcgccttattgctgaggaagagatgggggcggcaggtgttgggacctcatgaaacgtcactgccatttagtgacatgaacctgaagccccactcccccgtagcagaccccaggcctcacagagagcggastaagcgacgttccccgtctctcatgactgtggccccagcatgctaaggccaggcatgttacatctgacagttcctctcgtcttaaacatcgccacaatagccgcctac

SEQ ID NO: 14009 - DNA, 336 bp, Homo sapiens
ataaaaaatgttatattaggttggtgcaaaagtaattgtgttttatttatttatttatttattattttttcctttgagacagagttttgttctggagtgcagcggtgtgatctcagctcactgcaacctccgcctcccaggttcaagtcattctcctggctcagcctcccaagtagctgggattacaggcgcgtgacaccacgcccggccaatttttttttgtatttttagtagagatggggtttcaccttgttggccaggttgcagtgagccgagattgtgccatgcaccccatcctggcgacagagcgagactctgtctcaaaaaaaaaaaaaa

SEQ ID NO: 14010 - DNA, 60 bp, Homo sapiens
atccaggtgtttgtttctaacttctgtaatacatacaatgcaaaaaaaaaaaaaaaaaat

SEQ ID NO: 14011 - DNA, 281 bp, Homo sapiens
  misc_feature 20: n=a, g, c or t
aactctgtttgggtctcmanccctttggatgttaatcgactgggtccgtgcacctaaataattaaataattcctcctmaatccmacggtctctctgattccttaattatcccaactgcaacactctgtcaacccmaggctggtgtgcagtggcgtgatctcagctsactgcagcctcaaacctcaagggctcaagggatccttctacctcaagcctcctgaatagctggactgcagatatgcatcactacacccagatgttgaagtgctgttttttaaagc

SEQ ID NO: 14012 - DNA, 524 bp, Homo sapiens
aaatacgagggtcaaccagggaccccggagaacaggtaggagtgttttgctggagtggtcctgatgtgggatgatggcggcccagatgagaggggtggcaaatgaaacaagcagaaaggagagatgtaagccatggaacagasagaagaggacatggccagtgagtgaatgtaggtgatgagggaggcaggaaatctgagacgatgcaggtttggggaaggggtgatttgggtagcaccattcgcagaaggcagaatcatgggctgattgatcagataactgatcaaaggcaagaagcaggagaataaagtcctgtaggagacaagagggaggattcagacgtatgttacttctagtccctgattcttttcaagggtagtctctggaccttctcatccattcccagctcctagtacgtgggcagtgagatgggagaggtgggtcactgccccactgcccaccatgcttttgtaatgctccctgctcacccgttctgtgctttagsctctacacctccacgtgaa

SEQ ID NO: 14013 - DNA, 529 bp, Homo sapiens
ctgaataattctccccaaactgcccatatcctaattccagaagcctgtgaatatgtgaccttacattcaaagaaactttgcagatgtgattaagttaagaaccctatgataagaagattatcctgtattatctaggtaggctcaatataatcacagtagcacttacaagaaaaagccaggaagtcagacaagacagataatgctgtgctgccgactttgaagatggaggaagggtccttgagccacaggatgtaggcagtatctagcagccggaaaggcacataaaggttctccctagagtatccagaagaaatgcagccctgaagacccattttagacccttcctgtcagaacttaagagaatatatttgtgattttaaatagataaatttatagtcattttatagcagcaattagaaattaatatagaactgtctgcagtacagttaattggtaagatttaggaattatgtctttttagtgtagttgttatttcaaaagtgtatcatgagaaggtgaattgtgtgaa

SEQ ID NO: 14014 - DNA, 343 bp, Homo sapiens; identical to SEQ ID NO: 13996

SEQ ID NO: 14015 - DNA, 231 bp, Homo sapiens
ctcagcatctggagtagctgggattacaggcacatgccaccacgtctggataatttttgtatttttagtagagacggggtttcaccatgctggtcaagctggtctccaacktcctgacctcaagtcatctgcccgtgtcggtctccggaagtgctgggattacaggcctgagccaccacactccacccctaatcaccccttctaataaagacacagctcatgtaggatgag

SEQ ID NO: 14016 - DNA, 518 bp, Homo sapiens
acttctgtgagttagaaaccctgcctctgtattcccatagcctgctacagacctccacgacatcacatgaaagtgacagctcacttgattcatttttgagaaaatgtctgcaaaatatccaagtctgaataaccagagttcatctattagtcctttcaagtacaaatgacgttccctgaaagaagtacgcagttcagcttccatctgaaacaaggccactgggattttttttcccttcatcacaaccattatgcttcagtatgaaacagacatttatgtgtacatcacactgtgcacacagaatattaaaaaaatgttcactcaacgatgaagatttaacaaaattattattattttttactgctccatcccaacattttaaagtaaaacctgtgtgatgagcaaggggtagtgaataacataatggctaatacagttttgtgtccctgccttggtttgtacttaaggaccagcagttttacttacaactgctttttacaccagcaatgcaaatgtca

SEQ ID NO: 14017 - DNA, 57 bp, Homo sapiens
wasagtgttcttagaggtagcyacacctcagcaagggctttctaacttagaacagca

SEQ ID NO: 14018 - DNA, 440 bp, Homo sapiens
tgacttttgaacttagtttcctcggtttgaggatgtctttgaatacaggtagatgtttgagtccattctttcttttttcgctctgtagcccaggctagagtgcagtggcatgatctcagctcactgcaacctctgcctcctggttctggttaaabcaattctcctgcctcagcctcctgagtagctgggattacaggaacacaccaccatgcccagctaatttttgtacttttggtagagacagggtttcactgtgttggccaggctgttcttgaactcctgacctcgcgatccgtctgcctcagtctcccgaagtgctgggattgcaggcgtgasaccacgcctagcccactctttcttctttctacagccttaatcgaaattgtatcgattytctagtgtagcctacaccttccctaatacagtaggatgttgcaagg

SEQ ID NO: 14019 - DNA, 496 bp, Homo sapiens
attgtaggatggatctgaatgagaaattaatctctgacttcttcaccaaatatttgattctcagcctgattagacctctattttgatacattcattcaacatatttatcaactgcttgctatgtgaaaaatgctatcctaagtactagtcatggtctgattggactctgcaactgataactcaagcgctattgtgtaaggataccagatttagatgagactgtcagcagccctctgggtcctcactgctcgcagtgtccacaggcagcagcagcagaatctgggagtttattagatatgtaggatggcagatccactgcaggcctcctgagtcagaatctgtcctttaagaagatccccaggtagtgcatatgtgcactgaggtttgggaagcaccagtctagtccattctctctgtcactagaataaactgtcctggcctttttcctaagcagatttcttttcagattgttccaaaagataatatggaaaaaaaa

SEQ ID NO: 14020 - DNA, 499 bp, Homo sapiens
aacagagtgaagagacaacctacagaatatgagaaaatattggcaaaccatgaatatggtaaggagttgatatccaaaatatataaagaactcaaaagtaagaaaacaaaatacctgattaaaagtaagcaaaggatgtgaatagacatttttcaaaagaagttatacaaatagccaacaggtataaaaatgctcaacaccacctatcaccagggaaatgcgaatcacaaccacagtaaggtatcatctcacatttgctagaagggctattatcaaaaacttgaatgacaacaagtattggtgagaatgtgaagaaaagggaaatctttttaactgtttgtgggaatgtagattggtacggtcattatggaaaacagtatggaactccctcaaaaattaaaaatagaactaccatatgatccagtaattctaccacttggatatatttccaaaggatatgaaattggtatgtcaaagagatatctgcactgtcctgttc

SEQ ID NO: 14021 - DNA, 428 bp, Homo sapiens
awaggtccacttgcagtgaaataaaccagaggtttgaatcatggcttgatacgaaattattggaaagaatatggcgatgacatccacaatgccggtaagaagacgaaattacaagcaggatgaaaaatttgttcaatgaaacacagctattaagtggctgacctaataagtgttatgtataagtgactcatccattgtagcttctgggactcaactttaggatcatcgtcatatgcagcctggagctagccatatttgaagagctaggaaggaggcacagtgattgacaatctcctttctcctcaactagaatgtcatttccttttttaaaactaatttaaatcccatctacattcaattgcttgtctaaaataaaacccaactcctctcttaaagactttaaaaatattatatagcagagttcatcc

SEQ ID NO: 14022 - DNA, 387 bp, Homo sapiens
aactttctcattagaaatagcccatttatacaggggactggctaatgtttttctatgagtatcattagccagtgtctcaaagtggtgaagagtaagtatatagcatctttcaaaagactgcaacctggaacaaggagagacaaagggaaggaggagtctggagccatattgaagatgaaattgagatatggactaggtggtggatcgtttttataagaggacataaaagaggatgctaaagctaattgccacaatcagaactcaaagacctagcaaatgcaaggtggtatttattccaaactcagcaaagtagtagaaaaatagttttgagaacagttttaaggagactagggtaacagtgagaaaatagttcatggctagtctgga

SEQ ID NO: 14023 - DNA, 382 bp, Homo sapiens
  misc_feature 162: n=a, g, c or t
atrgcttctcmatcttaaggttgttaatcacatctgcrgaatgcctgtrgccatataagttaacatattcacaggttctrggaagaaggacatggacatcttccaggaagcattattctgtctaccacagcagttctttcaaactgtatgtttcccagacmnttcatccttccctgcacaaagtcaagttcatmaacgttcttactgaaatgtgatgttgtttatcacgaatatatataaagcaaagactctctaatcctgtactttgcatctggcatttcaaaatgaagtctaaaagtgtacaatttctactcctatgcaagtttcctcttcttrgatttgacctcctattctggactatgaagagaaccctgactmatac

SEQ ID NO: 14024 - DNA, 87 bp, Homo sapiens
attcctgtaatcccaacactctgggaggctgaggtgggagggtcacttaaggtatttgttattttttgcgtacaaatatttaactaa

SEQ ID NO: 14025 - DNA, 255 bp, Homo sapiens
cttaaaaaaacatctggtaaagactgggtgtggcagctcacgcctgtgatcccagcactttgggaggccgaggctggatggatgattgcttgagcgcaggagttctagaccagcctgggcaatacagggagaccctgtctctatttcaaaaataaataaataggccccggtgtgtgatgttccccttcctrtgtccatgdgttctcaaaaaaaattaaaaaataaaaataaaaataaataaataaaaaaaaaaaa

SEQ ID NO: 14026 - DNA, 502 bp, Homo sapiens
ataaaagacaaaaatggaggtccaggtagatgtaattcacacagactgaaagtgagttcgggctagtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtactttttttgtttacttgtgaaaatggccatctttaagcatat

SEQ ID NO: 14027 - DNA, 317 bp, Homo sapiens
agtattgccagagaacaggagaggaggagagtatggtataagcatgtccagaaataaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcgtgacatttttggagtcagtgaatctcctcctcgtgatacctgtggcaaccacactaatcagctggatggcacc

SEQ ID NO: 14028 - DNA, 119 bp, Homo sapiens
  misc_feature 69: n=a, g, c or t
aatttttataaacttttgttctttcttgtaactttttatcagtcagctattccaatgaagcaaaatctngataatatattgcttttatactaaaaaaaaaaaaaaaaaaaaaaaaaaaa

SEQ ID NO: 14029 - DNA, 399 bp, Homo sapiens; identical to SEQ ID NO: 11121

SEQ ID NO: 14030 - DNA, 228 bp, Homo sapiens
  misc_feature 60,83: n=a, g, c or t
aaaaatctctttgctccagccagggttgtgacttaagcctataaattttkggaggctgangtgggcagattactggaggccangagttcaagaccagcctggccaacatggcgaaaccccatctttatgagaaatacaaaaattagctgggtgcattggcacatgcttgtdattccagctactcgggaggctgrbgcacgagagtcaccatgcccggcatatatgaag

SEQ ID NO: 14031 - DNA, 483 bp, Homo sapiens
ttaaaagatcaatatttcaaaattatatttccgtcaagtttgacctcaaagacgagtaaaaaaattgtgttttgatgttagcatttttttttagcacagccatttaatagatagagtgagaaaatcattcaaaagacaaagctaactcattggaattggtggtgatctctggggatgtagagtaccagagaaactgcactattcatgcatatcctttttcattttaggccttattgaccacatctgtgtataagttgcaaaagtgagttcacattcactaatttctgaggaatttggggatctgggaaggcccagctagagtaccatgagtaacaggggaagacaggaaagctgacctcatcctgtgggccaggccatgcacctggctcatggtcgagtagcatcatgtggtctttaaagtgggaaaaggctggaagtggtgactcacacctgtaatccctgcacttcttgaggctgaggcag

SEQ ID NO: 14032 - DNA, 89 bp, Homo sapiens; identical to SEQ ID NO: 10118

SEQ ID NO: 14033 - DNA, 77 bp, Homo sapiens; identical to SEQ ID NO: 10181

SEQ ID NO: 14034 - DNA, 458 bp, Homo sapiens
aaattaaagaaggatgtgaaggttaggctaagaagtgtgatgacctttatttaggtaataggcaatgaggagaaattgaaacatgaaggaacataatttgaggtgtgattatttgagtttttaaaatattatcactgtgcatcagaatgggttagggaaggcttaaatcctggatgctggctcagcacctattagagcaattaaaatgagaaatgatgcagactaaactataatttcaggtaaaaatgggaaaaataggcgttaaaaaatggtataaacgttaaaaaactacacttgactgagttagaatatggaggaaaaggaagtatggagatcaaaagaaaacatcaggatttgggagcttggacacaggggaatgacaacgtaaagggattatttcaaagataatttggcatagacacttctagactctcctcttcatctgtgtgtgggtactg

SEQ ID NO: 14035 - DNA, 440 bp, Homo sapiens
  misc_feature 101,157,257: n=a, g, c or t
cagggcagtggggtctaatccccctctgtccccagagggctgtgcttggctggcacacctgcttgcgggtggtgatgacctgccggatggcactgacgaanccgctctggtcgtaggggatgaggcccatgaagatcttcttcttggacgagtacangagcatgagcacgcgcacctcacagggggagatgtgggggaacagcatgcagcccgcctgcgggggccgcgggtcaggaccctgtggtcactgcccgkgnccactgtgcccccaccaccctggaccgccccacctgtaggggatgaagggagatcatcggtggacagaggcccccacagtcaaggccatggccataggtgaggggcctctgagagcccgtgcagcgcccatcggcatcccccgaccctgccatggctgaggtcagagtggcacccggcaccca

SEQ ID NO: 14036 - DNA, 312 bp, Homo sapiens
aaataatcttgagcaacaagaagaaagctggaggcatcacactaccaaactttgaaacagcatggtactggcataaaaacagaaacatagaccaatggaatagaatagagaactcagaaataagtatttgtatttacagccsaaagaacctttgggatttttaacaaaagcaccaagaacatttattggagcaggacagtctcttcaataaacgatggtagggaaactagatatccacatgcagaaaaatgcagctcaacccctatctctcgctatttacaaaagccaactcaaaatggatcaaagacttaa

SEQ ID NO: 14037 - DNA, 489 bp, Homo sapiens
tgatctcagccccaaggatactagacaagcccccaacatttctaaattttttgtagagatgggggtctcactatgttgcccatgctggtcttgaactcctagcttcaaacactcttcccacctcagcctcccaaattgctgggattacaggcacaagccactgtacctggctctattaaaatttaattaaaaatttgaaaaagtgaaaattcaggctgggtgtggtggctcacaacccagctggctggccaacatggtgaaacccggtttccactaaaaatacaaaaattaaccaggcatggtggcatgctcctgtagagccagctactcgggaggctgaggtgggagaatcacttgaaccccggaggcagagattgcagtgagcaaggatagcaccactgcactccaggctgggagacgcagtgagactccatctcaaaaacaaacaaacaaaaaagatgcggtggctcacacctgtaatcccagcac

SEQ ID NO: 14038 - DNA, 490 bp, Homo sapiens
ttctggaccaaaattcgtgctacacatatgtctgatggcctttaccttttcaagaaaacagttgcaattttgagcaaaattttcctagttgtaatattttaatagtgttatgtattggaaaaaatttagaaatactcctaagagttttcaatttcaagcagaaatgcttctcttctaaataaataccacttaattgatagacctttagcagttcttgtgctaggatttatacatttttgcttttctggaaaactgctttggcgcattaacctttctactgcaacattttctcttcagtagatatatgagtaaacatgatgagttaatgttacacagcatacccagttaggtctcttattcttaaagcatctttctttagaagtctgcacatattttcaaatgcatcatattaaaggcacaagtcaagaggaggtggagttgcctacttcagtggcctttattcccactatacccagttctcagtcttgat

SEQ ID NO: 14039 - DNA, 475 bp, Homo sapiens
cttccctgttgcggastctgaagcgggctccctgagggcgctggttttgaactggtcttgtgcggtttgcgctttctcttagtggttacagttggcgctgtctccgctttcctgtttcgtggcgggcatcttggccaaaacactctccctgccaccttattcctctagggttgtgatttttttctttcaccaagaaatatcactcgctggtaatttgtcaaactgaagaaacccctgaagaagcagtggtgggcaggcgccgacgctgcggcttccagagcattttggcaaatcaaagccagggaccgttgctgggcctcatttccgcaacttttcggctccgaactgctgtgagtggaagacttttggtggttgttttgatcaggctccttctgtaactagagactatagcattttgaaagaaatgagattctcattcatgtcaagaacatacttgtggatttttgagtgttaa

SEQ ID NO: 14040 - DNA, 478 bp, Homo sapiens
attcatgtttttaaaagagcttgtctacagatggttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgt

SEQ ID NO: 14041 - DNA, 510 bp, Homo sapiens
attaatgcacagaagggatatgtgtgtctaaatgcttatatttgcttgctttgtcttaggtttggtgtgtctttttaaacttgggaatctaggtatatgctcttaaaaagtacttcttggggaattagaaaagatttctaagataagacattgattttgttatcttagcagtgtaatcaaaacaaatattataacctcaggactaattcttaatgaactttgctgaaattgaaagttgttgctgacaacttaagagcatttcttctcatcctcatcagccattgtgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaacctttccaagttaaca

SEQ ID NO: 14042 - DNA, 472 bp, Homo sapiens
cattgataatttttcatgtttatttactccattattttctatctccttttacttaaaagcaagctctgctaattcccctcctcttcagtgtggtgggcaggacttagtaacttccttccaaagaaaagcaaatggaaaataatatcttcacagagaaggaacctggcagacaccacctgggccaagtgatcaaagctaactgcaccagggacgtcttgtggatattgggtactctgatgcgaagagaagggcactttcccctgtgatatgtatccaaaaatccataagcccagaataattgtaagagagcatcagacaaacataaactgagggacattctacaaaatatctgataagtacccgtcaaaagtgtgaagatcgtgaaaagccaggraagactgatgatctatcacagattkgaggagactgaatagagatgacaactaattgtatgtgagatcctggattatat

SEQ ID NO: 14043 - DNA, 535 bp, Homo sapiens
aagaagaagaagaatataggctatgagtggtggcatgttcctgcagtccaagctactcaggcagttgaggtgggaggatctcttgagcccaggagagattggtagaatgtattaaatgaataggtggatgacagagccttgggaaatgtaaaaaaattagttaaataaaataaaacatgatccatctatatactgtctataaatacagacttactttagatacaaagacacaatgagattgaaaacaaaagaatgaagaaatgaattccatgcaaaaagtaaccaaatgaggccaggcttagtgactcatgcctgtggtcccagcactctgggaggctgaggcgggcagatcccttgaggtcgggagttcaagaccagcctgaccggcatggagaaaccctgtctgtactaaaaatacaaaattagccaggcgtggtggtgcatgcctgtgatcccagctacacggtaggctgaggcaggagaatcgcttgaacccgggaggccggaggttgcagtgagctgagatcgtgttatt

SEQ ID NO: 14044 - DNA, 319 bp, Homo sapiens
atctgccacgaaggaagcgccacgctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgsagcgggccatttacacgtcgaggctggcacctggcgcgctcgggggccactgtagcgtctgcctgctccctggactcgcaggcctcg

SEQ ID NO: 14045 - DNA, 479 bp, Homo sapiens
gcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagttaagaattagtacagctgtgttttttaaagccacctctctgtctccaccccatgggcccacacccaggtgggggaggaggaagccactgcatctgttggctcagggccccagcctgtgcaagcaggggcgcctgggctgttgtgtctcctgtctgtgccgatctctattaaaggactccctcttgg

SEQ ID NO: 14046 - DNA, 485 bp, Homo sapiens
ctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgtta

SEQ ID NO: 14047 - DNA, 443 bp, Homo sapiens
ctacctatgtagacaggtatgaaattaagttataattttcatgagacattttcatcactgttgacacagtttcaagcattccatcatgttattttgactctttttctttttttttctttaaaaatatatttttaactagaccaggccccactataatatcacttaagagagtcagggcaaagtttttgcatttatgaagatgtgttcatgtaagggtgattgtaatggagttcattggtaatagaagcaaaagtacagtaacgaagtattgaaaagaaaattttggagacattggagcatattatatatagcttgtggaaagacataaggctacagatggaatggaacattcctgttttcttgaagaaattcacatacacatagctgacctgactagtacttcagctcttccacagccttctataaaggttctttcttctgca

SEQ ID NO: 14048 - DNA, 371 bp, Homo sapiens
  misc_feature 28,75,115,217: n=a, g, c or t
ctaaccaaccctgagaggcttgttcctngttcccatacataggagactcaatttacgagttgtctgatgttgtcntatachtttcccaattgatttaaccaaaagcaacvttttncatctaaggctaaacaaattcttccctgtgctgccattaacgtatgtactccttggcgatttgggaggactatggctgctgacgagtcaatttgttcttgcnagctattaaggttttagttgtggcatcaatgttgttggctatgtctgttgagagctggtcaaggaggcttctgtgactctggcaattctggttcccatactggatataatgccacatctagcaagaagtsgaattaattggmtagccckcwtca

SEQ ID NO: 14049 - DNA, 473 bp, Homo sapiens
ctagccccttctttagggccmaagagaattttgagcactagccgtctctgggtcgccggctaataaaggactcctgaattcgtctcagagtgtggtttctctataagttgctcggttacaacaatttggttgtccaaaactttgattttcttgaacttttttaagagagtttgtgtggctagggagcaggaccactgtaaaacgaggcaccttccctggtttgtcctaaccctttctctcagccagccatctggatggaatggagtcaattatcagaaagtggagagttaagaattagccaggtgtggtggctcacacctgtagtcccagcttgagtcccaggagttcgaagctgcagtgagctgtgattgcacccctacactccagcstgggcaaccagagtgagcactgtctcttaacagaggccaagtgcggtggctcacgcttgtaatcccagcattttggdaggctga

SEQ ID NO: 14050 - DNA, 111 bp, Homo sapiens
ctgtaatcccagctactctgaagactgaggcaggagaatcgcttgaacccgggaggtggagtttgcagtgagccgagatcgtgccattgcactccagcctgggcaacaaga

SEQ ID NO: 14051 - DNA, 499 bp, Homo sapiens
gaggagtgggtccggaagcggcgccggagctggtccggaagcgggcggtggagaagtccagttgccccaaaattcttagggtgagcgaaccgattttctggcggggtgggtggtcccgcggcccaccaagggaacgtctccgcagcctcgcctcggcgacagstcctcgctccttaggtgtcttccgcctcactagttaggatgcgcggtcttcagacttgagacaaatctaaccataaatttgcgcggccgttattttttaagcaaaaatgtgagctatttttacccagacatcatagttacgagagtgacgaagactctggcaggaaaccaaatatcacctgttttcctcaaaaagcagcagaagagtgacaagtgaaaaaagttcctagcgggagacgtgcttggaaccggagataatctgtgtctaccgctggtcttcaaggtgcttaatttcgtgcccgctctacaggaaaataacgtgcgcggcggaggagcc

SEQ ID NO: 14052 - DNA, 70 bp, Homo sapiens
atatatattgataatagattgattagcaacgttctcaaagatctcatatactcttttttttttttttttt

SEQ ID NO: 14053 - DNA, 333 bp, Homo sapiens
ttcttttggactggtccaggaggtagggtccttcctcagtcgactcctgcagaggtcacattttgtgtgcgggtttgtccccagcgtttgagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgtgagaggtgggctccaccctgtacacta

SEQ ID NO: 14054 - DNA, 486 bp, Homo sapiens
taaatgttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaatgtatgcagatttatggatattatcaatgagaagacatagcatgtaacttctcctatatctctactgtccagcatgtattgttccaaatatgactccctaaaatatatacactttgcagaagctctaggccctcacctcaraccttgccattggttgccgtatttcaaggtcatatagtttccctcactttacacaatcattattcttc

SEQ ID NO: 14055 - DNA, 513 bp, Homo sapiens
cagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcacacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcaaa

SEQ ID NO: 14056 - DNA, 383 bp, Homo sapiens
gcaaccttccctcggaaggagacaattcgaggtgctggtacatttcccttgttttctatgttcttctttctagtgggtctcatgtagagatagagatatttttttgttttagagattccaaagtatatatttttagtgtaagaaatgtaccctctccacactccatgatgtaaatagaaccaggaataaatgtgtcattgtgataatcccatagcaatttatggtaagaacaagacccctttccctcaccaccgagtctcttggtctgtgtctgtgaaccagggcaggtaattgtgacactgcatctcatagaactctgcctgcccagatttttgtgtgctcacctcaatgggtgaaaaataaagtctgtgtaactgttaara

SEQ ID NO: 14057 - DNA, 485 bp, Homo sapiens
tattaaactccccattttgtacacccctcaagaagaggacataatttcttaacaccagtgatcacagctcagaatcaatttaaaagtcactaagtgtctcccatacatccccctgggactcctacagcttacaaaagaggaaccctccaaccctatggttttgctttcaaacgttcttggcaaagacggttaacaatgtcttatctcgatgtagtcctcccagttgggctagaagcaccatgaactttaaaaatagtcatgctcggctgggcgcagtggctcacacctgtaatcccagcactttgggaggctgaggtgggcagatcacgaggccaggagatcgacaccatcctggctaacacggtgaaaccccatctctactaaaaaaaatacaaaaaaattatctgggcgtggtggcgggcacctgtagtcccagctacttgggaggctgaggcaggagaatggcatgaatccgggaggcggac

SEQ ID NO: 14058 - DNA, 201 bp, Homo sapiens
aaccaaatagacctaacagacatatggaaagatatccatctaacaagagcagaatatatattcctctcaagtgcacatggaacattccccatgataaatcatatgttaggccacaaaacaattctcaataaattttaaaaggtcaaaattatacaaagggccaggtgtggtggctcacggctgtaatcccagcactttgtg

SEQ ID NO: 14059 - DNA, 322 bp, Homo sapiens
agtatttggtcaaagttgcaaactcctcgggaggaggccaggcgtggtacctcacgctgtgatcccagcattttgggaggctgaggcgggaggatcacctgaggtcgggaggtcgagaccggcctggtcggcatggcgaaaccctgtctctattaaagatataaaaatgagctgagtgtggtgatgcacgcctgtggtcctagctacttgggaggcttgaggcgggagagtcgcttgaacccggaaggcggaggttgccgtgggatgagattgtgccactgcactccagcctgtgtgacaaaacaagactcctcctggaaga

SEQ ID NO: 14060 - DNA, 176 bp, Homo sapiens
cgagaaatcgacgttgacaggtctggtaccatgaattcctatgaaatgcggaaggcattagaagaagcaggtttcaagatgcccttgtcaactccaccaagtcatcgttgctcggttttgcagatgaccagctcatcatcgattttgataattttgttcggtgtttggttcggctg

SEQ ID NO: 14061 - DNA, 129 bp, Homo sapiens
tggctcatgcctataatcccagcactttgggaggccgaggcaagaggatcacttgagcccaggagtttgagagcagcctgggcaacatagcaagaccctgtctcccaaaaattaaaaaaaaaaaaaaaa

SEQ ID NO: 14062 - DNA, 421 bp, Homo sapiens
  misc_feature 106,340: n=a, g, c or t
agtcccgcgatasttcaggcctggcggcggcttccaagctaaggaacggtttggggcagtgtcgttcccggagtcggccgcsgttacccgctcaccagctacgcgncgstacaggtccgcggaggcgcggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatngtccagaattatgagaacctggtctctgtaggtcttttccgtaactaagccatatgtgatcatgttattggaggatggaaa

SEQ ID NO: 14063 - DNA, 309 bp, Homo sapiens
gtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaaaaaa

SEQ ID NO: 14064 - DNA, 444 bp, Homo sapiens
tgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaratacccttcatttgacacagtttttaatgagtgatttaatttcctctgtatttgtatgtttagaagactgcctaaaacatgagcactgtacttcataaaggaaactgcgtat

SEQ ID NO: 14065 - DNA, 477 bp, Homo sapiens
ttttttttttcatagtttaggtgtcattgttgccagcacctttagtgcycagtcttcagtgaaaaatataaagtgccaaaaaaatcttgcaagacagaatccatacttaacactctttccaagacactgtgaccatgtacagwrgctatttcctgatgaccaaatctctcaacgaatcatgttattaataaatatttttagcactcatcagtattctccaatgtgaccttctcattggagtacacagaaggaaagcaaagaagagcatctgacttctagctctggcttacagcctctctaccaggccgaagcaagagacccgcggcagcagytccccgcmactcagacctgggtggtgataacctcaaagaatggctctgttttctattgacagaaaacccacttgattttgcttctgagttagcagtcagaagmccctctaagtacaatagaagtgctcttaacggactctgcctg

SEQ ID NO: 14066 - DNA, 508 bp, Homo sapiens
ctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaactta

SEQ ID NO: 14067 - DNA, 170 bp, Homo sapiens
ctataattctatcatatgtaataatgttttttttgttttgtttttraracggagttcgctctgtcacccagactggagtgcagtggtgccaacgtgactcactgcactccagcctgggtgacagacgagactccgtctcaaataaaaaacagcaaaaaacaaaaaaaaaa

SEQ ID NO: 14068 - DNA, 242 bp, Homo sapiens
tttactggggaaaaaagtttctagagttgtaaactggcagtcagcaatagttgaaacaaatatgtaggataatgagtggatcgataagaagtctagaagacttacatggtggcgtttactcagaacctattcattgagttcttctaatcctatataatctctttgctaccaccaccagctttattgaggtatagttaacaaataaaaattgtatatatttatggtgtacaatgtgcattttt

SEQ ID NO: 14069 - DNA, 484 bp, Homo sapiens
gagtagctgggattacaggcgcgtgccaccacgcccagctaatttttgtatttttggtggacacggggtttcgccgtgttggtcaggatggtctccaactcctcaccttgtgatccgcccgcctcggcatcccaaggtgctgggattgcaggcatgagccattggacccggcctgtattggcttttaatttttaggaaataacacatggctgtgacctgacaacttcatagtggccgtaggtagggcactgttgtcattattcctgtcactgacaatgtcagccccacctgcagatgtaggagagtagatggggaaagtagtagtggagagtagaggtttcccttacsatccttttaggaagtaggcttttaaacatgatatgtaagtttatttagaagatgaaaattaaagcttgaaatgtaatatgagaggaattggcagcggatgtgagtcagatcctcacctgtcagagcaggaagttag

SEQ ID NO: 14070 - DNA, 482 bp, Homo sapiens
cttcatgactcctgaagttataggctgactcctgggctgggggtgggctgggaaactcacacctttgtcctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggtaaggcctggcgtaaccctgggtcagactgtgtcctgtgacacccgggatctggctaggctccctttggattgttcttagggatttctgagtggcttcccggctggggccagatagagagtaggctggcaacaacacacaggctcccccagggccgcctgctgtccctcctcctgcctcggtccccgccgcaccagtgctgctctgtggctccacc

SEQ ID NO: 14071 - DNA, 487 bp, Homo sapiens
agtctccgttccagacgcgacctggcggcggcttggcacggtgtggagggaagacgccggagaggccgcggtctcggggtccgtgtgctcccggagaggaggcgggtggccgaaagcagggtcggagcacgcgttcctctctctcccgggccgagcgttcccagatcagactccgcgcgccgtggattgcagtggaaggggcgagttgacttgcggtcgcacagcccccaccagtccaggaccggcatgccgcaasscagtggctcacacctgtaatcccagcactctgggaggtggaggcaagcggatcatctgaggtcgggagttcaagaccagcctgaccaacatggagaaaccctgtctctacaaaaaataaaaaaaattacctgggcgtggcggcacatgcctgtagttccagctgctcgagaggctgaggcaggagaatcgcttcaacccgggagtggaggttgcggtgaccgagatcgcg

SEQ ID NO: 14072 - DNA, 243 bp, Homo sapiens
atttctaggtcagcatttcatatgcctgaagagtatgaggatagtttgaaaaatcagaaggaagatgagagagggctttgctcttttttaagatcttgctagcagttttgtttgttggtaatttttgctgtctcactgacgccaagagtcctggaattaaaccccgtggccagcaggctgttagttcgtcaggaaattccaaatgggtataaataaattctctgcaacagcaaaaaaaaaaaa

SEQ ID NO: 14073 - DNA, 289 bp, Homo sapiens
ccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggast

SEQ ID NO: 14074 - DNA, 439 bp, Homo sapiens
  misc_feature 74: n=a, g, c or t
attttcagcgctggaacgtctacccgctgcgccaaaccaaaactttgcagtaatagttgatgctgtttcctgcnstttggtggagatttgcaccaggcgctggagaccgtcccacctggccaatgcccacctcccggtgaacacagagacccaactttgtgcaccgccagtcttgttatcaaaaaacaggctagtgccaggcgcggtggctcaagcttgtaatcccaacactttgggaggcggatgcgggcggatcacgaggtcaggagatcgagaccacggtgaaacccgtctctacaaaaatacaaaaaattagccgggcgtggtggcggggcgcctgtagtcccagctactcggagaggctgaggcaggagaatggcgtgaacccggtaggaggagcttgcagtgagcagagatcgcgccaaatgcactccagcct

SEQ ID NO: 14075 - DNA, 468 bp, Homo sapiens
gaaatttcaaattgtatatgcatattttgaatttggtttatattttgtggtatctgaaatattccctggactagaagcaaaaccacagaaacaaaactttacatttagaaaaaaatttcaagacttctattgctaactttattacattagtggtttttagaagttatttagagcagtcttgtctgatagaactttccaccatgatggaaatgtaaataaatataccacattaaaaatataaatttgcaatgtccaataggctcgtatggctattgagcatttaagatgtaattaattagacagaggaagtaaatttaacattttctctcattttagctaattagaatttaaagtgaaatagccacaagtggatagtggctactgtgttggatggcacagttcaaaatgcctcttatttataaaaaaaagtgtttaaaagtggttccatggcttgaagaggaataatat

SEQ ID NO: 14076 - DNA, 298 bp, Homo sapiens
  misc_feature 276: n=a, g, c or t
acccagggtagcagagaagagactatagaaatgtagtgcagagggaagacaagtgaggaattatggcagccaaatgtctcccaaagtgaaagacaagaaaaatgggggcttcactgcacagtaggctggagattctacctaacctcacaggactcctagcatggctggtttcaaaactcgtttgagctataggaataggccattcgtggtggctcacgcctgtaatcccagcattttgggagacctcacaaggatcacgtgaggtcaggagttcangaccagcctgtccagcatggcg

SEQ ID NO: 14077 - DNA, 258 bp, Homo sapiens
tttgggaggccgaggtgggcggattgcgaggtcagatcgagaccatcctggctaacatggtgaaatgccgtctctactaaaagcacaagaattggctgggtgtggtggtgcacatgcctgtagtcccagctactcaggaggctgaggcacgagaatcacttgaacccaggaggcggaaattgcagtgaaccgagattacgccaccgcactccagcctggcgacagagcgagactctttctcaaaaaaaaaaaaaaaaa

SEQ ID NO: 14078 - DNA, 314 bp, Homo sapiens
  misc_feature 85: n=a, g, c or t
gtatagaaagaggaacacagagccaggcacagtggctcacacctgtaatcccagcactttgggaggccgaggtgggcaaatcacntgaggtcaagagttcaagaccagcctggccaacatggtgtgaaaccccatctctactaaaaaaaaagaaatacaaaaattagccaggcgtggtggcgcatgctgtaatcccagctgctcgggagctgaggcatcagaatcacttgaacctgggaggcagaagttgcagtgagccaagatcgcgccattgcactccagcctgggtgacagagtgagactccatctaaaaa

SEQ ID NO: 14079 - DNA, 509 bp, Homo sapiens
ttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttbtacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctccttgcaacttctcaaactgtactaaatttggatatttcttgaagtct

SEQ ID NO: 14080 - DNA, 489 bp, Homo sapiens
tttaaaaattgattaggcttttctttcctaatctctacataaacatgatagcttttttacttcattctttattgattcattgattgattgatattcaatgacagaagtcattgagtgactctttctgccaggtactgttacaggtgctggaaaacagcaatgaacaaaaagacaaacagctatgctgtcatatagcattttatttaagagtgagaaagtggtggtagttttaaactgggtcttaaaaaagaaaagaaatcagccgggcgcagtggctcacgcctgtaatcccagcactttgggtggctgaggcgggcggatcacgaggtcaggagatcgagaccatcctggctaacacagtgaaaccccgtctctactaaaaatacaaaaaattagctgggcatggtggcaggcgcctgtagtcccagctactcaggaggctgaggcaggagaatggcatgaacctgggaggcagagattkcagtgagc

SEQ ID NO: 14081 - DNA, 497 bp, Homo sapiens
ttagaggatggtaacaattggagtgcctaaattaatgagtcaaaattaccgcgcaaggccagctgtggtggtccacacctgtcagcccagcactttgagaggctgaggtgggaggatcacttgaggtcaggagtttgagaccagcatggacaacatggtgaaaacccatctttactgaaaataggaaaacaattacctgggcgtggtggcacgctttttgggaggctgagacaggagaatcacttgaacccaggaagtggaggttgctgtggaccaagattgcaccactgcactccagccttgggtgacagagcaagacgcccactccaaaaacaaaatactgcttaaaaaggttcttttagccagatgcggtggctcatgcctgtaatcccagcactttaggaggccaaggcgggcggatcacttgaggtcgggagtttgaaaccagcatggccaatatggcgaaaccccctctctactaaractacaaaaattcg

SEQ ID NO: 14082 - DNA, 204 bp, Homo sapiens
caaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagcaaaaaaaaaaaaaaa

SEQ ID NO: 14083 - DNA, 392 bp, Homo sapiens
aacactgcaatgggataccagctgcagcgyctgccatggcagggctggtcccaccggagaggcaccctggcacccctgactcccaggatgagtcccagggaacaccagggtggagtcaggggcagggagactcttggggactctgagggagccacaggcccagggagacctcccaagaagacctcccaaagaatcaagcccagcctgtggacctggggtgctgatcactcatggggaagaaaggggtgttaccagcactagaaaatccgacatcttttcttttcaccattcctagaggtgcccccaggccacatgtgcagccctcaaacttggactcctgcagtctctctcccaggtcttctcaacctctgcccaagccagctcctacgcct

SEQ ID NO: 14084 - DNA, 267 bp, Homo sapiens
satacasacacacacacayacagagacacatcttaaggggacccasaagtattgcsctttaacaagacttcaaacttttctgctgtaaagaaagctgtaatatatagtaaaactaaatgttgcgtgggtggcatgagttawagarggcaaaggcttgtaaatttacscaatgcagtttggctttttaaattattttgtgcctatttatgaataaatattacaaattctaaaagataagtgtgtttgcaaaaraaaaagaaaarrmgc

SEQ ID NO: 14085 - DNA, 473 bp, Homo sapiens
tgattgattggcatacaagttctgtgctttaaattattgttttaaaatacaaggtgaaatcgtgaaataaagatgcttctgggtggcagatttccagggttttttcactaagttggtcagacatttctcttgcaaccttgtttgcaatattaatttttttggcaatttttcatagctaatacaaaaaatagactaagcccctatattctaagctaatagagcccagttaatgaatttgagtttggggaaaaccttttgtaggtcagctgcttctcctgccatcacactgactactaattcaggaggatggattcaaacataagtacaggaaatgatagactttttcaaaatcattgttttctcaatcttaattgtgcatttctataagaaacacttgagtaggatattaaagcccagcaggagacctgggcttagtgctcttgaaactctaccttgcccacctacctaccacc

SEQ ID NO: 14086 - DNA, 414 bp, Homo sapiens
gagacggaagcccgtggtgccgaaggcgcgcgtmstcgatgaggtctaggatggacgtgcccaggatcagcaccaccttgggagtgaaggcgatggagtagataagccaggccagacagtgctttaccatggaactgaaaccatgaaaagtgaaactgcaaatgggagagactgctgtatagtcactgaaaaattaatggatgagctcaacagcaaattagacacaactgaaaccttggacccatgtgtggaagatgacagcatcaccaactggagggtgcctggatccctgagtcaccacttgaagcaaaaaggtcaagagtagccacctgacccatatcaggctatgaatgagcagcatctggttgctacagcaacccagctctgcagggtgtccgattaccagcaggctcc

SEQ ID NO: 14087 - DNA, 445 bp, Homo sapiens
  misc_feature 345: n=a, g, c or t
acaatagcaggggacaagaagcagacgagcacagccttggagaagtacccttgaaccttcctctgcagaataagtatcctggcccaggatgggcagccatgcccatggcaaaaactaggggaaaaataatttgcattcctgaggcttctgctctgaccctgacagatctctctcatccaggaaatctggcggaacggcgctctctcagctaaaaagcctcaatcctggagccaacggattcggaaagcaactttgcactccaatcaaataaaaatgttcttctctgctgaggagaagggggcaggccccagaactgagctctcgggctcagaagagtgtacgcgngcttccagccggtatgcacaggcaagaagtgaagtgggcagccctggggcagaggatgcgactactggactgaggttgaatcctttacgtgtcgccacgc

SEQ ID NO: 14088 - DNA, 503 bp, Homo sapiens
caaagaattagtaataaatttttagggaaaataagaagccagggtataaaatttccaggtttttatatctaaaataatgtgaagcaataactgtttaaaactcaggaatacattcaccagcagcagcttaagaaagcatcaaacataactgagatcatcagtaattttataaaaatggcatccaggaaaagtaaaaatataacagaaatttccacgaggtaaaatgcccctacccaccacccccccaaaaaaaacagaaagtgaatataaaataagctacacagtcctaagacttcttattaataatttccagttggaagacaatgggcttaggaggaaacatgtttgcaactgaatgaaaaacgtatgaagagaaaataataatacctactccttgagctctaagcagcaatgaaaatctaagaagtttaacatttttctttctccatgctgggagtacagtggtaaaggtagcaaaacaaactataattactcagagatga

SEQ ID NO: 14089 - DNA, 441 bp, Homo sapiens
aattaaagaatgggsraaggatttgagtaagtatttcttcaaagaacatacccaaatggtcaataagcacatgaaaatatgctcaacatcattaactagcaatgcatataaatacaaataaaatcatggtgagatacgacttcatacccactaggatggctatactggaaaagacagataataaccatcattgggaagaatgtggagctgttagaaccctcatgcactgccagtgggaatgtaaaatggtgagccacattggaagagtttgggagttcctaagataagaagttaaacatagaggctgggtgcggtgcctcatgcctgtaatcccagcactttgggaggccgagacgagtgtatcataggtcaggagatcgagaccatcctgccaaacatagtgaaaccccatctctactaaaaatacaaaadaaaaaaaaa

SEQ ID NO: 14090 - DNA, 394 bp, Homo sapiens
ctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttwaaasaatgtaattgctacttgataaggmccgaacattatyctagttycatgtttaattt

SEQ ID NO: 14091 - DNA, 508 bp, Homo sapiens
agtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtcctttcttgtttaagataattg

SEQ ID NO: 14092 - DNA, 501 bp, Homo sapiens
cgtttgtgttcttacttggaaatctttgttgggagggctaagatgatcctcttttctaggagcagtggtatattagggttcttcagagatatagaaccaatggaatgtgtgtgtgcatgtgtgtatgtgtatgtttgtgtagctatacatagatgtatagatatatatatatagagagagaaataggtatgggcggggggagagagatttatttaagggctggtcacggtggctcacgcctgtaatcccagcactttgggaggctgaggcgggtggatcgcaaggtcaggagatcgagaccatcctggctaacatggggaaaccccgtctctagtaaaagtacaaaaaattagtcgggcgaggtggcaggcgcctgtagtcccagctgctctggagactgaggcaggagaatggcatgaacttgggaggtggaacttgcagtgagccgagatcacaccactgcactccagcctgggtgacagagcaaagactctgtctcaa

SEQ ID NO: 14093 - DNA, 326 bp, Homo sapiens
cattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcaaaaaaaaaaaaaa

SEQ ID NO: 14094 - DNA, 514 bp, Homo sapiens
aacgatgttgcctagttaacgcgagastcgggcgcagtctgggagcggacaagatacagtaaacaattggcttgcattgcaccttcctacccaagcagcttggttttctttcgctttgaccctgtaatttctttcccacttcgttgtcgtctctgaattacctttctcttgattcttgcccattagcatcctccaatttcagatgtttgtagatccccaagtgttcccagggaaaactactagaaaaggagaaaactgaatgggctacctttgaagtccagggcaccctcctctatcttgttcacttcctcatcaggcactatctatggactgagaagagaaggactttaaaacagtggtaaagaaagcaacaaagacaatgactggcaagacagaagaattgtgcagagaaagaggaacactgtgacccgatcaaggacgaaatgattccaacctccttagagccttgctggtgccgagatgtctgtgatcatcagtcacctcttcatcccaa

SEQ ID NO: 14095 - DNA, 504 bp, Homo sapiens
catatatatgaaggtgaatcaaaagaaaaagaaaacagattacaactttattactgcccttgttggacacttataccagcaggctagcagacactgcacagaatatagaaatgagactctgagtacatgatctataatgaaaatgaagccaatcagaatctaatattactacaaggttgaaataaaagctatggtatttctcataactgcacttggcacttagagaaattgagactcacaacatgcttcataaacattaattaattactctgggcttacatttaattcttccagtggatagaacgtatgtacagaagatgaaagagtcagccataacctggtgctcattgtacttccagattgtaggatcagctaataataatcacaatagtagctgacacttgtaatcttcagaacaccctttaagcatttattaatcaactattgcgccatctcaagggaaatattattcttctcacttataacccataaaattgtgtcttc

SEQ ID NO: 14096 - DNA, 186 bp, Homo sapiens
aacgcccagctgctgccgctgcttcaggagagagggtggggtgtagactgggtgggtctcacctcctgatgccctcaaggcgcsctctcagccccgsgtccscggcctgcagcggtgcagccaaagcccggacctctgcccgccccaaacccgccatgaccaccggccgccttttacydagcgtca

SEQ ID NO: 14097 - DNA, 174 bp, Homo sapiens
ttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtcagcatttttttttttt

SEQ ID NO: 14098 - DNA, 225 bp, Homo sapiens
agtagatatcagatacgatattttggaaagttggacattaagaagagtgtgattggggaggttgttgtgactttctgcctgaagattcagagtcaggatcatgtgctaacaggtgacttgaagtttagaatagccatttggggagagtagacacaagaggtggggcactcatggctgacatttgttagagcaaaaggatttattagagtgaaaaaaaaaaaaaaa

SEQ ID NO: 14099 - DNA, 382 bp, Homo sapiens
  misc_feature 372..373: n=a, g, c or t
taattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcgggagaattgcttgaatccgggaggtggaggttgcggtgagcctaggtcgtgccactgccctccagcctgggtgacagagcgactgcnnctccaaaaa

SEQ ID NO: 14100 - DNA, 432 bp, Homo sapiens
ctgaaccagtattttctttgttctatctgagtcatgggaatgtcagaaacaaagatggacttatctgaacctaaaatactgtagaccagaaaacccccaacagagtttgtaacattgcaaattttggcagcatgatcagaacattagatggcttatcattatcagactttatatctgattataaagattaggaatttctacttcaggaaaggaatgaatgggattgaaaaggattgaaatcttcaaaataatgaatatctgaaagctcttgcattattttgaagcttattttttctataaatcttagcaattgaaactaacagttgctgggtatggcaactcatgcctgtaattccagcactttgggaggtcgaggcaggtggatcatctgaggtcaggagtttgagcccagcctggccaacatggcagagc

SEQ ID NO: 14101 - DNA, 455 bp, Homo sapiens
attttaagtcattcatgtattgaaaagaggatggggatatgatccctctgctctgtggcagtagatctactaatgggagagtcctggccgcacatctggcctgggtctggaggtgccctacggaattgaaagctggctggaactgtcatcttaacatgtcctggtcatcttaacgtgtccacctctctggcaagcctcttttcaagtctttttgttaccatcttcagctttttccctccatactagattcttaatgaattgctgccaacaagagaaagctttatacatgaagagaatggcaataagaactaactcgtctttttaattttaaaactggtatatattcctatataataggaatggaagatacttgcaaagcctatttgttcctctacagaagagttaaaaattacctgggctaatggaaagaagggagagtcagccaattagatgct

SEQ ID NO: 14102 - DNA, 354 bp, Homo sapiens
  misc_feature 342: n=a, g, c or t
aaaaaaagsggacccgsgaacggtggcgstgggtggacacggaggtcccgsgstccccgaccgaaatagggsgggccctatttcggagaggtktttggcacsaasattttttaaagccccgtgggtggttctccgggatctcccagaccgagagggcstgaacgtcsagacstcagggaatggggtcgaaggggcggcgctcgtccgcggaggtgggcgggasggccstgggctccggctctagagagcgggaktgaccctcggtttctggcctccgaggggcgggagcdatcctcagcaatgtccctagtctctggcttgsggstgatttttaaatttttntgtagaggccgg

SEQ ID NO: 14103 - DNA, 454 bp, Homo sapiens
ctttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccgctccctggaaagccactgcagaggggcagtgctggmcagtgcagcctgggggaagtggaagcgtcctgtctgggggcagattcccaagcaagggtgacccatggttaagggccactggaaagctggagagagcttgggatcccttccacctgggggccaatggtg

SEQ ID NO: 14104 - DNA, 607 bp, Homo sapiens
taaattatttgttagttgacgatgcaatcagcatgctgattaaggttgcttggttttttactaaacattaactgaatgaaaacgggtagtccttgttctgcttggggggctttaaggaagcaaatggactttcagaacagagattgtcaataaagatccaatgtgataatttatgtkaaatctttctgcaaactmtacagtatgataaaaatataaggtagtttcactggaaacaacagaagactagaagctgatgtgacgtggcaatatcaaccaggaatacccatctcgagttctggatatgtgctctgagaaggtgcccatgtcaccgaccacactggaggccaatgcagatactgggggaaggttccatggtagctaagtgtggacaagctaatcactgaagttccctgatgcagagttgataatctctctagagttggatgaaagactgtgctgccttgaagctctgagagatgccatgccaattcaaggcagggtctttattgttgaaactcttgcgtaatgacatctttattcaggtgaaaatacaggatgaatttcaactatatgatattgtttatgtyctcagacatgttatttgtct

SEQ ID NO: 14105 - DNA, 69 bp, Homo sapiens
aaaaaaaaaaaaaaaaaaaaaaaaaaaaaaaaaaaaaaaaaaaaaaaaaaaaaaaaaaaaaaaaaaaaa

SEQ ID NO: 14106 - DNA, 429 bp, Homo sapiens
atcaccttttagagctagagaaccgtccaggtattaaatgtttggaatcttttatgatgtggattgtgctacaggggacactgagtaacgtggggaccaatgtccttcacagtttttgtagaaaaatttttaggtggtcttccatattcacccttagaagcaaggacaacccttcgagtgtaattccgtggagatgatttccttctgactcaaacacccatagcttccctgtctgtccatttcgtgagctcctcattaccttccatgactcacttttccatgtgacacggagcctccctggcttccactgctgatactgaccattcctttctttgttctctatgctgccgtggacacagagccaccatcgctgttaactgtactagagtctttacttttttttcttttgtgagcctaagccttcctcaa

SEQ ID NO: 14107 - DNA, 379 bp, Homo sapiens
attctcctgcctcagcctccggagtagctgggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgasaccgcgcctcgctgtccgcctcttgaagagtaaacgaggccgggcgcggtggtttagtaataccagctgtaatcccagctacttgggaggctgaggcagaagaatcgcttgaacccgggaggcggaggttgaggtgagaggagatcgcgccattgcactccagcctgggcaacaagggcgaagttctctcaaaaa

SEQ ID NO: 14108 - DNA, 488 bp, Homo sapiens
aaatctgtttgttataagattggaaacaatttttgagagggactaatttaaacaagtcctcctttagtcttttgggtcgcgtagttgctgaaacctaagtacctgcagcctacaggataaggaagttcacagcctgcggggtgaatgaacccatgtgtgaactgcacagagcaattcatagaaaatgcatagaaatttgtaacactttggtcacatctgtctctagatggtcattgaatttgtttaaagatggatgaaaggccaggcatggtggctcatgcctgtaatcccagcactttgggaggccgaggcaggtggatcacttgaggccaggagtttgaaaccagcctggccaacatggtgaaaacctgtctctactaaaaatacaaaaattagccgagcgtggtggtgcgtgcctgtagtcccagctacttaggaggctgaggcatgagaatcacttaaacctgagaggtggaggttgcagttga

SEQ ID NO: 14109 - DNA, 471 bp, Homo sapiens
cttagctccaagctaccactgcagatagaggttgtatgggataagtgagcaggggacaagggactacatgatagaaggggcctggaagccatccccaaggagtctgaacttttgtcagatcaagtcttgcccttgtctttgttagtgcaatttttttttcctgccaggaatgttcttcagtcatctggggtggggtgggcaaaggcatccttacctccctgaaccaccccatcctctgagcagggggagatgatcaatcggattgagaagaacatcctgagctcagcgactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaaccc

SEQ ID NO: 14110 - DNA, 171 bp, Homo sapiens
tacaaaaattagctgggtgtggtggcatgtgcttgtagtcccagctactcaggaggctgaggcaggagaattgcttgaacctgggaggtggaggttgcagtgagccgagatcgtgccactgcactccagcctggcgacagagcaagactccatctcaaaaaaaaaaaaaaa

SEQ ID NO: 14111 - DNA, 356 bp, Homo sapiens
ataaaggacacattagagcataccagagaaaaatcttacatgaaaacagtaaacagtaagaaatacatgaacaagattattccagagggtgatgggtgctgtacagaaaataaaccgagaaggtataaaagatattgactaaggataaattagattgtgtagaacaggagctctagaaagacctcaccaaggaagtaaccttggagcgagtgatgagacagcaggaaccaccacgccaataccttgggacaggacattccacagagatgcagagacaaggttggcttagccaggcatggaagaaaggccaggggcacaaagatttggtataagaagttccagaggaagacaaagac

SEQ ID NO: 14112 - DNA, 74 bp, Homo sapiens
aaaccctcagggacctggtatagacccagaatctgtttcacacaacaactgctatttgaaggaaaaaaaaaaaa

SEQ ID NO: 14113 - DNA, 481 bp, Homo sapiens
gcattttgatagtggctggagggcaggcagctcaacctctaaacccccctggtctgggcaccaagtcctgtcctgggcacgggacacagtcctccagcgagaccaaacccagcttctctacagcaccaggaagaaggcaagctgggccaccagggcgcggcccaggaaggaaaatcctccatggtcctgttgacagatgtggtatcaaatgaattgttctctgcttagacacgactttgatatttattggttcaaattgctcggctgactcagtcttgcggactctgattacactggacctatccaagatctgagatcatcaactcatctcaaaatccttaagctgaccacagcagcatcgtcccttttgcagtgtaagggagcccagctgggacaatgtgtgaatcaacgcatgaaggagtgagtgagcagctaaccaaatgaaagaatactcagatatctggggtacagttcccttcca

SEQ ID NO: 14114 - DNA, 443 bp, Homo sapiens
gtagaaaggggtgtgggggagatgatgtgggctctacctacaagatggggaggcatttctttatattatttgcaaaaaagcagggttgggaaataatattcagaactgagtattgcctctctgtcatacaattttctcacatgtgctgcggaagatgccttatttcgtgcatgcatgagcttcgaaggggcgcagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaa

SEQ ID NO: 14115 - DNA, 259 bp, Homo sapiens
attctatttagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaatagcaggggca

SEQ ID NO: 14116 - DNA, 309 bp, Homo sapiens
  misc_feature 212,262: n=a, g, c or t
agttttagttccggcaatgagttgcgccggggcggsgcctccccgcctttgssttgcgccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatnccggccagatggctgtcctgggtcggaccagcgtcgggccagtcattcanaaaatgktgggatcaagaaaaggaccatttgaaaaagttcaatgagt

SEQ ID NO: 14117 - DNA, 483 bp, Homo sapiens
accgtctccatccctgcgccgggactggagaggcttactctctcctgctgatgctgcagctgctgggatgccaggaggggaacgcctgaggaaagtgctgagagaaaagagagggagggatacagaccgggcccagatgagtttgcgctgaatctgaagtcggtaggtccctggacatttctattatggaagccaagaagaacctcccctccaccctctgaagccagtgtggatcgggtttctggcacttgcagtgtctgcacggtctcctctccttccttctccattgccctttctcacccgcctgggcccgccaccctgaactaccgggacacatgctgttcctgcctccaggcgtgcacttcttcctgcagcctcctcccctactaactccttcttgaacttgatagctccattgtcactttcgagtcttccctaaaccactcccttcccaaataaaactgtttcatgtatttttctttc

SEQ ID NO: 14118 - DNA, 473 bp, Homo sapiens
tgaagaatgtatataggtaaaggggagtgtggtccagtggttccagaaaagggacagaactgtgttctgtctwaggcttgaccgctggctcgctgtgtggccttgggcaagtcacttaacctctctgtgcctcagtttccccatctgtaaaatggggataataatactgacctacctcacaggggtgttgtgaggctttaactaaatgttttgtaaagcgttttgagatacagaggcaaaggcgctagggaagggcaaagtattattggacttaaggaagctgaaatggtaccataaatgctgctattctgagagccattttaaactgcactgctccaaccacccccgcttctcatcaccaggacagcaggtcgagaaaatgtctttcctttcacttgcttctggggtttgtgattattcaagacaattttttccccttgctgtatctccttccctcacctcctcgacttgtt

SEQ ID NO: 14119 - DNA, 487 bp, Homo sapiens
tagacctgttctacctcctcaccaaatataatggcagacccatgtgtgtctggaatggccttgaattgctctttccttaaaatagctagctcttcaggagagtatctaaggcccactccatcttacctgaaccagttggtaagggtaaccatgacatagagtgaggcaaggaagaagacgaagtggaaggcagaatagttgtaggaaagatgctggacttggactggaggagctggaggggtttcttggtcagctggcctcgcagccccacccctttgccctggagagaggaaatggctgctgggagcagagctgctgaaacacctcttcccctctcccccaactacctttgttaaggctcttgagggttcttatggcactccacagagatctaccacttcttatggttcctcacttggcactcacctttgtctgcctccactgtttcagggcagcagaaacacagtgagggcttctgcaaaacaga

SEQ ID NO: 14120 - DNA, 430 bp, Homo sapiens
tcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttc

SEQ ID NO: 14121 - DNA, 168 bp, Homo sapiens
acctagcgccacccgcttcgcttgcatcagctgcgcgccccatcccgaggaatggtaggggaagaaaaagctattgtttacaattatatcaccattaaggcaactgctacaccctgctttgtattctgggctaagattcattaaaaactagctgctcttaacttaaaa

SEQ ID NO: 14122 - DNA, 403 bp, Homo sapiens
aaatatataaataccacaatgaaaaggcactttggcttgaaaaacacctgaggtttgcttgtgggaagtaagtgtcattaggttacagcttgggagttatcaggaagtggtggaaggagggctgtctgaagtccaatggaaagttctgacatcaatgtgatgaatgtgattcataacacatgcagtgacctgatgaagctggtagatgtttaaggtgcctgtgtatgtgtgtgcacattttgtgcattcctgcatggctcatttcagccgaatatggttttctgcacttcctagtgtttttctcatgcataagcaaatgcaaaatttatgttatgctcagattgtttctggatgtatctgatgcatttgaacaaattcacattttcaaagtaagagttaaagc

SEQ ID NO: 14123 - DNA, 481 bp, Homo sapiens
tgattgcaaggaccaccttgtggatcaccttttcccagctggctagggctaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaagagacttaaggttgggcatgggaagggtggggtttccatgatccattaaatgccttcctactcccattcatcgctctcaaaattagcttcagtgacaaagacttaaatctctctcctatctgcagcactgggttggagagagggcacgggagttggtcttggctgttcattgattgagactgtaggaactgtgttgg

SEQ ID NO: 14124 - DNA, 315 bp, Homo sapiens
attgtttgggatgctggggtgaggcccgcctggaccgcgcccctctcggaagtgtagccaggagtaggggtgtaggatgtgcagctgtgacccgtccctgtggactgaaggcagaggttccggcttctggcaataaagaaacaactcagactgtaaaaactctggagtttaatgtcaccgaacacattttgaaaagaactgccccaggcctggcgcagtgtctcactcctgtaatcccagcactttgggtggatcacgaggtcaggagatcgagaccatcctggctaacacggtgaaacccgtctctactaaaaa

SEQ ID NO: 14125 - DNA, 417 bp, Homo sapiens
  misc_feature 372: n=a, g, c or t
agagtttaattgatgtgaggctggccatgcatacaggagacggagttatgactcaaatcaatctccccaagcatttgggggctaggatttttcaaaggagcaggacccggcacacagagagatacactctgactctcgggagggagaggaagcagccggggaaagcaagtctaaagtcaacggtggattccagagagatggggacttggcctgacgtcaagcatgtgatggtcaggagttatggagcagctggcatctctatctgaccacacgcaaagcctcctggaaaacacgtggccatattggggttgataattcaggtagcagagttggcttccatgccagaagtgggagggacaaagaaaccacagnctcccacaaaaggaggaggagctttctctgaagtgctactgccca

SEQ ID NO: 14126 - DNA, 503 bp, Homo sapiens
  misc_feature 316: n=a, g, c or t
tttaaaataaacagggcaacataacagaaagtaatacagagactctactttggactgaagggataggaaatctcagtcttgctaacaaagtgacatctaggcttaaaacttaagcttagagctcaaggtttaaacagagaggatagaacaatgtactaggcagagaaaacataaaggtcccaagacaaaagatatagtcaaggtacagacaaaaaataccagggtgcctggagcagtgaaatggctcatggcatgcagtgatcaagaagccttttgggtactggttaagaatttggaattatattaaatgaaatgngtagtccatggaggatttccagcagtgtagtgtctgattcgactatgttttatttgcctgcgtaaatagacacagaaagaagggtatgaagaaagggcaaattggctgggcatggtggctcacacctgtaatcccagcactttggtgtttaaattccttggggaaggccgggcatggtacctcatgc

SEQ ID NO: 14127 - DNA, 493 bp, Homo sapiens
ttttgggagtaactatcttgtttttgattttagaggctcataggcagaaggtacttgccttgtctcagatgtgactttagactgtgaacttttgaattaatgccggaatgagttaagactgtggggtgactattgaaaaggcatgactgtattttaaaattgaaaagacataagatttgggaggggccaggggcagaataatatggtttgaatctctgtccctgtccaaatcttatgtcaaattgtaaaccacaatgttagagttgtggcctggtggaaggtgactggatcatgacggtggtttctaatggtttagtaccatcccccagggctgtttccattatagagttctcatgagatgtgtttgttaaaaagtatgtagctccttccccttcttcctcctgctccagttatgtaagatgatcctgcttctactttgccttccaccataattgtaagttttaggagacttccagaagctgaggaaatagcc

SEQ ID NO: 14128 - DNA, 182 bp, Homo sapiens
  misc_feature 116: n=a, g, c or t
ataatacagctaaacacacagccataaaaacaaagtgtggactcgtgccatttcccttggagcagagaaacctgaacgatcagggaggcattgtcctaggatagtaaagggaggangggggaggaaaaggtttcaggaggagacagactttcaaaaggaaacaagccataggccaaaatatg

SEQ ID NO: 14129 - DNA, 385 bp, Homo sapiens
  misc_feature 122: n=a, g, c or t
attgaaaatggatggtttgggtattaaaaagaaaaaaaaaacttaaaaaaaaaaagacactaasggcsaktgakttggattctcagggcagggtggsattttcccttragcaaagcagccanacgttgaactgtgtttcctttccctgggcgcagggtgsagggtgtcttccggatctggtgtgaccttggtccaggagttctatttgttcctggggagggaggttttttgtttgttttttgggtttttttggtgtctkgttttctttctcctccatgtgtcttggcaggcactcatttctgtggctgtcggcsagagggaatgttctggagctgccaaggagggaggagactcgggttggctaatccccggatraacggtgctc

SEQ ID NO: 14130 - DNA, 62 bp, Homo sapiens; identical to SEQ ID NO: 11091

SEQ ID NO: 14131 - DNA, 392 bp, Homo sapiens
attcggagggaagctgacatccacaccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaatagattcattcagtggtgttaaggattccaacaacaattccgatggcaaagcgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaaga

SEQ ID NO: 14132 - DNA, 496 bp, Homo sapiens
gaaggatattataccttccattttctttactttaaagacaagatctttaatgttgccattccccgattccatatggcatgtccaacattcagggtgtctatagcccgattggtaagttaaattttcctctagtgctgatttacatgactttgtagggttaacactgcagataagccaggcaaatagttagtttataaatagtgttccagagaaccctagagattttgagaaagtatcttgggggtcatgtgaatttgttgagagaaatggacaagtaaatgaggctccatagtctctaaccagagaatttctgctgttttaaagattcaacttgtttttcactgttcagtggcctaaatgtagattatgagaaataccacattagaccagtagaatcagctttaagactgggaaaacaacttcttacagtgtttttgctcaaacttccaatttaatgtcaaataaacaaatattccataaagatcattataaagaa

SEQ ID NO: 14133 - DNA, 452 bp, Homo sapiens
cttattggaaacaaaagaataacttagaatacgtggagggatgaatacttttttttttctacctcttttatactaaaatastatgaatctcagttgggcatgagaggtagtgaattgaagagggtttgtgtccgagctctctggtcaaagcttggatttacttattctgtgctataaattaaaaggaaatacattctcttaattggtggtgaagagacttgctgaaagttgcccaatttgtaattaaactttggatctaatattctttttttcattttctatactttgatattagatagctgcttgtatgactatacatgatgaaataattggatacatgttaaaaatgaaaactaaactctgcataagtaaaattagtgaagaggcagaaggtaggggtggcctctatgaagcaggtatgagaaaagctccatgaagttatgattacattt

SEQ ID NO: 14134 - DNA, 480 bp, Homo sapiens
aaaccatggtgaacttgggtctgtcccgggtggacgacgccgtggctgccaagcacccggtgagwaggccggtctgggacgcgggcctcaaaccccagaagctgacctgagcgaggcgtggggccgggcgtgggggtgccctcgtcagggaagagtggcggaggctgggggcactctcttgctaaggggctcagggcgtccgggtgggcatagtgaggtgggacgtgtccaagcgcccagggtctcactcctccacagccagggtgtgcccagaggagggacaggagaggcggtgaaggaagagggcaggggatcgagccttcacccgcctttgccaccccagggactcggggagtatgccgcatgccagtcacgccttcatgaagggcgttttcaccttcgtcacaggcaccggcatggcctttggcttgcagatgttcattcagaggaagtttccataccctttgcagtggagcctcc

SEQ ID NO: 14135 - DNA, 449 bp, Homo sapiens
attacctcattgaatgacattaagcctataagattagggattattcccacttgatagatgaagaaaccctggtatagacaaataaattgtccaaaatcaaatagcaaataagtatgctattgtatgccatatcatctctcatgctcatattagcatttgggagaaacagtttatcgcaattacagcatgagsctgggtgcagtggctcacacctataatcccagcagtctgggaggccaaagcaggaggatcacttgagcccaggagttcaagaccagcctgggcaacatagggggactccatctctacaaaaactttttttaaaaaagaaattagtttggtgtggtagcatgcgcctgtggttctagctacttgggaagctacggtgggaggatcatttgaatccgggaggttgaggctgtggtgagccatggtcatgccattgcatt

SEQ ID NO: 14136 - DNA, 438 bp, Homo sapiens
tttgtatcaatttattaaaaaaatctctaatcctctgtaaattggtgaaacattatggactctggaaaacactacctacttggctaatttctttttcccctaatagtctactgcaatgtgatggccccttattaatttattaaccatgagagtcctattaaaggacagagtattatagctggaggggatcttagggattcctctagccccactttatagttaagcaaactgaggatcacaaaggcattgccctcacaatctcagggcagtggctgggaatggagctcagagatcttcactctagactcagaagacccttcaaggagaaccagtctaatgtgcttgaggggagaccatgggggctcctagggacctgcgaagagccagagtgggagatggtgagttgaggagaatgacacctcagcctccawcctccag

SEQ ID NO: 14137 - DNA, 181 bp, Homo sapiens
catgttctctttgctgctaaattaacttatcactgcattcatattaaatttccttgaggaatttccctttcactgtgtcatttttatatttttttattagtaccttttctctcaaaagctaattctctttgaaagcaatgtcttccagtccaggctcttcgtaattttttttttttttttg

SEQ ID NO: 14138 - DNA, 472 bp, Homo sapiens
  misc_feature 430: n=a, g, c or t
aaattatttcaatcattgtaagttaatttgtattctttctaaatatataggttgtaattaggggtgtattagtggtcctaaaccctggaccagcattggaaacatttctaatgtttaacacatttggagactctataactcactaggtgggaagtggggcttagaagcttgcttattaagaggcgggcatggtggcagtggttctcatcggtagacccagcattttgggaggtcgaggcgggctgatcacttgaggtcgggagttcgagaccagtctggccagcatggtgaaacctgtttctactaagaatacaaaaattaaggctgggcgcggtggctcatgcctgtggtcccagcacttcgggaggccgaggcgggtggatcatgaggtcaggagttcgagaccagcctggccaggagggtgaaactngtctctactaaaaatacaaaaattagcttcctgcagtggcgg

SEQ ID NO: 14139 - DNA, 444 bp, Homo sapiens
actttggtcgtgggcgcgtgtgtggaatgggaggaggtcgcgctgtccatgggcgtccttggcctgcgccacccagagatgataaatagccaaagacgtcaatggcacccatggacatagtaagcatagtaggagctgaaaaactagaagcaatgacaatgtcaactattttgagcaaaaagaagcagtgtcttcggaacatttgatcataaaaccagaaattaaaggatgagaaaaacatttttctgaagcttatactttcacatttcctagagagcatatttgtgtggatgggggtgggtaaacactcaacaaaagtttctttaaaaagaagaaaccatcctggtttgatgtaatcaatggttgcccactgctcccttcctgtgcctgtgacccttcccaaactgccctgttgcttgcaggctcgcctgagctgaaaggcag

SEQ ID NO: 14140 - DNA, 236 bp, Homo sapiens
ttaggcttttggtctagataacctctgtcgtagtgacacagtggtgccatcgtagcctaaaagcttatgtagacaatggataaatcaatggacctggttttattccagtaaaacttaatttatacagtcagagggccagatttggccttggtctatagttggccaaccctgtttagagcagtcaaaatttattccctggggctgggccaactttttcttraaaaaaaaaaaaaaaa

SEQ ID NO: 14141 - DNA, 478 bp, Homo sapiens
ttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccgtgacccaacagtgttcccatgctgtttcttgtgaaatgctctcggctatgtagcagcttttgattccctgcataccctaggctgctgccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttgggtcacaataaagagtc

SEQ ID NO: 14142 - DNA, 52 bp, Homo sapiens
ttcagtgtgaggcgacaggctgaggccagggggacacagaggaatagacaca

SEQ ID NO: 14143 - DNA, 439 bp, Homo sapiens
  misc_feature 327: n=a, g, c or t
aaccatggtgaacttgggtctgtcccgggtggacgacgccgtggctgccaagcacccggcaccggcatggcctttggcttgcagatgttcattcagaggaagtttccataccctttgcagtggagcctcctagtggccgtggttgcaggctctgtggtcagctacggggtgacagagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatnscccctgaccccaggccgaccctccccacaccctagggtascccagtcgtatsctctgtccgcatgtgtggccaggcctgacaaacacctgcagatggctggtgcccaacct

SEQ ID NO: 14144 - DNA, 316 bp, Homo sapiens
gacggggccgggcgacctgggcaccacaggacccgaggccaggagccaggggcccagaagattgagcttctagagcctcagagatggaattcgccgttttgccgcgatttggcgttaacttattgacccatggggaggagggtcacttcccgtgaaaagaaggcagagatgttttgctgtgcccagtgtgaggaagcgaaggaaaagaaagatcttttgaaaatgtgtacatctacttgcagcttgaaaattccaagtgccagacatttttcttggaggaaataaatgtcttcaatttaaaaaaaaaaaaaaaaag

SEQ ID NO: 14145 - DNA, 509 bp, Homo sapiens
tttgctcatctgtcagcgtatttggtctttatctgactgcatactgcctatactactctctcctaccagaagctacagccactggtgacaggaacagagctctcatgagggtaaagtccctggctagtacagctacacaggtagctccctcgcagccaatgagctgagccatgtgatgtccaatttgaagtcagtcacagccaggcctatgctctcagccagcagtgccactcccatgggagacaggggtgctggggcaaggccagggctagggtcaggccaggcaggccccaggtaggacaagaccaggcccggctcaccttgttcatgccagacctcccaggcactgacctctaattcttaagaaagtgcctagtacagaccagcctggccaatatggtgaaacccgtctctactgaaaataaaaaaaattagctgggtacagtggcaggcacctgtaatcacagctacttgggagactgaggcaggagaatcactttgaacccggg

SEQ ID NO: 14146 - DNA, 497 bp, Homo sapiens
tgatgttctaattctgtgaattatcccaataatgtacttgtagcatgttttttttttcactccattccacgatccagtccaggatcacatgttttacatattgcatttaatgattatgtctcctcagcagggtgatcaagtcatcaattcagaataaccctgttttcccagaccttctccattttagcactgaaagtcctgcatcctgggaaactactcagtcctaggtgaatgggtgaagagttggttatgctactcttcagtctcctttaatctggaaccgttggctcagcctttcaatgttatgtcttttataacattgccatttttaaagaaatcaagtcagatactttattgaacatccctcaacttgatattacctgatattctcccaggttatgcatttctggttggaatactacattagtgattttgtgtcctttttgaagtatcacagctggaggcacagatgtccatctgtcctgcattgggtaacg

SEQ ID NO: 14147 - DNA, 67 bp, Homo sapiens
atatatacctaggagcaggattgttcgaccatatggtaatttctgtgtttatctttttttttttttt

SEQ ID NO: 14148 - DNA, 291 bp, Homo sapiens
  misc_feature 215,222,233: n=a, g, c or t
ccaaagatagtatttccaaactgttatatacccatctactcccaacatggatataagttttttaaaaaaatagttgtatataacatacatatctgccccagtgttacttcacaggcctatgccctacgggaactccactctcccagccccactttacccagstggttgggargaccagagcctgtctcarggaattgcctgctggggtgatgcanggaggangggaggtkcanggaagawgggccggcctcagctgtsaccagcacttttkaccaagtcctgctactccgg

SEQ ID NO: 14149 - DNA, 100 bp, Homo sapiens
tacttttagacttggggttctattttgctttaaaacatgtacatcagttttgttttttgttttgttcttttctttccttttttttttttttttttwaaag

SEQ ID NO: 14150 - DNA, 471 bp, Homo sapiens
aaaatttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataaagcttg

SEQ ID NO: 14151 - DNA, 456 bp, Homo sapiens
ttagggagtcccctcttaggacaggcactgcccagcatcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacgcagcctgcaaagcacagggccaccgccacaccccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcagggggagaggctcttgagacct

SEQ ID NO: 14152 - DNA, 406 bp, Homo sapiens
aatttctatgattcaacaccgccttcaccagctcctctatcaaaccttgagatggagtctcacgctgtcacccaggctggagtscagtsgcgcgatctcgactcactgcaagctccgcctcattcacatcattctcttgcctcagcctcccgagtagctgggactacaggcgcsccataccaggcccggctaattttttttttgtatttttagtacagacggggtttcgctgtgttagcsaggaaggtctggatctcctgacctcgtgatcagcgcgsatsagcttcccaaagtgctgggattamacgtgtgagccactgagcctggccaacatggcgaaaccccacctctactaaaaattaaaaaattgcccaggtgtggtggtgtgmacctgtaatcccaggct

SEQ ID NO: 14153 - DNA, 443 bp, Homo sapiens
ctaaaaatacaaaaattaactgggcatggtggtgcacgcctgtaatcccagctactcgggaggctgaggcacgagaatcgcttggacctgggaggcaaaggttgtagcgaggcggaggttgagtgagccaagatcgcaccactgcactccagcctgggcagcagagtgagactccgtctctaaataaataaataagagatgggaaaaacacacacacacgcgccactgtgttttggggccttctgcagcctcagtctcaaggggcctccttcggtcagcttggactggcttctggcctcagaaacctcagggcccatcaaagtccggaagcagcaatgggtaggtctgaccagggctgtggctgtaaactacactggaggagcctggccctcaggaagaccagagatgcagtctgcagcagtaggagaagggaggaaggaaaa

SEQ ID NO: 14154 - DNA, 328 bp, Homo sapiens
gttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatmttgatgtcctaacactgggtctgc

SEQ ID NO: 14155 - DNA, 267 bp, Homo sapiens
cataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaacttgtaactaggtgtttatggaataaaggagaatggaaaaaagaaaaaaaaaaaaaaaaaaaaaaaaaaaaaaaaaaaaa

SEQ ID NO: 14156 - DNA, 333 bp, Homo sapiens
tttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatgaaaaa

SEQ ID NO: 14157 - DNA, 503 bp, Homo sapiens
aaatctggcatctttagaaatcttgctggtgctaaagagagaggaaataattttttatacagaaggcatgtctcaagtgaaaccaaaacaccaaagcacatdccttcagtgtatattcacatggggtaaatatgatgctgagtaatgtgcacaaaggaaactcttgacaaaaacacagtcatcttttgagtatgttaggtcatttgttatttcatttgaaaataacctggctggggcgtggtggctcacacctgtaatcacagcattttgggaggccaaggtgggtggatcacctgaggtcaggagttcagaccagcctgggcaatgtggtgaaacccatctctactaaaaatacaaaaattagctgggtgtggtggtgggtgcctgtaatcccagctacttgggaggccaaggcatgagaatcacttgaacctggcaggtggaagttgcagtgcactgagattgggccactgcagtccagcctggacgattgagttgagact

SEQ ID NO: 14158 - DNA, 460 bp, Homo sapiens
ttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggccacatgctgacacagactcactcagagacccttagacactggaccaggcctcctctcagccttctctttgtccagatttcc

SEQ ID NO: 14159 - DNA, 354 bp, Homo sapiens
  misc_feature 12: n=a, g, c or t
actggaggcttnggcccgccgaaagtgggcttctgggccatctcgcatattctcaacggctgtgcgtgtccttaaaagtccctgggaagcggccgggcgcgtggctcacccctgtaatcccagcagtttgggasgccgaggcgggtgcatcatctaaggtcaagagttcgagacaagtctggccaagatggtgaaaccccgtctctacgaaaaatacaaaaattagccgggcgtggttgctcatgcctgtaatctcagctactcgggaggctgagacaggagaattgcttgaacccgggaggcggaggttscagtgacccgagatctcgccaccgcactccagccagggcgaca

SEQ ID NO: 14160 - DNA, 147 bp, Homo sapiens
ctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggact

SEQ ID NO: 14161 - DNA, 337 bp, Homo sapiens
tggtttcatgtcctagtaggaagtgcattctccatcctcatcctctgccctcccaggaagtcagtgattgtstttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgkgtgwacgkgtctgtgcgtgcaacataaaaatacagtagcacctaaggagcttgaatcttggttcctgtaaaatttcaaattgatgtggtattaataaaa

SEQ ID NO: 14162 - DNA, 69 bp, Homo sapiens
aaaaaaaaaaaaaasytysysggscsgtttttttttttttttttwwttttttttttttttttttttttt

SEQ ID NO: 14163 - DNA, 472 bp, Homo sapiens
  misc_feature 403: n=a, g, c or t
aagaattaagaagtgaaagatctctacaattaaaactaaaacattgaagaaagaaatcaaagagaacacagaaaaacagaaagatattcaatgtttacagattgaaagactcaattattgttaaaacatccatgctacccaaagcaatctgcagattcaatgcaatccctatcaaagtaacaataacattcttcatagaaatagaaaaataatcctaaaatttatatagaatcacaaagtcccagaatagccaaagaggatagcccacaaaagacctacaggctgggcgtggtggctcgtgcctgtaatcccagcacttttggaggctgaggtaggcagatcacttgaggtcaggagttcaagaccagcctggccgacatagtgaaaccccgtctctactaanaatacaaaaattagctgggcatgggggcacacacctgtaatcccagttactcgggaggctgtggcacaa

SEQ ID NO: 14164 - DNA, 461 bp, Homo sapiens
agtagattaattccatccatcacaggcaggctgagccttcttcccctctctggactgcctggccaaccccagagagaaggagcatcatggctcacctgggcctagtactggatctgggaacaatggataaagttcttgyttgggsmggatttaatgaatgaccttgagcagatgtgggtgcctaaatgctgtgaaatgaacatgtatttctgkcatatggggataaacatgtggacatgtatttaaggttttgtatctgtgcagcttctatgcacacaaacatcaaagtctattggatggatagccacggtggctcaagcctgtaatcccagcacttgggargccgargcgggargatcacttragcccaggagttcgggamcagctggggcaacatggtgacactgtctctacaaaraaataagaaattakccaggcacggtggtacatccctgtggtcc

SEQ ID NO: 14165 - DNA, 543 bp, Homo sapiens
tataatcccagcactttgggagtgtgaggtgggaggctcacttgagcccagtagtttgagactagtctagtcaacatagaccttgtttctaccaaaaatacaaaaattagccgggcatggtggtgcatgcctgtggtcctggctatttaggaggctgaggtggatcacttgagcctgggatgtctaggctataatgagctgtgatcatgccatcgcactccagcctgggcaacagaccaagacttggtctgaaaaaaacgaaaccatttgatgtcacatgtgaaaaaagacctacaagtgaagtaggtgggccaaaagacatgcacatttaaaaatgtgctaactatactagctaaaacctgtgcttaatatatgccagaaactgctctggtgctgttaatggagcctgctaaacaaaactgcttctcaacaatagaagttgtactacgctatggagtggacactccatagcaatgaaatgttttggagtgcctgtttcctcatctcagcaacataatagttctcaaacttcttagtctttgt

SEQ ID NO: 14166 - DNA, 424 bp, Homo sapiens
ccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgasarcagcgatgacctctggggtcactgtcccaggagggacttcacctggaacaagarctggaggcagccgcttgcccaggaggcttgtcccctgargcgcttcgccagtraagtrcgggctcagggcctcgagtctctc

SEQ ID NO: 14167 - DNA, 538 bp, Homo sapiens
aacaaaaaaacaaaaaaaaaaaaattagaaacgagactgcatactgtaacatacaacttttatgaaactctaaaatagtcaaaattaatttatggtgatagaagttagaaaagtgggccgggcacggtggctcatgcctgtaatcctagcactttgggaggctgaggcgggtggatcacttgaggccaggagttccagaccaacctggccaacatggtgaaaccttgtctctactaaaaaatacaaaaattagccgatcatggtggcaggcgcctgtaaccccagctactcaggacgctgagtcaggagaatcacttgaacctgggagggaggcagaggttgcagagagctgarattgcactccagcctgggcaacagagtgagactccatctcaaaaaaaaaaagttagaaaagtggttacctgtaggtaggcacagattggaggggcaagagggagacttctgaggtactggaaatattgtgtcttcttatctgggtcatagttatgtgaatctatccgtctatccatatgtaaaa

SEQ ID NO: 14168 - DNA, 372 bp, Homo sapiens
  misc_feature 92: n=a, g, c or t
tccttgaaaaccactctgatgtcacaactgagtgtctgttccgtttcagatacccagggctgctgcccagttctgtaaacgcagcccagmtnaagctctgctgtctcaagtgtgcatttatacccaggtgatttggacggagcagctaccatggcgtggacgccttcactgaactccgggctgcagtgcagggagctcagagcagtgctgctaccaaacagtatttaactttgaacaactgtgtcaggcaatggatttgaattttaagtgtattaatagctgtgctctgtgtcgtaggcaaaattccactgaaggagcctctgtgccctgcagccggcagcgcggctkaagcatgtgttggccaaggaatgc

SEQ ID NO: 14169 - DNA, 392 bp, Homo sapiens
catctagactttgagttccctgcatctgccaccgtagtttctagcaggagtagtggggggagtaatacagattcttccctagaaggggacactggtaacatgtcccactcttggattagcargggtgggtccaggaagatgatatttgcgtcttttgcccacccccctggcattcagctggacccaactaggscatcatgagtggcttctccctgtcatccccaggggtcataggatatctacaccgcctttctgaccccaccctgcactcccatcctttcctctctccccgttcatgccctgcactacatagcacagccgggatgcttggaacagaggscttggctgctccgcagtgcacagggcttccctctctcggggttggcttcttc

SEQ ID NO: 14170 - DNA, 347 bp, Homo sapiens
cttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgarggggtcaaccttggaccaaagttgccttaagcctgtggtaaaarggcttcagggaaggtaagtgggccacctgccggaagctgccagctgcccggctggcaatggtgtkagtgtcttggccctgtccctgccctggggtccarcargtcatccctcccttcttctctctcctttggcgtttgttcctgtagtcac

SEQ ID NO: 14171 - DNA, 448 bp, Homo sapiens
atttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcag

SEQ ID NO: 14172 - DNA, 106 bp, Homo sapiens
aaaaaaaagcaaaggagtctaaaaagcatgaaaagcttgagaaaccagagaaggagaagaammmaaagatgragaatgagaacgcagacaagttacttaagagtgw

SEQ ID NO: 14173 - DNA, 487 bp, Homo sapiens
cagaaggggacatcctcaccgctgagctgtgagctccctagaataaagatggaagctttctggtttcccattgaggctgaaasctctttcatagcaaggactatcctgtctctttctagtatgacatctggcccacagtagcccctcaagtggagatttgaatgaccaggtccacctaaaccagatggccctggcatctggagagttcgaggccattttagctggagagttcgagctggagagttcgaggccattttaggtaagctcaagtctttacaactctgcaccttctaccagtccttcctatctgtttcttttggatgaagatgattcttcttttcctaactctgaggttgccctctttcatgtgcattcacattaactgtcagccatacctgtgtacctcaacactcactggttgctgcctgtaatactcttacaaaagatttaatgaaagtgatggagaccttgggtgtctagcaactgc

SEQ ID NO: 14174 - DNA, 491 bp, Homo sapiens
tttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagcwgctctgactagcaatatatagattcatttaatgtgttaacattggttaataaatgtatttaararrdacartgadraaaraaaaaa

SEQ ID NO: 14175 - DNA, 600 bp, Homo sapiens
cttgtatctatcaccagatgctcttgtatctagtacctgcttggcatacagtagatagaaagctttgctgagtgaatagctctgcctttcgtcttttttgatatgtgtacatcttttaaaaaataatgaatagactttgttttagagctgttttggtttacagcaaaactaagcagaaagaaaatatccccttccacaaacatcctggactgtacagcctcccctaccatcaacatcctgcattactgtggaatatttgtcacacctgataaaccaacatagattcatggttacaaaaatgaaccaatatggataaaacatatacattatcagccaaagtccggagtttgttaggttttgctctttgtgtatattcaagatacatttgacaaatgtatagagatgtacccaacactgtaacgtcagactccactgccctaaaaatcccttgtgcctcacctatccatccctccttccctgcaaatccctggcagccgctgatcttttttactatctccgtagtttttccttttccagaatgtcacatagttggaatcatgcattatgtagtcttctcagattggcttctttcacttagat

SEQ ID NO: 14176 - DNA, 77 bp, Homo sapiens
aaaaaaaaaaaaaaaaaaaaaaaaaaaaaaaaaaaaaaaaaaaaaaaaaaaaaaaaaaaargaaaaaaaaaaaaaaa

SEQ ID NO: 14177 - DNA, 529 bp, Homo sapiens
agtccatctcaaatcttcaccggctgtaccaagaacaaaaaaaaaaaaggaatttgagacgggatctcagcatgtttgccaggatggtctcagtctcttgacctcgtgatccgcctaccttggcctcccaaagtgttggaattacaggtgtgagccactgcgcccagccatcagaacaaaatatacagctggatgtttgtcacaattctaatgtccctgcaaagatgagatgcatgaatcacacagcaatctcatcaaaaagttgaggaagagaaagagtgctgccccacgctgcctgatttacaacgtgaagtgaaatctttgaaaagaaaaataagacaatgtcactcaagctcttatctgaggatttcctgggtttgaagacagagctcaaactcatacaaggggtcatctgagtctgcagataggcttgctttatgctgctccgtcagatctcttctaaagattagtgcgcaaattctggacattacattttaatggtaacatggattcaactaaagggtaagca

SEQ ID NO: 14178 - DNA, 564 bp, Homo sapiens
ataataataataaaaatactaagtatatttcttggtttctagggttaattttttttcatcttcctctcattaatttaccacttttatcactaagataccttaagtttctttattccttggattggtagtatagtgaaatgattagggcagggctttgaagccagagagtcctgggttcaaatcctggtgtggactctatctttttggggtaagaacctttaaattctctgactttctagtgtcttttaaatgggtgaaataacccttactttatggaatgttgcaaagatgagagaggatgtatgtaaaatgttaacctattacagagcttgatatggagtagacgaattctaaaattacattgagccattttgcctatagtggtgttagaatagaaaagtatactcatacattagaattgtgcacctagagctaagtgattccagccctgtggaacccgtcaatgccagaatggcatgtaggactagatagatgaatgtcacctgaccctgattgtctattaaaactcaatgtatggccagatgcagtggctcacgcctgtaa

SEQ ID NO: 14179 - DNA, 498 bp, Homo sapiens
tagaagaaaagctccatgacattcatctgggcaataattttttggatacaaatccaaaaacacaggcaacaaaaacaaacattgacaaatgggattacaccaaactaaaaatctcttgcacggccaagaacacaaacaacaaagtgaagagacaacctgtctgcaaatcatacatccgataaggggttaataaaaaaaaaaaaaaaaaaaaaagaaactcaactcagcaatgagaaaacaaagaactcaatttaaaaattggcaaaggatctgagtagacatttctccaaagaagacataaaaatwtccaacaggtatatgaaaaagtgccccaaatcaaaaatcacagtgrgatatcacctcacgcctgttagaatgactgttatcaaaaacacaaaagataacacgtgttggtgaggatktggagaaaaggaaacccttgcacattgttggtgggaatgtaaattrgtacagsccttgtgaaaaacagtatggaga

SEQ ID NO: 14180 - DNA, 301 bp, Homo sapiens
cctccctgctctccacctacccagctgtgttcattgagttacatttcagtattttgtggtttattttcatcaaggggtacacaagaagcagctttatgcaattaatttttttgttctgtttattgtagtcatcctcaaatgtcactgtgtaaagtgttgttgttgtttttaaattcaactgtcctgcagtaacataacatttgagaaacagagacaatgtaataagttttcataaagctaaattaatgtagagaaatttttatcatgaaatgctatcttttcaattgagggaaaaaaaaaa

SEQ ID NO: 14181 - DNA, 439 bp, Homo sapiens
caaaataagggcgttatttctactgagtggaagggctcagggtgcagtgttttggtgatatctaatgttttatcccctaagttttgtgagtcttgggcgtgatgtatccacacatagataggtcatcatgacactggaggacatcaaaggcagagaaacgtgtagagctgctagagagaaatgactggctaagcatgaagggatgataatttgacaacagatctctcattagtagcaatagatgccagaagagcttgtaatgcatctttgagctgctaaggggactgcactgtgacgtgcatgtggacaggctgcaccaggtccgggggtgcgatggccactgcagtgggttcctctccccaccccagaaaattcagttaccaaaactgactcaagaacagagaacagaatcagatcagtaacaatggaaggatctggg

SEQ ID NO: 14182 - DNA, 203 bp, Homo sapiens
agggaagagtcgcgcccccggggagggagcagcactggcccattctgcagatggggacatcgagtcacgggctggctacgaactcctcgggggcgaaggtggcggagagggatgggttccaggacgtcctggcgcccggggaaggctcggcgggacggatttgcggtgcgcascagtgccgttcgtccctcaggtgcttggcg

SEQ ID NO: 14183 - DNA, 436 bp, Homo sapiens
cgaaaatcatcacaggttatccattacgccgaccctggctgcagagggcctgccacaggcaccactcacaccacaagcagactggtacagtttcgggaatttctgtggactggttgtccagctgggggtaacttgaaaccagccccggtggagtattcacaccacgcgcatgtgcaaaacacgcaccccaggcttcccctcactaggtccggctgctaaacactgcgccasgcaccataggysagggactcagagcggcctgggagaggccggccctccaagggcgggagggcaggtggggtctgggccccgggtgggaaggctggcagcaggatgtaccctgcctgtgtcagtcactgctcccccaagaggacttgggagctaagcagggaggtggcctggctccagtcctgctgcatccccaggcctcagccct

SEQ ID NO: 14184 - DNA, 413 bp, Homo sapiens
aagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggtctgtcctcaggggtcgaggcggctgcgctggggcctcggccgggaggaggcggggggcacggcctttccattttccctgctcccctctgcagaagcctcatagggcccggcgcggcggctcacgctgtcattcccagcgctttgggcggattgggtaggaggattacttgaggccaggagttcaagaccaggcagggcaacatagggagacccccccccaaccatctctaatggaaa

SEQ ID NO: 14185 - DNA, 483 bp, Homo sapiens
cattttgtaaataattgaatcaaataacaatggggcggggaagaagccatatatttttcctctctttttagaaatgaattgaaggccagacatgctggttcacatgtaatcccagcactttgagaggccaagcgggagaattgtttaagcccaagagtttgagaccagcctgtgcaacataggaaaaccctgtctctacaaaagaatttaaaaacagctgagtcagctgggcgccgtggctcacgcttgtaatcccagcactttcggaggctgaggtggatggatcataaggtcaggagttcgagaccagcctggccaacatggtgaaaccccgtctctgctaggaagacaaaaattagccaggagtggtggcggacgctgtagtcccagctactcaggaggatgaggcaggagatctgcttgaacccgggaggcggaggttgcagtgagtcgaatcgcaccagtacacttcagcctgggcga

SEQ ID NO: 14186 - DNA, 391 bp, Homo sapiens
tgtaagacctgcaaattcgttatttttcacaattgttttggccattttaggtcctttgcatttccacatacatttttagaatcaacttgtcaattttaacaacaacaacaacaacaacaaaactcctggaactttgactgggattgtattgaacttctagatcaatctggggagaactggcatcttaacagtaatgattcttccaatctatgaacacagtatatctctccaactttttaggtcttaattttgttaaattgtttgtagttttcagtgttctggtcttgtacctgttttgttaaatttaaaaaattcccactttgggaggctgaggcgggcagatcacgaggtcaggagttcgagactaggctggccaaaatggtgaagcccc

SEQ ID NO: 14187 - DNA, 468 bp, Homo sapiens
aataaaaagaagatggaatcctaatgcaatgtgtttgtttttgtggcttgtgctggagtgacaagaaaagttccttttgtttttgtataacagactctattactaaattggagagtcataagatgacttttgaaaaagctgtttacagatcagatttatagatattctgggcaaattagcctttggtgtgacttttgttaacttgaaagaactttcaggccaggtgtggtggctcatgcctataattctagcactttgggaggccagtgcaggaggattacttgagcccaggagttcaagaccaacctgggaaacatggcgaatctgtctctacaaaaaataaaaaaattagccaggcatggtagtatgtgcctgtgtcctagctactcaggaagctgaggtgggaggatcgctggagccccagaagttgaggctgcagtgagccgagattacaccactgcactccaa

SEQ ID NO: 14188 - DNA, 261 bp, Homo sapiens
cattgtcccagactcgaagccgaggctccactaatctctttagtaaattaacttcaaaactcacaaggaggcttccaactgaatatgagaggaacggggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataac

SEQ ID NO: 14189 - DNA, 74 bp, Homo sapiens
catccgatgagaaattacaaggcaggcaaagagtcaggaaaaaaataacccataacaagggggaaaaaaaaatc

SEQ ID NO: 14190 - DNA, 323 bp, Homo sapiens
atacaaaaattagssgggcgtggtggcggccgctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgcsgccgcagtggccaagttgcgacactgcccacggcccctccctctgatgcagattcagggcttctcttcgatcatgttgggttttgattct

SEQ ID NO: 14191 - DNA, 453 bp, Homo sapiens
accgacgaccccgacgtctgggtgcgcmgcggccctgcgcccgcgacgcccaccgcaagagatttgctctgtggccatcatctccggcgggcagggctaccgcaactttggcagcgctctgggcagcattgggaggcaggccccgtgtggggagacggacagcaccctcctcatctggcaggtgcccttgatgctatagcgcctcccctctcccctcagagggcacagctgcaggcctgaccaaggcacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaa

SEQ ID NO: 14192 - DNA, 489 bp, Homo sapiens
acatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtgtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaa

SEQ ID NO: 14193 - DNA, 441 bp, Homo sapiens
agatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcagcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagagccccacgggagccaggatgggactggtcgtgtttgtgcttttctccaa

SEQ ID NO: 14194 - DNA, 497 bp, Homo sapiens
gttgttgttgagctgcaagatgaagaggttgacsagcggggagagcaacccccggggcagctcagtgaccttgttgtggtccaggtagaggttgcttatggaaccacagagaacagtcccatgacattcgcgcacttccctcaggacactgtggagcagaaggcagaaagcgtgggcagaattatgcctcacacggagagatgtcgccacaatgaatgagcagggcttctgcaagatcgtgggccgctctaaggatatgatcatccggggtggtgagaacatctaccccgcagagctcgaggacttctttcacacacacccgaagtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaacta

SEQ ID NO: 14195 - DNA, 180 bp, Homo sapiens
tactgaaaaatagaaacttagccgggcatggtggcgcatgctgtaatctcagctactcaggacgctgaggcaggagaatcacttgaacccgggaggtggaggttgcggtgagccgagatcgtgccattgcactccatcctgtgcacaagagtgaaactccgtctcaaaaaaaaaaaaaaa

SEQ ID NO: 14196 - DNA, 452 bp, Homo sapiens
atttatttaattaagaggctataaataatatatacactactgtatggtatttaacaaataagttttaaatctgttaattcttctggaaaactttggatgtagggatggcaagctaattttcttgtatagctggtgatataagcagcatggtcataaaataasatttcttataaagamtaactggtaatagttgtgacagaacctggttttcctgactgagaatcccttscttgcttagaatatctgasttcccattgaaatggaacatagaaaatgtgttttcttatgtgactctcattattggttcstttatsttagttgtgctacaatataaggctggacctgtaatacactatgtatcagactagactgaaaaatgtgatcgatttgttttctaagtcctccatctatataactgaaccatggtcaggggattagagagcaacagagca

SEQ ID NO: 14197 - DNA, 474 bp, Homo sapiens
ttatcattttctttttcttttccccccacttattcctctacccccttgaagttagcttgcagccccaccactctgttgcaactactgctgtagttcctctgctctcccaattgccaaaccaagtagatatttttcagttcatttctcatcaagtttctctaagtcaattgccagtgwatccctctcaaaaacctttccatctttgcatgaggtcgtacactctttcttttcctttccccccacccttcctttgacctggggttcccaggatcccattctccattcctgctttcctcactctgtgtgtcttccaagactgacttgtgcattcttattttaattaccacctgtttgctgaaasccctaaatttatatagaaatccatcttaacctcttctgcaaagcttggaaaccccaatatttattggaaattcccaactgagtatcccatgggtttataaaattcttcatatc

SEQ ID NO: 14198 - DNA, 353 bp, Homo sapiens
tagacagatccccgttcctgacatcacagcagcctccaacacaaggctccaagacctaggctcatggacgagatgggaaggcacagggagaagggataaccctacacccagacccccctggacatgctgactgtcctctcccctccagcctttggccttggcttttstagcctatttacctgacaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagtaaaa

SEQ ID NO: 14199 - DNA, 444 bp, Homo sapiens
  misc_feature 324,392,430: n=a, g, c or t
ctgtttgtgggagaagtttccgattttacctgcagctgagtcaatttggagagccgagtgaaatacaggggtagaggaagcagcagaaaggtcctgggagctcactgggtccccaagcagcccattcctgcctggcaccacagggatccaacaggagaggagcagggggtaaaactccacagggagaaggaaatctctagctgaactctaacaatttgaacagggtgagaagcctcttggccagaactcgggggagggtgcaaatctggtgtgcagactccacaagtggtggaagaaccaagccctttcttttgcagctggtangtgggtagtctggggcaggttttcaagcctctgtggctctccacctggaaatggactgggggctgttnggggcagcacgttgggagtgagacagccctttggtttncgtgggagctgggt

SEQ ID NO: 14200 - DNA, 390 bp, Homo sapiens
tttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaagrtgagcaagtcacttgaggtcgtgagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgact

SEQ ID NO: 14201 - DNA, 317 bp, Homo sapiens
  misc_feature 188,288: n=a, g, c or t
caggctttctgacttccatccccaaaacacatttaccagcatactccaaactgtttctgatgtgttccatgagaaaaggattgtttgctcaaaaagcttggaaaatactacacactccmtttctscttstggagatcaacccacattagagtgtctaaggactmctgagaattcctgtwwacagtaancaaaactaacgtaatctaccatttcctacactatttgagcatggaaatcatagtccccactctgtgagaaacttaacgctttttggagacatttctgtanatgtcagtttggagaaatgatgagctacg

SEQ ID NO: 14202 - DNA, 145 bp, Homo sapiens
  misc_feature 25: n=a, g, c or t
agcagtcctctctggggagcctgangcaaacatggatcaagaaactgtaggcaatgttgtcctgttggccatcgtcaccctcatcagcgtggtccagaatggattctttgcccataaagtggagcacgaaagcaggacccagaat

SEQ ID NO: 14203 - DNA, 275 bp, Homo sapiens
agagttgtaaggatggaaacaaacacttctgtttctgaaccagagtgggttctcagagtcttggctttctttctgcagcctgtmtgcctcctaagcagctgagattgtttccccactacagatgagtgataagctgactgcaccctcacggataattctatcaactcctgggaccatagcatagagggtgcttaagacatgctgcactggacgatgcacacaccccatctctccaacatgactaggccaccaggatgcatcasagtcctgacccc

SEQ ID NO: 14204 - DNA, 200 bp, Homo sapiens
  misc_feature 43: n=a, g, c or t
tttgcttgactgcttcctcctaaccctctasccactagcackntacttcctaaagctgttgtgtcattaactctgttggatcaactctctgggaaaagattctgttaatgtaagtgcacttactccctggatgttgtcactagtctagtggcttttgctaaataaacctttcttatttctagaaaaaaaaaaaaaaaaaa

SEQ ID NO: 14205 - DNA, 484 bp, Homo sapiens
tatgtttagatatgttaagatacacaaaacttaccattttgttgcagttgtctacagtattcagtacagtaatatgctgtacaggcttgtagcctaggatcaatagactctaccgtatagcctgagggtattgtaggctataccatccaggtttatgtaagtacactctatgattatgcaaccacaaaatcacctaagaatgcatttctcagaatgtatccccatcgttaagtaaggtatgtggaaatgaagagaggggcattttaggtagtgggaacagtctgagaaaaggcaaagatgtggaaaagcttaataatgacactttatggggaatggtaaatcatgctatagaaaagactctagtctctagacaaagtctagtttaccagtagtatcagagttaagagtttcctgttggggccgggtgcagtggctaatgcctgtaatcccagccttttgagaggctgwgacgggcggatcactt

SEQ ID NO: 14206 - DNA, 434 bp, Homo sapiens
  misc_feature 346: n=a, g, c or t
atagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagnaaaatctacgagcttcttatttacaacactgctgmscccatttmcatcccagactctgacatggatgttcatgcaacttaagtgtgtt

SEQ ID NO: 14207 - DNA, 300 bp, Homo sapiens
atgagaagtttattctgagcaagctcagatatggaaccactgggaatttcctgatgtggaatcactgtggatttgctggtgatgggacttacttgactgggccaaaatgtgaggcatgcactgggaaactagcaggaaactagcacttgaaactcagcctgaagatgctgaaagacatgtatttccagcaccctttagaattgattgagaatagtttaattctctagtggtttaaagcagatacaaattacttaaggaacagctgcagttatgccctaaaaatttaattttttttttttt

SEQ ID NO: 14208 - DNA, 484 bp, Homo sapiens
aaatgatttgataacaggattctagcacaatcaaatgataatcttccgagcctcaatgtaaccattctaaatagatgatswtgttatatggctttcaattaacaagctgggaatcaaaaaagtaaatgaatcacactaatttgattccaaaccaatgtgagccccataataatttttaactagggcaatttcttaaaagtttcctcacacaatgacagcaaagtattttctcaattgtctaatatgatttggggatttgtatataaaatcacgaatgtgctcagaaactataaagacagttcatatgtatgtgacgaggaatgcaaggttttcggtaggtatacagtcacaagttaataattacctacctttctgtgtctgggccatttttggctataatcatctttaattttcctagtcctcccacaggtgctctgtctgtgcccgttgtaactgcaagaagagtcttttctgttcatctgta

SEQ ID NO: 14209 - DNA, 465 bp, Homo sapiens
  misc_feature 461: n=a, g, c or t
gcattgtataaaaacttctctagctgctgtgtcacaaagagactggaaaggggcaaggtgaaggaggagaccagcagagcagccacggccgggacagtgcagaggagggaagatgacacagctgtgagacattttggggaataggtccttctgtcacggggtacaggacccttgaccgcaaaatgacgtgagttaccactgaccattttctgggtcttgatcttgtgactccaaatggatggtacagcttgagcaaagacacagaagcagaaggcaggtttttggttccatgaactctacatctggctacatacaaatggtgaagaggaacagggagaaacatggttgaaaagaacaggcttggacttcaggaagcagtaaaatgagcgaatgccatttatggttacaaagataactcagctgggggccaaacagagactgaaatggagtgggtgargatngagg

SEQ ID NO: 14210 - DNA, 357 bp, Homo sapiens
agaccagagatctagcgactgaagcagcatggccaagccgtgtggggtgcgcctgagcggggaagcccgcaaacaggtggaggtcttcaggcagaatcttttccaggaggtcttcagtttcctcatttgcaagtcttggacccagtgatttccaaaggcccttccagttccatttgtcagacatctcattgagcatattctgtgattcccctcccttgcaatgtaacccacaggctgaggaattcctctacagattcttgccacagaaaatcatatacctgaatcagctcttgcaagaggactccctcaatgtggctgacttgacttccctccggccccactggacatccccatccc

SEQ ID NO: 14211 - DNA, 341 bp, Homo sapiens
acatgcattagaactaaataaaaatgtctatgagagggaaatgttttttataaagatgagattacacggctgggcatagtggttcatgcctgtaatcctagaactttgagaggccaaggcaggtggatcacctgaggtcaagagttcgagaccagcatgactaacatggtgaaaccccatctmtactaaaaatacaaaaattagccaggcatggtggcgcatgctgtaatcccagctacttgggaggctgaggcaggagaatcgcttgaacccaggaggtggaggttgcagtgagccaagatcatgccatcacactccagtctggtgacagagtgagactc

SEQ ID NO: 14212 - DNA, 106 bp, Homo sapiens
atttaaaaagaactctatttgtaaaaacatttatttactgcatggatattgacgcacattaaatttgtgggattttgtatatgtaaaaaaaaaaaaaaaaaaaaaa

SEQ ID NO: 14213 - DNA, 466 bp, Homo sapiens
ctgagaggttgacagtgtgtagatatacttaaagccactagacaggaagagatcactgatggtttcagcaaagatatgaaagagcagtgatctaagggcggagacctgagtcacctaagttttaagaaatgaggagagatgagaaggaaccagaaacagaaactaaaaaagaggagccagtgaggcaaagggagaaccaggagagtttgttgtcaaagaaactaacttaaatatttcaaagaaggaagaagtaagttatcaactgtgtcaaatgttactgataggtcaaataagatgaggattaataattgaccattgtagcctaggcaacatagtgagaccctgtgtctacaaaaaaatatatatattagctggatgtggtggtgcacacttgtggtcccggctacttgggaggctgaggtaggaggatctactcggagcctsggagattcgggctgcagtgagc

SEQ ID NO: 14214 - DNA, 327 bp, Homo sapiens
aatatatctgttattgcatttttatacattaaaagtggaatcatgggctgcgggtggtggctcatgcctgtaatatgaacactttgagaggccaaggtgggaggatcacttgagcccaggagttcgagaccggcctaagcagcatggggagaccctgtctctacaaaacatacaaaattaggtgggtrtggtggcatgcacctgtggtcccagctactggggaggctgaggtgagaggatcgcttgggcctgggaggtgaaggctgcagtgagctgtgattgtgccactgcactgcagcccagaggacaaagtgagaccctgtctct

SEQ ID NO: 14215 - DNA, 458 bp, Homo sapiens
ctacagcttgtaggtgccagagttggggtttggccacaagtaatgttattccaggaccagtgttttatagcacacctaataaggggtatttcaaagactatgctatatctccttaatcaagtccacatattattatgcactagccacacagctcagtgttatagtgggacacaaatcttggggcacacataagaataatctcttgtcctcaaaaattatatctagctttgagaagtagaaggaacacagtagtttcttgcccaaagagaattccagcagtgtttgatgacttccttccatttcatccccagcaaagtgatgcagatgactttctagagtgagtagctgcagtgtttagatagtcctctctaatcacagaatttctttgccatacttttcaccacttctcttaaataacatttggctgcagtttctagagcagttggcacttgaggatc

SEQ ID NO: 14216 - DNA, 494 bp, Homo sapiens
agccccccttttttttattgtacttgttacagatatcttttttcccctctgtagcttgtcttttccctgttagttgtgtcttttgataaataaattcttaattttaatgttgtaatgaaatttaatctttttttctgtatgattagtgctttctgtgagttatgacataaagtcataaagataatctctaatattatcttctaaaagttttattgctttgcctttcacatttagatttcttaagggctaaaattattagataactaggtattagttgattatatgtaattagtaaacaaatatttattgtgacttcagctatgtagaagagtcagtggtagatactaagagatgtaagacttggttcctgccctaaaataatcaacattctgtttgtgtaagtaaggcccttggcatcagcacgatgtaatagaaagaacactgactggactgggcctggtggctgatgcctgtaatcccaagcattttgggag

SEQ ID NO: 14217 - DNA, 466 bp, Homo sapiens
  misc_feature 187,373: n=a, g, c or t
aaatgcaaagattggcctggcgtggtggcgggcacctgtggtcccagctacgcaggaggctggggcaggagaattgcttggacccgggaggcggaggttgcagtgagccgagatcgcgccaatggcactccattcagcttgagtgacagaggtgagactcscatctcaaggtaaaaaaaaaaaatanaaatmagmaastgctatttgagtttasaggagtgagaagtcctctsttgmatggtgagatggggaacatttaattcaatagaaatatttgagaccgggtatggtggctmaggcctgtratcccggsgctttgggaggctragttgggtggatcacctgacatcaggagtttgagactagcctggcnmacatggcaataccctgtctcaaggatacagaawttgcccaggcttggtggtgtatgtctgtggtcccagctactsaggaggctcaggcggga

SEQ ID NO: 14218 - DNA, 462 bp, Homo sapiens
  misc_feature 122: n=a, g, c or t
aaaacattaccgaggtctcatctagttttctctactgccttccaaggtttctactgtacaatttctcattgaaaactgcctcagcattttttaagaagacatcacttcccccttgggaaganaagaactcaatgacttgaagaaactgatgcttcaggtacsttgaaaaattcagmtggttttgatgagaaacagtcaatggggctgttaggggtcctggcggatgcttaggcagtggctgtcctggattccagggaatgccccaaacccagtgatgcaggacccaggactccatctgctcattcttcataaggttggctcacaggtcatctgctgagaaggtcatcttctccgtcttcactgggctcactgaatgaggacattccaagatcccagctcatctcatttgagctttccttttcctaatcccatgcatctgtgtttgagaaaatcttcccaagt

SEQ ID NO: 14219 - DNA, 503 bp, Homo sapiens
  misc_feature 248: n=a, g, c or t
tagaaatgattaaggattccaaagagcttttgtttcagtaggttatacctatcaatatttatcacactaaaaataaaatttattaattcacttacaaaaaatctattacatgtaaggataagtaagatttttgtgaaaagtattaccccaaaaaaggaagagtagcattgttttcaatttacagatctctttaatgtctggcaaaatattaatagaagacagatgaattgtcataggtgtttctgctntaatctcttgtgctattttgttttggttgaagtatttgaagaaaatacagcctctgacagatacatgattaagacgagtacttaatagcatttttagatcattgagggtgttgtgctttaatataacacagctcaacaagtaataaattaacccttcttaaaagttagttgcgggccgggcacagtggctcacacctgtaatcccagcactttaggaggccgaggcaggtgtatcaagagatcaggagttcgagc

SEQ ID NO: 14220 - DNA, 460 bp, Homo sapiens
ctcctaagcaagtatctgttgagcagtctgtctgtctgaacctgtctcagtacctcattctcatctttggttatctttagcttaaacattatcttctttgctgagaacttctggttccagttattcctaaaacaaggaataagtgtcttcagtgtgattacttcagtgtcacagtatggtgcactttctggtaccagaatatgtttttgatacactagacttttagctctctttctttttttaggaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaaggtatgtgaaaaactttgagtagcttgctaatcatggatattatttagtgacatccatgat

SEQ ID NO: 14221 - DNA, 446 bp, Homo sapiens
ttacaaagcttgttgttgaatgttgaatatttgtccaaaggagtttgacaaaatagaagctgcttggtccctgttctgcctgctaggtcataaggatgaaggccatgtggctggggtacttatgtcaagtccagaatggggcagtgtccctctcctacstctctgcggagacgmaattgaaggtcaagtagactcagtgtagggcaggcagctgtcatgctgcaaagaagtttagaggagtctttgggttggggaggtgacaggtaggtaggacaggatctcttaagatgggaaagatactggggagaggagggctgcttggccccagggaactgcagtgaggtggaactgagctccgctcctgaatctccaaaggagcccatgctgcccggcttccctgagtcattttttccagcatcctgtcagatccctcaatgtactgattt

SEQ ID NO: 14222 - DNA, 370 bp, Homo sapiens
gaaacaaggccgggcacgtggctcacgcctgtgatcccgacactttgggaggccaaggcgggaggatcacttgaggccaggcgtctgggacgaccctgggcaacatggggagacccccgtctctacaaaaaaaattttaaaatttgccgcacatggtggcgtgtgcctgtggtcccagctgctagggaggctgacattggaggatcgcctgagcccaaggaggtcgaggctgcagtaagctatgagagctgtgatcgtgccactgcactccagcctgggcaacagagcgagaccctgtctggaaaaaaaaaaaggaaagaaggccgggcktggtggytcamacytgtaatcstagcaytttgggaggccg

SEQ ID NO: 14223 - DNA, 456 bp, Homo sapiens
gaatgtgctagaagtgctcctagtttcttgtaaaggaagccagagttgacagtacaaagggtcgtcggccagccctgcagcttcagcacctgccccacccagagtgggagtcaggtggagccacctgctgggctcccccagaactttgcacacatcttgctatgatattagccgatgtctwtagtgttgagcctctggattctggggtctgggccagtggcatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgscctctgtcctggctctgcacctggtatatgggtcatggaccaagatggggctttccctttgtagccatcc

SEQ ID NO: 14224 - DNA, 475 bp, Homo sapiens
tcttttcggctggaatggggaatttgtgaggtaggccggaagtggtgttgcggagggaagtgtggggagagcagaggcgcastctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccrccacttcaagatgttcttatacaagtcaacagtctagcagatcagccagtctctttcatcatcaagcagacatactcaagaaagaggaatagtgaagtgaaatatacagaagcatgttcaagttcatctgttgaatctggaattgtgaatagtgacaatattgagaaaaatactgactccaa

SEQ ID NO: 14225 - DNA, 312 bp, Homo sapiens
  misc_feature 98: n=a, g, c or t
catataaaattarcatcaataacatcatagttaaaagggggctgggcacactggctcatgsactctgggaggsggtggcaggaggatagattgagcmnaggagtttgagacsagcstggscatcatagagagattctgtctctacaataaaaagaaaaattggctgaacatggtggwgtgsacctgtagtcccaaccacttaggaagctgaggtgggaggattgcttgagcctgggaggtcaagcctgcagtgagccgtgattataccactgcactccagcctgggcaagagggcaaggccgtctcaaaaaa

SEQ ID NO: 14226 - DNA, 457 bp, Homo sapiens
gttggaggaggcgcmstcaacagcccggccgaccgctcctcccagctcgctgcgcggaggaccccacagtccggcggccccgcagcscggctgcctagctcctccctggagaccgaagcccacaagagatgccagtatggggacaagatgtctggaactgtagcagctactttgtaaccaggagacatcaggaatgaagataacaagtcaatacatcaaggatggcagagcagaagaacagagggcatttttcagcagcagaaacagtaccagtgattgccttgtctggctggcttgtcatttgaggaaagacaactatttgtttaagcaatcagcccagttttctgttactggcaactaaaagcaattctaaatgacattgatatggaagggaggcagggaaatgctgggaggagaagggcaggtccctggcgagggttccacccccaggcctgtg

SEQ ID NO: 14227 - DNA, 457 bp, Homo sapiens
tcctctcctgaactcccatcctgtatctcaagccacctgctagcaaatatcacctacatgtcccatgtgattcaaaatcacacatctcatctcccattgcatctgcctacgtacaccacctcagcccaagccatttcctgttcagttctccaagcccacaaacctggcctctcctatgatgtcttctcaggcttatgataaggacacatcctaaggttagattttgctgacatttattaagcatacatcatgctccattaacaatgatcatcatattatgctgagagtctagaaaatgtgaagggctgtgaatttgtcctgatacgattctgcaagattgtttctctggctgtgctcagcagcctaaataagtaaaggagaagggaagatggattataagattgatccagagttgggagcaagctagataaatgcagtgggaggaatatgtgggatg

SEQ ID NO: 14228 - DNA, 354 bp, Homo sapiens
tcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgaraaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtatcacactttgtcttggaattacattaa

SEQ ID NO: 14229 - DNA, 455 bp, Homo sapiens
gatgcaaaaattagcagggcgtgatggcaggtgcctgtggtctcagcctcctgaatagctggaactacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaggagaatggcatga

SEQ ID NO: 14230 - DNA, 456 bp, Homo sapiens
tttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctattctttacaaagaattgaacctgatacagttaaccatctaccccaaactattatttgtttaaaacacaatctattggctgggcgtggtggctcatgcctgtaatcccagcacatcgggaggccgaggcgggtggatcacgaggtcctgagatcgagacaatcctagcca

SEQ ID NO: 14231 - DNA, 113 bp, Homo sapiens
agtacctggtgagcgtccctctgcgaatgttccgcctctggggttcacgggcatgatggctcagatcccactggcctggttcgtgggccgctttttccagggcaactatggca

SEQ ID NO: 14232 - DNA, 437 bp, Homo sapiens
cttttttcggctggaatggggaatttgtgaggtaggccggaagtggtgttgcggagggaagtgtggggagagcagaggcgcastctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagac

SEQ ID NO: 14233 - DNA, 413 bp, Homo sapiens
ccaaatgtctgagttaattcatctaggtactcccaaagtttatgtatttaaaagggacagtggtttctaatatactttctatttgaaaacatcaacaaataaaataattatttaaatatttttctttttaagaacatttgagagcttctaaatgtctagmgagggaaagtatatwatgattggtggagttaratttattatttatatgaataattctagctatgatgtgttatgtcattaaaaaatattggctcacgcttgtaatcccagcactttgggaggctgaggagggcagatcacgaggtcagtagatcgagactacggtgaaacccgtctctactaamrtacaaaabattagccgggcgtggtggcgggcgctgtagtcccagctactcgggaggctgaggcaagag

SEQ ID NO: 14234 - DNA, 338 bp, Homo sapiens
  misc_feature 276,278: n=a, g, c or t
taggaaaagtctatgtatggctggggggggtggggtggcttcagagagctgggggaccccttccccccaagtcccccctgcaggccaagatctttgctaaaggccattccctccgcaggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtntncccccasccactgcccatcccccattgttgtctggatgtggttctattttttatcggtct

SEQ ID NO: 14235 - DNA, 458 bp, Homo sapiens
tctgatactggacatgctagtaacttggagaggagaataaaagaatgtctcctggaattttacattcccattaatgtcctcattcaattggcagacctaggatgtatggttaactctcaggccattatgtttttcatggctcatttcccaaactgcattgttggtaggtgccttgctaagactgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgc

SEQ ID NO: 14236 - DNA, 407 bp, Homo sapiens
ccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgaracagggccactggaccctgcaggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcga

SEQ ID NO: 14237 - DNA, 470 bp, Homo sapiens
tgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgckctgaaggctcattttaatttattaattgctttgagcacaactttaagaggacataatggggtcctggccatcccacaagtggtggtaacctggtggttgctgttttcctcscttctgctactggcaaaaggatctttgtggccaaggagctgctatagcctggggtggggtcatgccctcctctcccattgtccctctgccccatcctccagcagggaaaatgcagcagggatg

SEQ ID NO: 14238 - DNA, 477 bp, Homo sapiens
atcacacaataaacgccagctgtggwggaacgtgcagaggcgctgcgcacgccaggcgtgtcgcgcgcttggcaaccctcgccgctcccgcagcgcagttaacgtggacaagctggggcaacctggacgagctggggcaacctgatctcggctgtcggagtgggtgtcctcaagaaaggtgacttgtcctcgcggacgccaggtgttgccccttagatacctgccacctcccagcctccgtttcctctctgggaaacagactcctcatcacctcctccagttttctgccccttcttcacctctcctgacgctccatccgtaccttttgcaagggaacgtgccataattcggctatgctctattttcttgtctaatagattgtaagctccttgcgggcagcatctatgccttcttaaatctgtttctagtttctaccagcaagcttgccccgargattttgcagaatatctgttaaat

SEQ ID NO: 14239 - DNA, 213 bp, Homo sapiens
taaatgcctaatacatttcagacatcatgccaggcacggggatgacagggcatggtggcgggcactgtggtcccagctacttgggaggctggggcgggagagttgcttgaacctggtaggcggagattgcagtgagccaggattgcgccactgcactccagcctgggcgacagagtgagactccgtctcagaaaaaaaaaaaaaaaaaaaaaa

SEQ ID NO: 14240 - DNA, 487 bp, Homo sapiens
cttttcggctggaatggggaatttgtgaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagcta

SEQ ID NO: 14241 - DNA, 464 bp, Homo sapiens
ccatagtcctcattgccactgctgctgtccagggtctgatttcactaccctgagtctcatttccttatctctcagtggaagataaagccactgcctagcacccaggattgttacagggatcagattagatgctcaggaagatgctcttgggacactgcaagggacaggattcttcagrsgtcgcttggaactgtggtgcctctgtgaggtggatgtcccaggcagagccagccagccagccctgacctgagctcgctgctgaccctgccacagattggctgtgtgtstctggacaggtggcttggccactctggacctctaccaaataaagagctggccggccaggcacagtggctcacacctgtaatcccagcactttgggaggccgaaggcggttggatcacaaggtcaggagattgagaccatcctggctaacacggtgaaacccatctctaccaaaaata

SEQ ID NO: 14242 - DNA, 454 bp, Homo sapiens
  misc_feature 275,406,409,415: n=a, g, c or t
atgttacactaagggaatcctgaggccctytgagtttatgctaggtactgaggagaatttccatcaaagtcacactaacagtaaawggaagaagaggwsagatgmagagaagcacagagrtgcacagcctgccaggctcaggaacagcagtacttactgaagcagragatagacgttggrmatcatcctctgtacargcagtaaggagccagccttgaagattttgcaggaagggatgagcagaggacagctggtgtcccctaaccacgcakgangtagaggtctaatctgggtccaggaactttgaaggatctctaaatttctttgagastcagattcctcatctgaaaaaraaattttgcaaaatgcttatrgattattattaattacatgtgataraattgtntgntartanttatgcacatatcaatattggttstgtataagtacacat

SEQ ID NO: 14243 - DNA, 474 bp, Homo sapiens
acacttttggagacggggtctcactgtcgcccaggctagggtgcagtggcatgatcatggctcactgcagcctcaatgtcccgggstcgggctgtcctstcgcctcagcccccctaggagctgggactacgggcgtgtgccaccacgcccagctgatttttttattttttattttgtaraggtctcactgtgttagccaggctggtctcgaactcctgggttcaggcggtcctcccaccgcagcctcccaaagtgatgggattacaggcctgagccaccatgccctgccttgcaggcactatttttgtctgcattttatagatgaagagactaaatctcaaagaggttaaataatttgcccttgatttgcscaagacsctatggctcttaggaggtagaacctggaatttttttcagaacgtattttatgagagtattttcaataccttattttatactgtagtctataggagg

SEQ ID NO: 14244 - DNA, 470 bp, Homo sapiens
  misc_feature 438: n=a, g, c or t
tataatacaggatgtaacaatgtcattctggcatttgttatgaatgcagcccatgggcgagggaaaatcacgggtcccgcaagcacactctgtaacaatgcctcttcccaggaggggccccccaccaggctgacgattgtcttcaggctccatcgatgttttccgttgtttaaagacacacattaacgtaaagtctcctcccattctctctgtaaattacagcattcagaagaagtggcagctgctgtaattaagacacagttaattgcctatctccttaattgcagtgataggattttgacagtttggtaaataagaattgtttggtttcctctggcaacttcagcctcagtcagttctctcctgcaagtgctgagtcacccagtctggggacaaagggctgtgttccaacggagacaggatggggcaggaactsanggtgagaggggggcagtgtttatgattcacct

SEQ ID NO: 14245 - DNA, 367 bp, Homo sapiens
tagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataasmacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttaaaaaaaaaa

SEQ ID NO: 14246 - DNA, 81 bp, Homo sapiens
tgcagaaggagatatttatatataatagcagatattattagtgatttaaatgtgaataatgatgtttacctggatggaaag

SEQ ID NO: 14247 - DNA, 262 bp, Homo sapiens
agtctccctgcagcttcaagtggcataagagagggcccacagcctgattacaacttctgccacctagatcctgaatccatagatgccatctctgstccgaagtctgatgacaagaataatgatgatgactgatgatgacaaactgttctaaatgccttctgtgtattatctcawgcgatcctcagagcaaccctttgaaaaacattcagctctattcagtccttgctccttggctagcctacaatactacccaggtgttcag

SEQ ID NO: 14248 - DNA, 227 bp, Homo sapiens
atatcaataggaaaatggataatttatgatatattcacacaatatacatcataggctagtgaaattmtaaccacatgcaacaatatggatatatctttaaaatatttaatgaaaaagtatgcttggcgcggtastcacacctgtaatcccagcactttgggaggatgagggaggtggatcacctgaggtcatgagttcgagacaagagcgaaactgtctaaaaaaaa

SEQ ID NO: 14249 - DNA, 410 bp, Homo sapiens
  misc_feature 335,354,387: n=a, g, c or t
aataaaagcataccaggaaggcccctagtgaggggggaattttgtaaaagttttcagctgtaactctcatttgcacaattttctctatgtatttatatttcaatcaacatgatgcatgtgtattaaagccctgtgtaaatgcaacggtgcacacaggttcaaagcgcaggcaatatttatwgagcaactattatgttccatatgctgtgttaaacaccatgcatacactaagaagcagagggatgctgcccttgcccgggacgagttggcccttgtcagtcagggaaaggcagacaccaacagaacagcaataaaaaggccgggcaatgggccangcgcggtggctcatgcttntaatcccagccttttgggaggccgaggcgggtngatcactgaggtcgggagttcga

SEQ ID NO: 14250 - DNA, 502 bp, Homo sapiens
  misc_feature 491: n=a, g, c or t
agcccagccccgcctcttctccggcagatcgcggccgagcagtctgcccagagacttagcgacagacagacgctgggacccacgacgacagaaggcgccgatggccgcgctgctgagccctgcgcggggcagggggtctggaaccagacagagcctgaacctgccgccaccagcctgctgagcctgtgcttcctgagaacagcaggggtctgggtacccccatgtacctctgggtccttggtcccatctacctcctcttcatccaccaccatggccggggctacctccggatgtccccactcttcaaagccaagatggtagctgccatccctgggagcctggaaccaggcaatgttcgggggaggcaggggacaggctggaacctggtgaagtcttaaagtagactcctcctatcggggtgtagaagggaatctgttaatcaaacagagcaatattagaaaggctacagaggtcaactcagtggaacacgnttctcccaaac

SEQ ID NO: 14251 - DNA, 272 bp, Homo sapiens
acagatgactctcgttcgccctgaccggcttctcacagtgtctcaggccactgcgccaccgcgctggtgctgagcagaagcgggcagaagtggggtctgctttcaggacttcatttcccccactcgttccggccccgcattctccacgtctgccctttggtctgagttaaaactgcgatgctgaaaagtgcgagctctttccacgaggaggagccacacagggtggcctccgagggtgagtcgctctgctaagcaagggcagccgctgcacg

SEQ ID NO: 14252 - DNA, 462 bp, Homo sapiens
gctcaggagcactgtggtagagcactggccctgccttgagaagagacacaggtctcccgtccctgcaccagctgagagagacttgccgcaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagrggtagaa

SEQ ID NO: 14253 - DNA, 431 bp, Homo sapiens
ctcctgamctcaggtgatctgcccgcctcggcctccccaagtgctgggattacaggcatgaaccattgtgcccagccaagagatggaatttaaaagcaaaatgcaggtatagtaggagcaaatggatgaaaatagatataccattcaagtaataagcctaagaaaactgctgtggctatcttaatatcatatgaggtggattttaaggtaaagaatattataagacatgaaaagggacctttgtagtgttaagagagttaattcatctggtagacataataatcataagatatatgtcctcaataatagagcttcaaaataaatgaagcaaaaatttacccagcactttgggaggccaaggtaggcggattcacctgaggtcaggagttcaagaccagcttagccaaaatggagaaacttgtctctactaa

SEQ ID NO: 14254 - DNA, 100 bp, Homo sapiens
acaaaaattagctggcsgtggtggtgggtgcctataatcccagctagttgggaggctgakgcaggagaattgcttgaacccgggasgdggagattrcagt

SEQ ID NO: 14255 - DNA, 391 bp, Homo sapiens
cagtattctgttattttttgcagtcgggagccgtgtggaagctagcccattacctaaattgagatgatagaatttgcctattgaaatctcaaggactggccaggtgcagtggctcacgcctgtaatcccagcactttgggaggccaaggcgggtggattgtctgagctcaggagttcgagaccagcctgggcaacacagtgaaaccccgtctctactgaaatacaaaacaaaacaaaaaattagccgggcttggtggcacgcacctgtaatcccagctactcgggaggctgaaacaggagaattgcttgaacccaggaggtggaggtggcagtgaactgagatcacaccactgcactccagcctgggtggcagagcaagactccatcacat

SEQ ID NO: 14256 - DNA, 288 bp, Homo sapiens
  misc_feature 187,271: n=a, g, c or t
gtatctagccatggctggcagaggtttctagggtgggtccccagccgtggcgtgaactgaggatgacccggggcagctggcaggagagagccttggcctgacctggcacagaaagggcagcttcagtctctgcagtgtccattrtctgctgttmcttcgagggttccaggctgtgtgtggggcccangcatgccccacccasccctcctgggsccaggcagcacctggrgcccacagagtctktgtgtagccaggwagccccgctcaggtngccaccgccggggcact

SEQ ID NO: 14257 - DNA, 171 bp, Homo sapiens
tattctctttaagagaaaagaactgttttatttgtctttgtattgtttgtggccccaggtatatcttgtgtttgataggatctcaataaagttctgtggaccaagtgaatgaataatacaaattctactgtacagaatagaatgactcacctagcaggggttttcgagttt

SEQ ID NO: 14258 - DNA, 364 bp, Homo sapiens
  misc_feature 7,313: n=a, g, c or t
tttgtanaaattggatattactaatatatttgacggtagaaactgtggagttataggaaattagaaaattaaaaataatcacaaccaaacgtgaatcttaactaagtataaaatagatgaattttgtagaggagtcccaccttattctgttgtatgttctaaaaggtttgtagatrtctatctgtggcgtaattgtaatctgaaactttgtgtttagtggcaagaaaagccgtcccacagcattaagagattctttaaaaaattawgacctctgccaggttcggtggctcatgcctgtagtcccagcactttnggaggccgaggtggacggattacttgagctcaggagtttcagaccagcctg

SEQ ID NO: 14259 - DNA, 436 bp, Homo sapiens
  misc_feature 150,430: n=a, g, c or t
cattcattgaatttagtctgttcattagctcattgtcattaactgctgtaggaattgatgaggattttctttttctatttgattaatttagtgctttgatgcaaacaactttccttctactagtatgaaaaagtggttggtctggaaccngtcaacatctgtacttcttaaaattatttttttaaaggttcatcatattattctttctgcctagtttatggttgctgaagttaagaaaactggaactaggtgtggtagctcatgcctgtaatcccagcactttgggaagccgaggcagggggtgttgcttgagttcagaagttcaagaccagtctgggaaacacagtgagacttcatctctactaaaaataaaaataaaaaataaaaattagccatgatggtgtgcacctgtagtcccagctacccaggnggctaa

SEQ ID NO: 14260 - DNA, 425 bp, Homo sapiens
  misc_feature 381: n=a, g, c or t
caatacasataatcttctgattttcaggggtacattcttctggcaaagctactataagttaaaatgasattagtcaaattttctgscagawgaagtcacaaaagaggattctttttgaagacctggtagtcagcctcttgtagataagaagacacttttagctgggtgcggtggctcatgcctataattccagcactttgggaggccgaggtgggaggatcatgaggtcaggagatccakgccatcctggctaacatggtgaaacccgtctctaccaaawctacaacaattagccaggcatggtggtgggcgcctgtggtcccagctactcgggaggctgaggcaggagaatggcgtgaacccaggadgtggagcttgcgntgagccgagatagtgccactgcactacagcttgggcgacagagc

SEQ ID NO: 14261 - DNA, 359 bp, Homo sapiens
  misc_feature 182: n=a, g, c or t
tttttattttttgagagggagtcttgctctgtcacccaggctggagtgcagtggtgcaatatcagctcactgcaacctccgactccctggttcaagcaattctcctgcctcagcctcctgagtagctgggattacaggcacacgccaccacaccctgccgaaaagagtgtttttagagagtngtcaattgtaatgaagctgccaggaggtcaagtaggtdgaggattgaaaatacccattagatttggagatgaagaggtttttggtgattttaatgagagttatycagaaatggggatggcarccacattggagttgcttgaagagtcagagtctaaatggacactgagtgtatttaa

SEQ ID NO: 14262 - DNA, 269 bp, Homo sapiens
  misc_feature 234,259: n=a, g, c or t
aaakgaaaaggaacaaggaagaaagtggaaccaattagcaagctaagggtcttgcggtgtcacccaggctgtcacaagagtgcagtggtgtgatcatagctcactgtggtctccaacttcagggctcaagcgatcttcttgcstctgcstcccaaaktactgggattactrgcgtgtrccaccgcacccagatgagactaacgttttaatgtcaaaaaacctataaaatatttngaaaaaaakcgtttaatctctaagngcsgctatgc

SEQ ID NO: 14263 - DNA, 138 bp, Homo sapiens
  misc_feature 19: n=a, g, c or t
ctccaactcccgacctcangtgatctgcccgcgttggcctcccaaagtgctgagattggccttcactcttgattttaactgacatgtcagttaaatgctactgcattccagcctgggtgacagagcaagagtctgtct

SEQ ID NO: 14264 - DNA, 491 bp, Homo sapiens
caggaaaggacgtgaagcagagaagggcagagggctggtgaggagggaagaggctttcattcattgcttcaaaagtatttattggggccaggtgcagtggcttatgcctgtggtcctagtgctttggggggccgaggtgggaggcttatttgaggccaggagttccagaccagcctgggcarcacagcgagacacccatctcaacaacaacaacaaaaaatttatttttaattagccgagcacacacctgtagtcccagctactaggaggccgggggggaaggatcgcttgagcccagcagttcagggctgcagtgagccatggtcatgccactgcgctccagcttgggtgacagagcaagaccccatttcttaacaacaacaaagggtcaggggcagtggttcattcctgtgatcgcagcactttgggaggctgaggtgggaggatctcttgagcccggaagttccagaccagcctggggtaacataggg

SEQ ID NO: 14265 - DNA, 345 bp, Homo sapiens
  misc_feature 17: n=a, g, c or t
agttctgagcagggcgngactcaggtgggcgggatgcgaagagctatggggaaggattcgaattccggtggatttaaatcgcgggaggagaagctaccgcggcctaaagaagacctctgttgaacacagactgcagttccagccaccacagctaatctggatcatgaatgggagccaccgtggtcttggcaagtccgaaaacatagctgagtagctcgtctagaaaagagatttgtgttcagctgagttaaaagaagtatttacctcaaacctctcctcttgcacaaccaacccccgttataaaaggaagtgcaaaatggaataaactgattttaagcaaaaaaa

SEQ ID NO: 14266 - DNA, 394 bp, Homo sapiens
cttcctctcctagcctaaggcgtgcaaacagagcgccactgggaggctgaaacctttaggccgatgcttgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaaggaaaaaaaaaaaaaaaa

SEQ ID NO: 14267 - DNA, 467 bp, Homo sapiens
atagaaagatctccaagaggcattgctaaattattattaggggaaacaatacttgtatttgcttgtataatgcataaaatatttctggaaggatgtagcagaaattaactgctgctgtctaaggaggtggaggcatgaggtctgggtagctgtgggacgggaagaagaggaagattttwcactataattatctttttattgtgatattttaaaatatatattcctttaaaaatatgtattattgttgttacgttgtaaaagctctgcatttattttactgttactgaaatctcaatattatgtggccaggcatggtgactcacggctataatcccacactttgggaggacgaggcagatggatcacctcaggccaggaggttgagaccagcctggccaacatggtgaaaccccatctctactaaaaatgaacaaattagctgggcatggtagcacacgcctgtagtc

SEQ ID NO: 14268 - DNA, 295 bp, Homo sapiens
ccatgttggtccccttggccactgtctctgggcatgcaagccagtgtcctggttcagtgcctcggccagagctggggcaggagaggggcctctgggttagagctgggggtgtctctgcagggtactggcagccttgccacactgtcctcattcccagatggaaagacctgagtgcctctcgccattcctctgtgttagaattggctgaagtgtttttgtgcagctgacttttctgacccatgttcacgttgttcacatcccatgtagaaaaataaagatgccacggaggataaaa

SEQ ID NO: 14269 - DNA, 476 bp, Homo sapiens
awtattgtgattctgtttattcttccagaatgctgaastcsttrttascccttcagattgttaggagtggttctsatttgtgtctgccagaatactgggttctwagttgacaacctakaatgtcagatttctggttgatywgtaacacagtcattctaggatgtggagctactgatgaaatctgctagaaagttagggggttcttattttgcattccagaatcttgactttctgattggtgattcaaagtgttgtgttcctggctgatgatccagaacagtctcgtatcccaaatctgtcagcatctggctgtctagaatgtggatttgattcattttcctgttcagtgagatatcatagagacggagatcctaaggtccaacaagaatgcattccctraatctgtgcctgcactgwgagggcaaggaagtggggtgtwcttcttgggacccccactaagaccctggtctgaggat

SEQ ID NO: 14270 - DNA, 440 bp, Homo sapiens
gaaatgggctgtctttcttttcctttcatgtaatgtctgatttttatgtggaagagaatgtaagtagtgctgtataaccctgcggatgctatgccctacagggaaagcaaatatttgcaagtcagactgaaaaatgtccagaccctgtactgattaagtagaaggggaatctaaccacttwgcatttgaaagaaaatgcagcatatagcctgaggaagaacttgatcctgaagagacaacttcctccagcagctttataagtttatggaagacagaggtactccaatcaacaaaccacctgttttgggctataaagatctcaatctcttcaaactcttcagactggtttatcatcagggtggatgtgacaatgtatctctatggttttgaggagtactgccgttcggcaaatattcagttcagaactgttcatcaccatg

SEQ ID NO: 14271 - DNA, 467 bp, Homo sapiens
aggctgagctgaaggcacttagtgccacaaccgcaccaagaagcacgacctgctgaggctggcaaaggatgaggtgacccggcaggagctgaggcagcgggtgcgcatggctgacaacgaggtcatggacgcctttcgcaagatcatggctgcccggcagaagaagcggactcccaccaagaaagaaaaggaccaggsstggaagactctgaaggagcgtgagagcatcctgaacctgctggatgggtagccctcacccctgcctcaggcttattatctggcctaggggaggggaagggaggcccacttccttctttgggcacaggaaacattggcctgtggctgtccctcaaatggcggcagtctctagagggccgtggcctttcccctgagttcttttggcctagctctgtacaaccaggacacaggaagccctgcttggctagcctgaggcctagtctctgctt

SEQ ID NO: 14272 - DNA, 263 bp, Homo sapiens
atgaactgcttcaggtgggggagggaaacttatttttatttgcctgatttaagtgtctgagaaacaaatctttgttctcttaggactagcaatggaacaamtttaccagggttttgagcattacctttcctttcctttataaaacatgctcagcaaactgcaccagtkwaactacagtttggtaaattgttatgttaacaattatgacatctgcaatgttttataaagcaactaatttaataaaatcactgttgtgacggaaa

SEQ ID NO: 14273 - DNA, 62 bp, Homo sapiens
gatggaagctccggccgcggagtgatggtggcctcagcgaagatgggccgggcagggaccat

SEQ ID NO: 14274 - DNA, 278 bp, Homo sapiens
  misc_feature 21: n=a, g, c or t
aattaaaggacttggccaggngcagtggctcacgcctgtaatcccagcactttgggaggctgakgcgggcggatcacaaggtcaggagatcgagaccatcttggctaacatggtgaaacccgtctctactaaaaaatacaaaaaattggccgggcgtggtggcgggcgcctgtagtcccagctacttgggaggctgaggcaggagaatggcatgagcctgggaggcggasttgcagtgggccgggatagtctcgatctcctgacctcgtgatccgccc

SEQ ID NO: 14275 - DNA, 396 bp, Homo sapiens
tgattctgccagcggctcctaaaccgccttacagctgagttagaagatgaggagaggcagcagggatttccctgscttgggatgtgggaaacagaagaaaagttgagaaaatggttgggaatcgctgttagaactctagaaattctaatctgactttgsmactgtgcccagctcatggcccagagggtagagtgcctcctgtggaagtttaggggcaaatttgttccctgacctggagagggttagaaagaaccaacagctgcsccctccccgcccccgtgttgagacaggttctcaaggctcaggggaagatgcatacctcctatgtaagaatgctcttcscttgctgttattcatacacactttccacttcaaatatacccaaatatggctttc

SEQ ID NO: 14276 - DNA, 164 bp, Homo sapiens
aatacttttcctcagaggagcaggcaacagtgtgggataaacagagtcacgatcagaggaactccagggtctggtgatggcagggatggggggagagagagaaaatccacaaattccaatgtcacaaaagcaataaaacaaactagaaaaaaaaaaggttttac

SEQ ID NO: 14277 - DNA, 479 bp, Homo sapiens
cattgttcttcttggtggatctgtcaggtctttgtgtagctagcagaaaagtctcttccaagtcctatcgatctataaggacttttaattcaaaatgcttattatgccaaggagtcatattttggggtggaattccttgcactttttaaaatgcagattgctaagtgaaagaagctattctgaaaaagwatgatttctgtatgattccaaccatctgacaatgcaaaaagcaaaactatggagatggtagcttgccaaggattgcggggagggaggcgtgaagagttagagtatgggagacttttagggcagtgaaactacactgtaggatactgtaatggtggacaccattgtcaaaacccatagaactgtacaacataaagagtgaaccctaatgaactatggactgtcattactaataatgtatcaatattgatgtatcaattgtaacaaatgtcccacatgaatgccagatgtta

SEQ ID NO: 14278 - DNA, 523 bp, Homo sapiens
actttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatgtctttgtgtgaagacatgctgctttgtaattatcgaaagtgtcgcatcaaactctctgg

SEQ ID NO: 14279 - DNA, 458 bp, Homo sapiens
tggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggccctccttctcccctccagacccctaccctttcccaaacccttcggtattgttcaaagaacccccctccccaaggaa

SEQ ID NO: 14280 - DNA, 316 bp, Homo sapiens
tatttttagtagagatggggtttcatcattttggacgggctggtctcggactcctgacctcgggcgatctgcccaccttggtttcccaaggtgctgggattacaggcgtgagcactgcgcctggcccaaaagacatgattttcaagagagggatggccccgatacccagcactgtggtccagtagcatggsctgtgtggttgaaactgacaatacagaagtaggcttgagggtgaggaaacagaggcgagccttcaactcccttcagggtttattattttcttgtgtttagcctcattaccagtggtgtgcaaaaa

SEQ ID NO: 14281 - DNA, 500 bp, Homo sapiens
  misc_feature 466: n=a, g, c or t
aagaaaaaccacgtatctagaaaatgctcctttaagccttttttgacgaggaggaggggtgcagacacttgcctgcggcaaagtgaacctggaaggagcggggcgtgtgtaggacagagcccaggagaacgggcagccgggtggccgggccaggaagcagggcctttctggccctttccgmagagggctggataatwgcctctcctttctaaaaggatccgttttctgggccgggagcggtggccctcgcccataggctcacgctcgtaattccagcaatttgggaggcccaggcaggcggatcatctgaggtcaggagttcgagaccagcctggccaacatggtgaaacccgtctgtactaaaaaaaatacaaaaattagctgggcgtggtggcgtgcgcmtgtgatcccagctactcaggaggttsaggcaggagaatcgcttgaacttgggaggtggaggttncagtgagccgagatcgcgccaccgcactccagcc

SEQ ID NO: 14282 - DNA, 398 bp, Homo sapiens
agtgctgagacctggctgctctattgtaagctttggaaacacaatttatgcaacagatgtccagatatgattctatttatggaaaaaagtttatatgtgttttacaaatggttttaccatcttatattaaaatgaccttttgacaggtgtgcactgttttgtctccagtgagcacataccatgcggattttatatgtacatcagtagtgtgaatccactggcacagtgtgtgtaaatgccagatgtggtgagattttatcttataaatgtgatcagataaaataactcctgacagaaactgtaaggaaaccagctgaatgtttgacctgatgactgatgttgtatggtttatgttaaatgtatattcttttaatcaatgaataaagcattaaaaatca

SEQ ID NO: 14283 - DNA, 267 bp, Homo sapiens
  misc_feature 5..7: n=a, g, c or t
aaaannnttcggttcctgggctgctgtctcatagacatcagcttgsagggaagctgggggctctccgaattgccctgctccggggcccctcctgstgcgtgactcacaggcacattgcagagagaagctgccgctcccagtaagtaatgaaaagagacatgaagaattggtattwmaaatgaccaccatgtwgcaaaaggcatagggatttccagctttacaacatgctatgaattatcctcctctgtgttaacacttgtgttaacc

SEQ ID NO: 14284 - DNA, 409 bp, Homo sapiens
agctgtcctgggggagcttgtttgcggcacggctgcystgccactgctgtgctgggggcccggtcgccaggcaaaaagccmtacccacgtttgaggggagtcatgagccgtttcctgaatgtgttaagaagttggstggttatggtgtccatcatagccatggggaacacgctgaagagsttccgagaccamaacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagct

SEQ ID NO: 14285 - DNA, 75 bp, Homo sapiens
aaaccctcagggacctggtatagacgcagaatctgtttcacacaacaactgctatttgaaggaaaaaaaaaaaaa

SEQ ID NO: 14286 - DNA, 157 bp, Homo sapiens
atcctggaatcttcgcttgtggagctgtggaggcaacggagtttttccgcgctttttctttcagcctcagagcctctcttcagcttctggagacctcactatcctattatgtctttgtgtgaagacatgctgctttgtaattatcgaaagtgtcgca

SEQ ID NO: 14287 - DNA, 165 bp, Homo sapiens
tcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaaaaaaaaaa

SEQ ID NO: 14288 - DNA, 445 bp, Homo sapiens
ccttggaagcaagtggggtggcatgggagagaagggaggaggtgggcacaggtggtgagcttatgtgtgggcactctactgcctcacagaagccagccaagtkccaaggtcagcttggctggtctgaggccaccttcttagccaaaaacctagggttcattttcaggactttgataawgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggct

SEQ ID NO: 14289 - DNA, 434 bp, Homo sapiens
cctcagcctcccaaagtgctgggattacaggtgtgacctaccaggcctgctcctcaaatttcttaagtaaagttccttttgaccattttagatgatctcctaggggaatgaaggtttggggaaagagactgggaaggatttggcccattcctaggagagcctaactggagaggttratctgggaaacctggttgggtgtcttcagcttgataaaagcagggttttaggtagatttgcgtaacagagccagctgaattgagtgggagggagcagggcagaaaggaactgggatgtgagaggcaattctgagaggtccttccctgcaacggatgaggttgtttgagtttgagagaggctgagtttaggatagcgagtggtggagctgcaccttcgtatgtgatggtgccgtagcatgcatttgactaccatgaact

SEQ ID NO: 14290 - DNA, 391 bp, Homo sapiens
  misc_feature 203: n=a, g, c or t
tctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagcsctaataaataatatttttacctaatgtnaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagccta

SEQ ID NO: 14291 - DNA, 339 bp, Homo sapiens
  misc_feature 330: n=a, g, c or t
aagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaataagacaaggaaaaggacagagagagagaacgggaaaaagagcatgagaaggwtcgagacaaagagaaggaaaaggaacaggacaaagaaaaggaacgagaaanagacagatc

SEQ ID NO: 14292 - DNA, 418 bp, Homo sapiens
acaataataacaaaatctgtggaaatggatataaatattcatgtcaattgtctcatatttgcgtgttgctttacacttcatacagcatttatatttcttatttaatcttggccacaacatgttcatctcatggattaaaatgagagacctggctgggcacagtggctcatgcttrtgatcccagcactttgggagactgtagcaggaatatcgattgagcccaggagttagagaccagtctgggcaacatagggagatcccgtgtctataaaataataataataaaaaattatctgggcatggtggtgcatgcctgtggtcccagctactcgggaggctgaggtgggagactcgcctgagcctgggaggtcgaggctgcagtgaaccatgattgtgccactgcactctagcctgggtg

SEQ ID NO: 14293 - DNA, 305 bp, Homo sapiens
gaggtgcccatgtgggtccgctgtgtcccctgtcatcatccttgtttttttctcattttggccaagggcaggctccctgggacagcagggaacaactgcggagatattagtgattcataggtttgtacagtgttttatactttgcaaagcactttattagctcacacctgtcamactcacatgaaactcgtgttaggccctgggaggccgacggtaactctcaccgtgccctcagatgaagcacagagaggttgttacttgcccgggccatccagtgggctgggctgggtcttgtgtccccatct

SEQ ID NO: 14294 - DNA, 491 bp, Homo sapiens
tttgttacagaaaatgttcaattaaaagtactttaaatacgtgtgacagaaactcacacatggagtctcaggagcccgacttctctttttaaaatgaaagagcctgggtgtgttggctcactcctgtaatcccaacgctttgggaggccaaggcaggaggatcacttgaggccaggataggtcaacatggtgtgagaccctgtctttaaaacaaggcagacacaactctgtgaatgtaaaatggttgcattgtacactttaagtgggttacttttattgtttgcaaattatagctctatgaagctgttataaaaactaaaaagaaattaaaaaaagatccttgaacttcttttagtgatacctaaaaatacacaggctgaatccaaacaagggtcgggggagtagtttctgacccacctgatgctaaacaatttttttcagtatttgttgcgatatttmatgtgagactttacatgccactgttgttggta

SEQ ID NO: 14295 - DNA, 433 bp, Homo sapiens
acaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggcgccggccgagacctgagacgtggcgctccctctctgccggcctcggcttcagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtggtaagattgtattaaaattatagaaaaaaacctcgaaaaa

SEQ ID NO: 14296 - DNA, 356 bp, Homo sapiens
aaaatataatatgcattcattttacatttgccattatctgtcacagtgacttatcaggctgagccctgtctttgttcatataatccaaatgattgtagaataagatgtaaagaaaactaagtaggtagttttcttaaaagggtgtaatttagaatacagtgttcatctggtttcatctttcatgccttatcataaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttt

SEQ ID NO: 14297 - DNA, 445 bp, Homo sapiens
tttcctaatgacaaaatcttacaggcataaatatggaattactttgccgttggaatgcaggtgtttattttgttaattgtgtttaagagtttttagatattagatattagatttagatgttagtgtgtctataaaatgatggtgctaattaaagactttaacctggccgggcawggtggctcatgcctgtaatcccagcactttgggaggccgaggcgggtggatcacctgaggtcagaagttcaagaccagcctggtcaacatggtgaaactccgtctctactaaatatacaaaaattagccgggtgtggtggtgggtgcctgtaatcccagctactcgggaggctgaggcgggagagtcgcttgaacccgggaggcggaggttgcagtgagccgagatcctaccattgcaccacagcctgggcaacgagagcggaacttcgtt

SEQ ID NO: 14298 - DNA, 190 bp, Homo sapiens
aaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccaaaaaaaaaaaaaaaaaaaaa

SEQ ID NO: 14299 - DNA, 379 bp, Homo sapiens
aaaaacaattagaagaaaacacagaggaaacacatcatgatactggtataggcaaagattttttgcataagaccccaaaagtacagtcataaaggtgaacattgacaaatgggattacatcaaactaaaaatcttttgcacagcaaataaaacaatcaactactgaaggtgaaaatacaacctacaaaataggagaaaatatttgcaaactatgctctaacaagaagctaatattcagaatatataaagaactcaactcaatagcagaaaaacaatgtaatttaaaaatgggcacaggccaggcatggtggctcgcacctgtaatcccagcactttgggaggctgaggcgggtggatcacgaggtgaggagattgagac

SEQ ID NO: 14300 - DNA, 454 bp, Homo sapiens
  misc_feature 433: n=a, g, c or t
tttccatatgcactcatgtgtgtatgtgtgtagctttatgcaattttatcacatttataggtttacttacaacgagctgggcaaattgtgcaatttccttaagcccaatttataaaactagggtgtaaatactaacttcctcagaggagtgttgtgagaattagagataacgtgtataaagtgtgtagaggccgggcacggtggttcacgcctgtaatcccagcactttgggaggcagaagcggtggatcacctgaggtcaggagtttgagaccagcctggccaacatggtgaaaccccgtctctactaaaaatacaaaaactagctgggcctagtggcacatgcctgtagtctcagctaggcaggagaatcacttgagcccgagaggtggaggttgcagtgagccgagatcatgtcactgcactccagcctnggcaacaagagtgagactcaa

SEQ ID NO: 14301 - DNA, 363 bp, Homo sapiens
  misc_feature 196,233,338: n=a, g, c or t
caatagtagtttgttgtaatggtggcaarggaagccaggaggtagtgagacattgaatttagattgctttttaaagctttgagtagcagagagggtgaaagctagagaatttagttttgaggaargatttatcttggggttgaaagaaaaagtcagagccgggcacgtggctcactcctgtggtcccagcactttnggaggctgaggcgggcggatcatgaggtcgagagttngaggccagcccgaccaatatggtgaaacctgtctctactaaaaatacaaaaattagccgggtttcgtgasgcgtgcctgtrgtgccagctactttggaggctgangcgggasgatcacttgaacccggga

SEQ ID NO: 14302 - DNA, 456 bp, Homo sapiens
ttccctaacacttaccccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgatgccaaggctgatgcaggatttgttctctgtccagcagtcacttcggccagagctgaagagttgccccgtctctgttccatgtctcctttaagagctctggtgataaggacatgatgcttttactgaactttcttatcctagcacatgcttcaatagttcaaggaacttaaaaaatacttttccttacctttaccccatccctgtctttactcctcacacttactgtaagacattataacataataaattaaaagtcacacgaatctcaccacataaa

SEQ ID NO: 14303 - DNA, 431 bp, Homo sapiens
tttgtagccaggaatctctagtgatattttgcttcgggcatcgtgggggaagaccataatcagctattttattcttgaaatttaggaaaaataattgctctatcttaaacagtgagaaaatattttttgaagtatggcagctttcccgaatccccactttatatcttcctatgtatctgaaatcttaggaccttcgatggttccggaatcgaatcaccctgcagcaatttattttagaaaataaggcaaaccggctgggcgcggtggttcatgcttgtaatcccagcactttgagaggccgaggcgggcggatcgcttgagctcaggagttcgagaccagcctgggcaacacagcgaaacctcgtctctattaaaaatacaaaagttagccaagtggcgcgcgcctgttgtcccagctgctcgggaagctg

SEQ ID NO: 14304 - DNA, 453 bp, Homo sapiens
atatctaccaaaggaaaatgagagttttcaaagccttataaatataattagctcagtgttctaaaagtaaaaatatacaggaaaagtacagaaaaaaagtaacaagtataaaaaaattttaaattattttaaaagtacaggaaaaatgtacccaaaaatatagaaaagaattgactgggaaagtgtgtaactatgcttacaaactacttcaagtagagagatcatcatgagtaattattttcctctgtattattttctactgtttcaaaagactcaatgcacatagatttatttttttaacttagaaaaatattgggttattgtgtaaataagtattaacaaatatctccattgtattactttttaaatgtctttcagggttaaaaatggtccttacacttttctttaaaaatcatttktcttacaagaatatagtggttctcaattgtgaga

SEQ ID NO: 14305 - DNA, 425 bp, Homo sapiens
gagggggtgagggatactgaggcccaggcatggagctgccggatccggtgcgccacggctgggaaacttcagccgggccgtgttcagtgattccaatcggaccggtccagagtccaatgagggtccggaaaatgaaatgtctccagtttggcactgcagatgtcactttatttwaatacctactatttcccactgtggtgggtgagcagcattatgatacttcacatgaagtattcaatcttgcctgactactacaaattcattgtgatcactgttatcatcctaataaccttaattgaagccatccggttgtatctgggctacgtgggtaacctacaggagaaggttcctgagttggctggcttttggcttttgagccttctattgcagttacctttaattcttttcktgctctttaatgaagg

SEQ ID NO: 14306 - DNA, 436 bp, Homo sapiens
aagaaatacataaatacattttgtaatgccatagctaccataggcagtgatgctccagtggatctgggcaaagtaaattgaaaaccttgtggagaggattcaccattccagatgtcatgaagaacactcatgaatcatgggagaaggtcagaatgttaacattaattaacagtggwwtggaagaagttgatttcaaccctcatggatgactttgaaggttttaagacttcagtgaaggaaataactcagatgtggcagaaacagcaaaaaatagtatcagaaatggagcctgaaaatgtggctgaagagctgcaatctcctcatcaaacttgaacagatgtggagctgcttcttaggggtgcgcagagaaagtggtctcttgagatggaatctactcctggtgaaaaggctatgaacactgttgaaatattggcaa

SEQ ID NO: 14307 - DNA, 405 bp, Homo sapiens
  misc_feature 147,367: n=a, g, c or t
cttaacccttcaattacgagcggscggcgctgcgtttccagggcagaggaaacgaggcgccgcgttggsttggacggcgggaacggctccggagcgagaacgcgcgtgagagagcccgagagagacggagagcgagcgagcgcgcgngagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttnttctcgttccctacttgggggtggcctttttcagcgga

SEQ ID NO: 14308 - DNA, 260 bp, Homo sapiens
ctaggtgttctaatcaatgtacaagactttaccatacacgcaactatagtttttctaaaccttcatcattttgtgattctttgagaaagggcttttaggaactttatgttctaaaaaatttttttaacaataataagataaaagaaaaacctgtgattcatatgtccccactggmattactcagcaggagcccccagctgccaaaggttggcagtgatcctgcaagttcaagggctctttctccctggggatgtcctttg

SEQ ID NO: 14309 - DNA, 477 bp, Homo sapiens
acctgcagaatcaaacattattacagtgggttgtggagtgccagatgacttatattcaccttaaagcttgagagtcagtgcttagctaagaggctctcagcccaggcttccagttggatcaaatggtcatattcagttactaccatcacctgtgccctccccatagcgtctgtctawtggtgtcgggggaaacatccatgctgtttcaattaactaccctgcccccaaggtgattctagggtgaggagaagtccagcatgagggcttccatatgcatttgtgaaggttgatggcagactgttccaaatgagaataatggtttccgtgatatgataaaagcaatgctattgaatatgatgatgactgatgagaagttttgcatagcattcgctgtaaaaaagccacttataggctgggcacggtggctcacgcctgtaattccagcattttcggagactgaggtgagcagatcacctg

SEQ ID NO: 14310 - DNA, 496 bp, Homo sapiens
caaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgctatggttttagggattragaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaraaacagctgaattgtct

SEQ ID NO: 14311 - DNA, 378 bp, Homo sapiens
gaaagatatcaactttcctagtttgcatttacactggctaataggataataaaatgctgtgtaaatgttaaactggaagtttctctgagttatttttastttaaaatttcatgtgattatgccattttgaatatgtatattacatgtaattgtataatgttaacatcgggtaggcaaaawtcttggtattaaatttaggatgttttaaaaattattaagaagatattaatgtctgctttttgatagcatatattttcatgtaatgtttagtgtattaaaatcaaccattcaagatttattttattgggtgacactattgactgtgttccaaaatgcccatagtgttaggaaatgtggtgtgagttttatttgtgggct

SEQ ID NO: 14312 - DNA, 409 bp, Homo sapiens
  misc_feature 370: n=a, g, c or t
acaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacmagaatgattaagtcacttcccaagtggttgtcatttgttanaccctggtttactgtcttgctattatgacatttcatttg

SEQ ID NO: 14313 - DNA, 442 bp, Homo sapiens
tattgattaccagacttttatgaaagccaaagactgcttgctagtaggaaaaaattwcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctca

SEQ ID NO: 14314 - DNA, 459 bp, Homo sapiens
cacacgattgtccagtggtcagacagaccgggaacaatttgcccagcagggagcactgtggagccacacctctgagccatggtgattttcctgctgctttgaaggaagagcgagagggcaaattacctctttcccagaccccgcaccagctgttgtcttggtttccaagaagggaagcacaaccactttgtttacattccaagtgacctggagtaacaaccggggaccagttctctggaggccaaggctacacctgggacaactggctgaggttgaaagtgagttgacagmcgttgcsattcaccagcgggtcctgggtcctcgtcctcatccttgtstttgtcctcttggcttcccctgggagtcatcagcggggttcgaacaagatttgctggttccggagcttgggtatgttcagcctggttttttctgggttattgaaaaatgttttaaggtgaa

SEQ ID NO: 14315 - DNA, 66 bp, Homo sapiens
ttttttttacctcctgaatagtctggtctgctgctggccccaagcaggatgtggcgtgaggctgga

SEQ ID NO: 14316 - DNA, 371 bp, Homo sapiens
acagaacacatttggcacccacagcaacacaggcagaccacaaagtctccagaatgaggaaatgttggaagcaaataatatattcagctgagcattcttcctggcagtgggagcaggagcctgatttggaccttaaaagcttagtggcaacaacaaataagcatatggcctggaaaatcmacatcccaacaggctaaacaaggcagtcataatttatcgtgaggaagggctgatcaggaagtggacagaagcatctgtatggaagccacacctcagtccacaggctttttcaggtgactcacctatttccaagctacctagctctccctgctgattgtttcaagtgcaaataaacatgctgtatgatacaa

SEQ ID NO: 14317 - DNA, 458 bp, Homo sapiens
  misc_feature 404: n=a, g, c or t
attgaacccaaagtcggtggtatatgactcaccctccttccaagtctcctgcgcgcgtgtttttaaaataaactcacccgaaacgtccgtaacacacggacctccaggagcagtgagaggtggcttagaagcccctggtttggggtgggtggaggaggagggcacgtgtctgcctcccctaggggtgccctccttcccccatcccaagctgctgaggggaggcccttgtcatgcctcagttcctgccttcatctgctttccggagaaaaaccatatcaactcctagaaacgctccttaggggcttgggaccttccatttggcactgagcatcttgtggggccttaactggctgagacatcccggccctctacatttgccctgttggccaggcagtccccttccngcaattggagggcgacgctaacttcagaatccatagtggcgsttgccgcagtct

SEQ ID NO: 14318 - DNA, 429 bp, Homo sapiens
acctgtcatggctgcctaactgacaacctgtttcctgttaaccaactccttttccttacccctccctagttcctgcttttccacacatggttacctttcttgctatataaactcccaattttagtcagtcagggagaaggatttgagactgatctcctatcttggctatggcactcatttaaagtcttcttcgctggcaatactccttgactcagtgattggctttctgtgtgattaaaataacaagaatgagtctgggttccaaggtgatgacaagattaacacaagataattcaataaatacttgctgactgaaggaatagaagaataagtgcatgaatggtgaagagaaatggaaaagtcctctaagtatcagtgaaaaaaacacagggtttgtcatctactgccttcagaaataaacatggagts

SEQ ID NO: 14319 - DNA, 299 bp, Homo sapiens
ctttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtagcaaacaaggaatccttgcctttaaggtgacaggccctccacaggcttccagacttgaaggaaaaggtttaagaaagaaaacaaaaccaacagttagtggagtcaaagcccagacactgtaaataga

SEQ ID NO: 14320 - DNA, 452 bp, Homo sapiens
  misc_feature 397: n=a, g, c or t
gacaggttgggagaatgaggtcagcggtgctggggaacagatggatggggcagtggggacagggcttgggcagacaccagcaggaataatttgaaatgtgtgaggtgactccscggagccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatsctttcscmtgcctggtctagctcctctccanacagccatgccctccaaatgctagagacctgggccctgaamctgtagacagatgc

SEQ ID NO: 14321 - DNA, 235 bp, Homo sapiens
gaaaggattgtcgacactgtggaagagaaccccaacagagagaacaccatgaaagtgtggaaggattgcattattgaagatgccatcatcgttattaaaaactgtgaaaccatcaaacctgaaacaacaaatacccgctggagaaaactgttcagatgtgcatgacttcacaggatttatgacagagtcaatcaaagaaatcatgaaagagatgtggatatggaaaaaaaaaaaa

SEQ ID NO: 14322 - DNA, 156 bp, Homo sapiens
gggcgccatgttggagggttggtggtagcggcttggggaggtgctcgctctgtcggtcttgctctctcgsacgcttcccccggctcccttcttttcccccccccggtcgcctgcrtgccggagtgtgtgcgagggagggggagggagtcggggggg

SEQ ID NO: 14323 - DNA, 392 bp, Homo sapiens
ttgtaggcatgagctactgcacccggccagagtatcttaattttaatgaaatatactttatcaatcttttcctttatggttactgcttattgtgtcctgtttaagaaatcaatgcctggccgggtgcggtggctcatgcctgtagtcccagcactgtgggaggcctaggcgggtggatcatgaggtcasgagtatgagaccagcctggccaacatggtgggaccccgtctctactagaaatacagaaattggctggatgtggtggcgggcacctgtaatcccagctactcaggaggctgaggcaggagaattgcttgaacccaggaggcggaggttgcattgagccgagattacactactgtactccagcctggttgacagagcaagactct

SEQ ID NO: 14324 - DNA, 277 bp, Homo sapiens
tgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggsggctctcgcagagccmcctgatgctgttgttctttgagggcttaaggcctgatgaacgtaggcacgtgatgcataatagtcttcaatggtacacttaactagtctcttctgtgta

SEQ ID NO: 14325 - DNA, 420 bp, Homo sapiens
  misc_feature 379,394: n=a, g, c or t
tgttctggtgcgagcccaatgctgccagcctctcagaggctgtgcaggctgcgtgcatgcttcgctaccagaagtgtctggatgsccgttcccaggcctccacctcctgcctcccagsaccccctgctgagtctgtggcacggcgtgtagggtggactgtsmgcagggtgttcaatcgstgtggggctccctgaagcccaaacggctgggggcccataccccatgaagaagcccccaccttccctccacctgcttgtgttgggccccagggaactaaagggtgtgggtcagggaggggtctagaggctattcctaggcctcaggctcccaaatatgcccctccccagtagctacggttscctgcctaggagctgggganggagagatctaatcncttcaaggaagtgataacactggagt

SEQ ID NO: 14326 - DNA, 461 bp, Homo sapiens
tacttcttcactatagagcatttacttttagtctctagatgtatattttggaatgctatacttggcataacatagattaaaatcataatgcatgactaaaaactccttggatttatttcccattttaaaatttttagcggtaagttcagatttataatctttctctagacttcacatggtctgaatgttgsctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacag

SEQ ID NO: 14327 - DNA, 452 bp, Homo sapiens
  misc_feature 389: n=a, g, c or t
ttaaaacttttggctcatcttaccagattttttacaaagatgcagatgttccttaaaagtggctgaaagattaggagttccttaaaagtggctgaaagattagggactttrtgcctgatgtgctggaatatgcccgagttctgttaaatctgatttaassatattaaatcaaawamttttctgatgtattcttatgccctcattttcatgtaatgttactactatgaagaagtgtaattaagamwtttgatatgagccttcacagtctaaagagtgcttcagtgacaacagttttattagattatggtgatgggcctggctgtgaaattcccacattcatgaacgactctgctttttactggctaaaaacaggattttaaatgcaatrncctttgggactctcagataagttgcctcttcaaccctgaggttatttgatgattgctggggac

SEQ ID NO: 14328 - DNA, 423 bp, Homo sapiens
aggaactattcagtaaaatacttttaaaaagcctcaggcaagaacatgattttccagattaggagaagggacaacatggcagagattcctgtaagtcttgggttatttctgagtgctggttatcgtggcatctgaaaatgtaaataagtgatgtaccctgtgggtarctctgctarsaggcaccccggggacctgctggtgamcctgsccttstcstgctgcgaacatcccaggccagcgtgacactcacagcagcgtggacgtctctctgcaaacgcccaaatgcagtgtatgaaatgtcatccctagaaatggcttcatttgggataaagctttgaacttgcgtgcgtgccccgcaccccgtggcggactgagtcactgctttgctgttgcggcgtggtgagtaaaactttctcaggggag

SEQ ID NO: 14329 - DNA, 218 bp, Homo sapiens
tggaggatagcatagttggagatttcaacaccactctctaaataattggtagaataagtaaaacacaaatcagtaattaacccagttaacacttaaccactccaacaacagcatgwtacacattctttactggtattcatagaatgtttactaaaatagaccatatcttgggccataagataagtttcaataaatttagaattttttttttttttttt

SEQ ID NO: 14330 - DNA, 375 bp, Homo sapiens
gacgccaggggatgcaaacccttctgcccctttttgctacccctgaagcttactgttagtggtcgagtttttctggaagtgggcttccgcgatcgcgggaccaacgccctgagctcttgtgcccaaaggggatcgccaggttttttgatgcggatcgaaagggactggccccggagcctacaacctgacgcaggtgggacttggggaaatgtcgagaaacctaggtctgggacttgagttggcttccagggcacacattcttgttcagaagaaacacattgcaaaaatcgggaggtgacgggcagatgaagtgtcggcgcttcgctcgggactccagtgcaacctatggggcttttggaaatgaggaagtcgatg

SEQ ID NO: 14331 - DNA, 277 bp, Homo sapiens
cacacctgtaatcccagcgctttgggaggccgaggcaggcggatcacgaggtcaggagattgagaccatcctgactaacacggtgaaacctgtctctactaaaaatacaaaaaaattagccgggcgtggtggcaggcgcctgtagtcccagctacccgggaggctgaggcaggagaatagcgtgaacccgggaggcggasttgcagtgagcggagatcgcaccactgcactccagcctgggcgacagagtgagactctgtgtcaaaaaaaaaaaaga

SEQ ID NO: 14332 - DNA, 402 bp, Homo sapiens
ttataggtgcctgccaccatgcccggctaacttttgtatttttagtagacgaggtttcaccatgttggctaggctggtctcgaactcctgacctctggtagatccgsstgcctcagmctcsstgttgggattacagatgtgagccaccgcacccagccggtgttggatactgtttacctagagtttgtctaaaagactagcctttgcttttttggtggcaaaaaaattttttttttcacctagaaactgggagccctctaaaggcagggaaaggaaactgaaatattcaattttgcacacttagtgccttgtaggctggcagaatcagcagaatgtaacgggtactatattcaggaggacctgagtttaartcctgtctgtaagatttgggcaatttactta

SEQ ID NO: 14333 - DNA, 82 bp, Homo sapiens
agastgggaaaacaacgatatggcaggagccagtcttggggcccgcttctaccggcagatcaaaagacatccggggatcatc

SEQ ID NO: 14334 - DNA, 420 bp, Homo sapiens
ttttcttatgttgttgggtggggtataccagcataaactctaaagataaaatctatgttagattgtcaatcaactgtgtttttgaacagcataattgtgtagcagcacattgcaaaaatgcattcatccaaagcgacacatgtggcaacgtagaccacgscagkaaataagccmcttcgtgatcacctgactccatttctccgtgtgctccattggctgcggctgcaggaggaagatgcctgacagccctcatgctctccgcagggggcgctcacaaagatgccaggggtgtttattgtgtttatttttttaattactaaaatcagtagctaagaaagggtccttgaagcctcctaacctgggttggacctttgaaaaatatatttgtagcacatattatagatggaaagaagaagatat

SEQ ID NO: 14335 - DNA, 410 bp, Homo sapiens
agaactcactgcaagcaaaaaggggaagaaacgctcacaaaagggaaggcagcaggaaaagtaatcgggttgctccgcctgcattctgcccctgtggaggagacctctggttctgcaactgcctgggagagtctaagtcggtgatggagagttaactggcctggtggacacatacctaccatgtcctgcaatctagcttaaagcttacactttaagaaacagaataacaagaatagattctagagctgagtttaaaccctggctccaccactgataagctgtgtgaccttgggcaagttgttagctggcacccagtaagtgcsacataagcatctgttaaaatctccatctgtctacattctttatctattcctcagttagttcagaacctaaatgggaaagaaaggtgt

SEQ ID NO: 14336 - DNA, 455 bp, Homo sapiens
atctaaaaatgttgttttgagacaattcttctgtgatgcttcctcctcatgctcataaatgtttaaagtcttgggatttcattttcaggctgaaatagataacaagaaaaaaatttaagtttaaaatgtttacattgcgttactaaattaataccaattcaaattaagtgacctatagtaaattaatggcaatgggggggaggggattttaaagtgattggcatattatgtgatactgtatcagtgatttagtgaaataatatgtatcatagcacaactctgttgggtattaaggcttcatcttagtatttccctgcgttgctctttgaaataaaattactaccataaaaataacctcttatcatattgatgtgtttaatttactcagttggcttctaatttgcgtaacaagattaatgtagtattttttgtactattattggaagcatgccttc

SEQ ID NO: 14337 - DNA, 434 bp, Homo sapiens
ggacccgattagtggataccactctttaaggttttagcaagccaactacttggcattttaggactctgtcattttcaacccatggctccaaggtcacagtgcttatttggatcataatagcaaaaaaggaaaagcatgtggaggctcatgagtggctggtttttattggctaggcccaratgtggctcaatttgttttttttttccctttccattagctagaacttggtaaggtggcsacatctgactgcaagggggattsctgggaaggtggtctaggtgtttgcccaggaagaagaagaaacaggtttgatgaacagctggtccatctctgccacatatttacctctcggaaacttcattccacccttacttttmacttctctgagctcttattttacttataaagagcactatcarccttaggatttaatt

SEQ ID NO: 14338 - DNA, 406 bp, Homo sapiens
ggaattttccgagaaggcgcttctgaatgccgaatcatgaatctctcctcttaaaaagctgacttttcattttggaaaaagggggtcctgggccctttaacagcttgccaggtgctcaaacgctgcttcccagaatgcgtggcgctatgtaaatgagacggtttggggagcgaggatgattcatactatatgaagtgaaggcaacgttttacaaggacatctctcacgataaatgagtggggagaacttatagcccttgaagtcaaccatctcacacctttccaaaggacgcgaccataactctaaaaggctccagatggaccctgggaaggacaaagagggggtgccccagccctcaggscgccagcaaggaagaaatttgtgatacccctcgacgagatgaggt

SEQ ID NO: 14339 - DNA, 448 bp, Homo sapiens
cttgctattttccatttcattaatgatagccatcctagtggatttgaagtggtaccttattatcgtggtttttattgcattctctattgactaatgatatcgagcatcttttcatgtattttttggtcatttggtcatttttcttttttaattttaaaattttgagacaggctctcactawgttgcccaggtggtctcaaactcctgggttccagcgatgctcatgcctcagtctcccaaaggggtgggattacaggtgtgagccactttgcccagcccatttgtatatctcctttggagaatatctaggttcttttgaaggtagctgcatataaactagccaaattaacagactgtggtttttagatggctttccatatctacaagaactatttagttctcaaaactgggaagaaatgtttcagaggcatcattaattcataatcta

SEQ ID NO: 14340 - DNA, 466 bp, Homo sapiens
cccggaggaaccacccccgccctcctcagcctgatcctggaagagactcggggccccccagcctccgccaacccagagacggggtttcgccatgttggctaggctggtctcaaactcctgagctcgtgatcctcccgcctcggcctcccaaagtgctgggattatgggtgtgagccamcgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggtttgagatggacacgtgacccaatgagcggcctttcctgggagttctacca

SEQ ID NO: 14341 - DNA, 314 bp, Homo sapiens
agtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcacacgcaaagaacaggtattactactaccaccggcagtaccgccgcgtgccagacatcactgagtgcaaggaggaggacatcatgtgcatgtatgawggccgaaatgcagtggaagaggggactacaaagtcgaccaagaaaattatca

SEQ ID NO: 14342 - DNA, 481 bp, Homo sapiens
cactgagccctgggatgtgagcccatgaacactcagaccaggaaggacttgacttcccttccaggtccactcccaactgggaggaggccacaggggagaaatggctttctggtgtgtttgagcagaaagcaccttgaagagctctgacccctggcttcccaggataaaatgattcctggaccggcaggggctgggaagggtgtgaggtggcagccaggggtgaaggcaccatcgggatgggattttggagcaagtgtaaagtgtgctagagcagaacaagactaataacaaataataatgataataataaataatgatgcatcattgaatacataccagacactgctcgaagcagtttgcacgtgtgttggtttttaatggtggtaaaatgcacataacatgaaatttaccattttaatcactttaaagtgtacaattcagtggcacttagtacattcgcagtgctatgcaaccatcacca

SEQ ID NO: 14343 - DNA, 416 bp, Homo sapiens
tatatatacttatggggtacatagtgatgttttcatacatacaatgtatagtggtcaaatcagagtaattagcatatccatcacctcaaacattgatcatttctttgtgttggatattcaaaatcaaatgaggccgggtgcagtggctcacgcctgtaattccagcactttggaggccaagwgggtgtgtggatcacctgaggtcaggagttcaaaaccagtctggccaacatgtgaaacaccgtctctactaaaaatacaaaaattagccagatgtggtggcatgcacctgtaatcctagctacttgggaggctgaggcaggagaatcacttggactcgggaggcagaggttacaatgagccgagattgcaccactgcactccagcctgggcaacagtgagactatgtctcaaaa

SEQ ID NO: 14344 - DNA, 464 bp, Homo sapiens
tatgaggaattgtccaagttggagtttaaatagtatctgcttttgtctcaaagcatctaagttattctgacagaaaatggtaagtcagctttgcaggcagatgcgcctctgggcctcctaccttgctccgcagctttctggssatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcatt

SEQ ID NO: 14345 - DNA, 274 bp, Homo sapiens
  misc_feature 154: n=a, g, c or t
acttgtgatcggaggagagccggatcgtccttccttgaaccctctgggtagggctgtgctgagsggctgggcggggagcacaggccgtgtccgctcgcttgcaccttttcagactgccgtgtcaggcctcgagccgggcccacctggagccctnccctkccsacccgcscccagcgaccgatatccgcccccggsccagaagggcggcttcggtcatccccagtcccgtcgcggccactgacccttgagatcagccctcscctcccsascttcc

SEQ ID NO: 14346 - DNA, 289 bp, Homo sapiens
cccacaggctgggtgtggtggcttatgcctgtaatcccagcactttcggaggccgaggtgggtggatcatgaggtcaataaattgagaccatcctggccaacatggtgaaaccccatctctactaaaaccacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaa

SEQ ID NO: 14347 - DNA, 383 bp, Homo sapiens
cattcaattctgggatattttcttaatttattaatttgatttctatgtttttcattcactctttctggcattctgttaattccatttgggctctctggactgttgtsctccagttttssmttatttattttccatttctgtmtttttacttcattttttgagamgatttscttagcttaatttccagatctttacggagtttttaatctcatctaatatttttaatttctaagagctatcttttgggctgggcgcggtggctsacscctgtaatcctagcactttgggaggctgggcaggtgggtsacttgacgttaggagttcgagaccagcctggccgacatggtgaaacccatctctactaaaaatacgaaaatyatctg

SEQ ID NO: 14348 - DNA, 313 bp, Homo sapiens
cttctctcaaccatggacagctgctcaagcacacttaacatgtgttctgatgtgttcacttagatgtatttgtaccctcaaaatcgcatgctggccgwggtgctgtgtgtgatttgcgtaagtgatgttccactctgsgtctcatctgtstctggctctcttcagctttaaccctatmcctacatgtggaccgagttcactgcttctgactccggcttctaaatcaattttctatagacatgtctatagaaaattgcttgaacccgggactcagaggttgcggtgggctgagattgtgccactgcaccccagt

SEQ ID NO: 14349 - DNA, 418 bp, Homo sapiens
ttctgcagtgttggagtggaacagctaggaaatgacaagggtggataaacaatgtttggcttctcttaagtaagacttaattttttttaggtaatgaaaatattagtacttttgtatattgattgccagaacaaagccagaactctgatgcaagtttgtatacctgagaaggtactcaartcggagggatagaagsttccttttgatgctggggtgggttgttctgaggtaacaatgatttatttctgtatttctttttctttttggagacggggtctsactccgttgcccaggctagagtgcagtggtgtgatcattcctctttgtagcctcaaccgcctggctcaagtggtcctcccatctcagcatgtagctgggactacaggcatgcatgtgccaccatgcctggctaattttt

SEQ ID NO: 14350 - DNA, 428 bp, Homo sapiens
ataatatgatacgtatgttaacaattaatggaccaatatggatacattagtattaactaaaatccctatttatttagatttcaatttttacctaatgtccattttatgtcttaggatcccattattgtatttgctttttaattgggcattctcttgaaattaagagaagtgacattttaagctgggtgcggtggctcatgcctgtaatcccagcacttcgggaggctggggcgggcggatcacttgaggtcaggagttcaggaccagcctgtccagcacggcggatcgtgtctctacaaaaaatacaaaaactagctggggttggtggcacacgcctgttgtcccagctacttgggaggctgaggcgggaggatcgcttgagtctgggaggcggaggttgcagtgagatsggattgcaccaccgcact

SEQ ID NO: 14351 - DNA, 325 bp, Homo sapiens
  misc_feature 69,260,264: n=a, g, c or t
tagaatgctcagaatggttcttggggccgggtgtggtgcctcactcacgcctgtgatcccagcattttnggaagccgaggtgggcggatcatgaggtaaggagatcgagaccatcctggctaacatggtgaaaccccgtctctactaaaaatgcaaaaaattagccaggcgtggtcgcgggtgcstgtggtcccggctgctcaggaggctgaggcgggagaatggcgtgaacccgggaggcggasttgcagtgggcgganattncgccactgcactccagcctgggcgasagagtgagactccgtctcaaaaaagaatggttctt

SEQ ID NO: 14352 - DNA, 182 bp, Homo sapiens
cctgtgtacccgaggggtaatgattaaatgataaagataagaaaagcgcccatgtaacacaaactgccattcaacaggtatttcccttactacctaaggaattgtaaccattgctcagacattgtaggatttaactatgttgaaaactacaggagaggccgggcgcartggctcacgcctgt

SEQ ID NO: 14353 - DNA, 162 bp, Homo sapiens
  misc_feature 130: n=a, g, c or t
aggttccacaatggtacaggcagcatcacgctgcacaatggtttccaggcagtgaaagagggtgattcagcaagccactcttcttctattttctttaacstccccttcactttttatttttatgggggtnggtggtgcttgctatatgcttacctttttctt

SEQ ID NO: 14354 - DNA, 514 bp, Homo sapiens
  misc_feature 254: n=a, g, c or t
gtttgctttgagatgtctgtgagcacatccttcctctaccatccctggttagaatggcgttctcactcacctatccacgctgcagatgagggtgaagaagtaaaaccatttaaaacatgcatcgcagcaaaccaacatggcacatgcatacctgtgtagcaaacctgcacgctgtgcacatgtagcctagatcttaaagtataaaaaaacaaaacaacaaaaaaacatgtgtaaccaacacacaaaaccctacncaaccaaacggcactggtctctttcagagccttccctcaccaagccctaccctgtccccagagatgaggccatgacatgacagtactttagagagttttagcaacgctttgttttttgagcccatgtgctcatatgagcttgttcaaaccccagagtaggggcctgaatgactggacctttacacatcagcgctggcccagaaggttacagattggcactgggagtctcccaggaaggaactgctgagcactttttagtt

SEQ ID NO: 14355 - DNA, 96 bp, Homo sapiens
attagttgtcttttatttcttctccttgtggacagttgttaatgaaaggagtaaggatttccctttttttgttttgtttgttttgttttttttaac

SEQ ID NO: 14356 - DNA, 352 bp, Homo sapiens
agatttgtgtggggccacaaagccaaactatattagggcatataaagagttttgggctgggtggggtctctcacgcctgtaatcccagcactttgggaggctgaggcgggcggatcacaaagtcgggggatcgagaccatcctggctaacacgttgaaaccccgtctctgctgaggatacaaaaaattggccgggcatggtggcgggcgctgtggtcccggctgctcgggaggctgaggcagggagaatggcgtgaacccgggaggcggacttgcggtgaggcgagatctcgccactgcactccagcctgggcgacacagcaagactccatctcaaaaaaaaaaaaaaaaag

SEQ ID NO: 14357 - DNA, 498 bp, Homo sapiens
  misc_feature 124: n=a, g, c or t
agaggaacctaggacgctccaggaatcgggtgtgcctggccctggccgggggctgcccccgggagcagcgtccaggcccatggcggatgcagtctagaggactgcctggaggaggcggcgccgnggcgagacctccagagcgcaaggccggcgggagaaaagctgaggaagtgggaaatctgtggctggagctcagcagattgcaacacttctacatcaagaaaatgtggcaataaggctgccaaaccctcctgtcttctgaaccgaatccttgtagattctggatatcgcaccttcataggaatattctgagaatattttctcctattcgcttccaggagccgtcgtagcatccgattaggactggctgctggtgtggtgatgacctagagggcttctcccagagtctcgctctgtggcccacgcctgagttcagtggtgtgatttccgctccctccaacctctgcctcctgggttcaagcggttctcctgcctcag

SEQ ID NO: 14358 - DNA, 198 bp, Homo sapiens
gtgaaggatgctaatgggtaaaaagaaagcatctaatggcattaaactcaccggcaaaagaaagaaaactcactggtaaaagaagacttctgaaaaattcagaatattgtaatactgacaaatgggatgagtaaaccacttatattttaagtatgaagactaaaagacaaattttttttttttttttttttttttttt

SEQ ID NO: 14359 - DNA, 550 bp, Homo sapiens
ttgcccatgtcagtggagctggtggcagagcatccgcttggcagaggatggcagcccacagccccaggcgatggaggcaccccatttccagtgtggctgcttcgtgcttgctgttgacttgcagtttggaaccttgtactgcgtgcttcattcgcaggacagaagctaaatctgcgccctctgccgtcctctcagaggaagtgcctgtatttggacaaaaacttgggacctgctgaatggtggggctgaaagagctgtaacacaaatgggactgaaacacacccctcgcttaccacattgcgagagaagaggagagaagagttgcggcccttcggggagcccagacctgggagctccctgagccaggtctgcgactccctctttggatccctgcagtttctggagtctgcaagcttctgagcatcaccaccttgcctggtgctaaccacggaatctgcttgcggtgcacctggtccagccatggccttgcagtgagctggtccccaatgctggcacctagagctgcccatcccactgcagcagcagtgtg

SEQ ID NO: 14360 - DNA, 459 bp, Homo sapiens
caatgttgggagtggttgtvgctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagt

SEQ ID NO: 14361 - DNA, 334 bp, Homo sapiens
ggaaggcgcacggggcgaagatggcggcggasacaggaggcgctgagggagttcgtggcggtgacgggcgccgaggaggaccgggcccgcttctttctcgagtcggccggctgggacttgcagatcgcgctasvgccttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagat

SEQ ID NO: 14362 - DNA, 453 bp, Homo sapiens
ttatattgatggtccttgcagtaattctactcacaaatcctgggaccccctttgctaataaggctttcattcagtaagcatgcagtgcccataaattatttgacatctactgcccaaaattacaaccaagtatatgcagctttgctttagtgccctgatataaattcacatgcagatgctgtttgaattatgagtgtgattgattttcagtgatgccatttgaggagactagtgagtttattgtgcttttctggcctccactgtgagtatctcgctactctagatgacagccctaaatactcccagttagacccattaaaaaagacatatactcactttctattcaggacagcttgaaaaaaactggccatgtcctccggcctgtgtcactgctattaccagctatataacctcttgaccgaagtgaagtttctctcctgaccagaaaggata

SEQ ID NO: 14363 - DNA, 347 bp, Homo sapiens
ttgaattgatatttcatcttgacttttaaagccctagaggctaattgttagtaacatcaatttctattaggatatccgtttggccacacaccaggaggttagagcaatggagcattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacagaaaaattgtcttccatgaaactggtcccaaaaagggtggggaccacaggtttaaagcat

SEQ ID NO: 14364 - DNA, 495 bp, Homo sapiens
caggataaaacaaaaatcatgagccagacctgggtgtaactgccctggaggcccttgctctgggtcaccctgagtaaaggacttacctctcctaagcctcagtgttctcaactgtacagtgggaccaaagacacctacttcagagtcgagaggactaagaaactgcatgcaaagtagctagcctgctgcctggcaagcaagtgagggggcataaattgctatggggtaggctatcacatgagccatctccaaaaccagaagtggctcatttaagcttcataaccactctatgaagaagacatgttcatgtctatgctacagatactgaactggatccatagaaagggtaagtgacttgccctgggtcacacaggcagtggctgagctaagatctgaatccaggccacctggatccagaatccatgctccagctttactgagggacactgaaagctttcaaatagaggaggaaaatggtcagattgccctaacagc

SEQ ID NO: 14365 - DNA, 161 bp, Homo sapiens
attgttgcacacaaacgtggcatagaaaagaacatgttcagaagccatggggccaagcacatgcgggggacggtctcaaatgcgtgatcagacaatccttcacctttgctgaaaagtgagctcagatccagcaccatgttcctcctgacccatcctgtcta

SEQ ID NO: 14366 - DNA, 478 bp, Homo sapiens
gttgcaatgtgcaagacaggctgcttgccgggccgccctcggaacatctggcccagcaggccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgct

SEQ ID NO: 14367 - DNA, 437 bp, Homo sapiens
aatcagggtgggcaattcacagcctttctgaactgactgaactagagcttgcagtgaagtgttctgctgagactgagcaccttacagatatttttctccagaagatggtgctgggtaataaaatcatcacaattagggaatggttagtggtctctactgtggcaaatgccaactgttggaattcactttawtgkdgraaaaacccmaaaytgrgacyctwaagttttgtttagcaatgtgtttctggtatgaaacaaactactgtgtcactgtccaggtaggaaacaattctttcaactgggttttcagcataaatgggaactgatgtagaaggcaggrtttagcccttctaggcaaaagaaaagctcagttgggtttcacgagtgttcctgtgcttatattcagtctgtgcctacatgttctcatgcatgtctaaa

SEQ ID NO: 14368 - DNA, 310 bp, Homo sapiens
acttaaaatggaatgagcgtaatttgaaaaacaaaatagccctggcacttctttttgtttagaacaacgtatagaaagcacatgcctcactgagaatacttagtggaatctcgataaccacaaaagcaattaaatgcttttaaattatagaaaacactaaaatttttaaagttgttcacccttggtagcttttaagtaaggatcacttgtgatttatagttgtagcttttcttgaacacgtcctcttgcactgatgactaacaaagttagttttaaacggaggtttgctggtgggttttttttttttttt

SEQ ID NO: 14369 - DNA, 566 bp, Homo sapiens
ccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggagaacttcatgttaactagagtgtacaaaaagtctgtttcctgctgagccaatagtgatttgttttgcatatcacctaatgtgaaaagtgctcatctgtgaactctatagcaaattatattttagaaaatactttgtgag

SEQ ID NO: 14370 - DNA, 297 bp, Homo sapiens
aaccaggccagccatggtggctcacacctgtagtcccagcactttgggaggccaaggtgggtggatctcttgagctcaggaggtcaagaccaggctgggcaacatagtgagactgtctctacaaaaaaaattaagaaaattaagtgaccataatggcgcacacctgtggtcccagctgctggggagagtgaggtgtgggggttggcagaggggagggcatcgaggagttccatgctgcagggagcaatggttgtgccactgtactccagcctgggcaacacagcgagactctgtcca

SEQ ID NO: 14371 - DNA, 430 bp, Homo sapiens
aaaccttctatatcacttaattctgcccagtgaaaatcagtgaccctgaggcactgccagattctaaagtgcctttgggatcatcagagactgtctataaataatgcaaaatcttgatctggatgtcagtgtatcaaatcttatcaaatccattgacaaatcagtggtgctatactggaaatggctactcctttggatgaaggacctcatttcccagttgcttggaacaaaagagaatttacatattgctgtaagaagggagagacggcagttgttggtagacacacagataagggtgcccaagaataattctgtctggattaaaggtcccagggaagtgacggtgccatttctgtaccaagaggtgaatataatttgcatgttgagtgcagtaattaagaacaaacgactcgactccacaaattaaacc

SEQ ID NO: 14372 - DNA, 462 bp, Homo sapiens
caaaaagggaaaggtagaaattacctttgaagagtcttcaagaacagcagtgaatcagagagtagtggagtggagggattggttgaatagaaaaagaatggatggacctgaaaattaatagagctcatcttgttactttcataattttttaaacagtgaattttttaaaaattaatataattggctgggcgcggtggctcactcctgtaatcccagcactttgggacgccaaggcaggtggatcacctgaggtcaggagtttgagaccagcctggccaacatggtagaaccccatctctactaaacatacaaaaattagccaggcgtggtggtgcatgcctataatcccagctactcgggaggctgaggcaagggaattgcttgaactggggaggtggaggttgcagtgagccgagatcgagccattgcactccagcctgggtgacagagcgagactccatc

SEQ ID NO: 14373 - DNA, 512 bp, Homo sapiens
actcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggttctgaagcccatgctatgacagaagaagcaggcctttgaagctatcctcgggttaagaaatggtgccctaaagaggcaagcatccctttctccgttctgctgtagacaccacatctga

SEQ ID NO: 14374 - DNA, 73 bp, Homo sapiens
ctcctaatcgaaaaaatcacacctgtaatcccagcactttgggaggctgaggcgggcggatcacctggggtca

SEQ ID NO: 14375 - DNA, 81 bp, Homo sapiens
ttatacttagcttgtcttacccatgagtgacggactgcatgtggcccaggacagttttgaatcgcagttcawcacaaattt

SEQ ID NO: 14376 - DNA, 449 bp, Homo sapiens
taggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaagtccagctcgtagcacaccccacag

SEQ ID NO: 14377 - DNA, 193 bp, Homo sapiens
ctaaaattacataatattatttaaaatatttttaaagattgcgtaaagattacatagaaagcttctgaaatattgtacaagtggctatctaaacaggaaatttggcagggcgcggtggctcatgcctgtaatcgcagtactttgggaggccgaggtgggaggatcacctgagcccagggagttccagaccagc

SEQ ID NO: 14378 - DNA, 307 bp, Homo sapiens
cagaaatggttaaaagggctaggcgcagtggctcacatctgtaatcccagcactttgggatgctaaggtgggcagatcacttgaggcaggagttcgaaaccagcctggccaacatggtgaaatcctgtctctactgaaaatacaaaaattagccaggcatggtggtgcataactgtaatcccagctacttggaatgctgaggcaggagaattgcttgaacccgggaggcagaggttgcagtgagcccaaattgcaccactgcactccagcctggatgacagagtgagatctctgtctcaaaaaaaaa

SEQ ID NO: 14379 - DNA, 477 bp, Homo sapiens
gactttagaaaactacttcttttcttttctttttttttcctttttaaggaagaataaaacctggattcaaacctctttccattggctcactttggtgcatcaatagctcttccaagtcatgctgagtaatgcctaaaagtgaacttgtcaccttcctcacctattcacaaaaccttctgttctgatgtgtcctatccattttctagtccaaaagtttctgacttttagcaggtcagaaactggctctaacaacttcctataggattagattctcacgaacttcagatactaggacttctggatagagaagataaagtaggttttaamatcaatggtataagaaataaatttaaaacatgagaaataaaaaatagaccataaaaaatgcatattttttgaaggactaaataggatttttatatatttatcaaaattaactcagtggacatgctaagtattacacattgataaagagag

SEQ ID NO: 14380 - DNA, 231 bp, Homo sapiens
gtcgaaatgcttcccggtgccgggagtgagcgatgagctggcttctgttcctggcccacagagtcgccttggccgccttgccctgccgccgcggctctcgcggttcgggatgttctatgccgtgagaggggccgcaagaccggggtctttctgacctggaatgagtgcagagcmaagtggaccggtttcctactgccagatttaagaagtttgccacagaggatgaggcct

SEQ ID NO: 14381 - DNA, 471 bp, Homo sapiens
cacaacttcaaaatttagtctgggcctagtgcagtggctcacacctataatcccaacactttgggaggccaggagttttgagaccagcctgggaaacatctgcctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcatt

SEQ ID NO: 14382 - DNA, 261 bp, Homo sapiens
ttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaa

SEQ ID NO: 14383 - DNA, 483 bp, Homo sapiens
tcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacatttttta

SEQ ID NO: 14384 - DNA, 412 bp, Homo sapiens
atataatatcattttccaaaactgtccagtaagttttattatttttaaaactagtttttcaactcattagttctaggctgtactctcttgtaagctttatgataaccactttagttttgtgaataataaattttattcttttgttaatacttgtatacaatttaattgaaaactgtagcwtgcacactggaccagatgagtccctcactggcacagtgccctgcacctggagtgatgtttcataaaacggaattttaatagtgtaagagcaccaagatttctctgcacctatacctagcgttggactgtgcattccaaatgaaattcctcctctttatccctgtaatgcactgactaacagaagacttactacacatttaaactgtatattgacatgctattaaatgcgttt

SEQ ID NO: 14385 - DNA, 239 bp, Homo sapiens
  misc_feature 175: n=a, g, c or t
acccggcctgccccgcgccgccgcttccggaagtgggtctcgtctcctcccaagcggasatttgtgcctgaagctgccgggtctgctacggcaccgcggggctgcagaaacccgggggccaagggcgggctgcttgccgctatggctggcagtcaggacatattcgatgccatcntgatggcggatgagaggtttcatggggaagggtatcgggaaggctatgaagaaggcagtagttt

SEQ ID NO: 14386 - DNA, 372 bp, Homo sapiens
agtgtcttctgggttatgaagtttcgacatcgcttctggacttgcagagcgttggtcagtccttatatggcggatagaggctcagtggcaccgtcagggagctggtaaacagagtgccggactccacggacaggacggggcttgggttgctcttaaaggcgacataaccagattttcttgaagtaaggtctaggatactcacagaaatgtgagggacctatgatatcggattgtgaagcacagcaagttctcaacggctacaccgccaaagggacacactataccmcaaaggcactctgtctctactcatgcctctcagccatatgttgcttttcaaatacacatacagttaaactttgacttctatttatt

SEQ ID NO: 14387 - DNA, 451 bp, Homo sapiens
atctctgagcctccgcggccttctctagcaaaatggtggagccggtacccggctgtaaggcaagctgggatgcgcggagtagcgggtggaaaactggastggagttctcactcggccgctgggtgacttcggtgcactagggatagtaacagtaccacctcgtagggttgtagaaagacmaagtgagttaatatttgtaaagtgtttagaacagcgtctactgcatggaaagtagtatttatttgttagagagactccaggaggtcttgcccagggattgacttctccsttccstgtctccascccccasattcacgtttgtgagccaagccttgcttttgcaccggccgggctctcttgcctggaaatgcatacccatctcaaacctgggctttaaaatcacctcstctgggacgccttcctctacttctcacagttcaggcctgttctg

SEQ ID NO: 14388 - DNA, 467 bp, Homo sapiens
gaaagcgtttcaaagcgtcmkgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttat

SEQ ID NO: 14389 - DNA, 443 bp, Homo sapiens
caaaaaaattaaaaaagaaagaagtgtgaatctttgtggctctgtgtaacctttttttcagtatattttccttactattctggggttctgattcagcttccctatgatagctgttgaccaagctgtatcccaaaggtgggagggaaagacagaagactaggcsgaatacggtggctcacacctgtaatcccagcacattcggaggccgaggtaggcagatcacctgaggtcaggagtttgagtccagcctggccaacatgatgaaaccgcccctctactaaaaatacaaaaattcgacaggtgttgtggcatgctcctgtaatcccagctacttgggaggctgaggcaggaaaatcgcttgaaccggggaggcggaggctgcagtgagctgagattgcaccactgtactccagcctggacaacagagcaagactctgtctcaa

SEQ ID NO: 14390 - DNA, 145 bp, Homo sapiens
cgaaaatagaggtggaggttgtagtgagccaagatcgtgccactgcactccagcctgggcaacagagcaagactccgaagttcgttttttttcttttttttgagatggagtgtcactcttgttgcctaggattacaggcattaag

SEQ ID NO: 14391 - DNA, 115 bp, Homo sapiens
  misc_feature 24,38: n=a, g, c or t
ttattatactttaagttctagggncatgtgcacaacgnggtttgttacatacatacacatgtgccatgttggtgtcctgtacctgttaactcatcatttacattaggtatatctc

SEQ ID NO: 14392 - DNA, 451 bp, Homo sapiens
acctgtcatggctgcctaactgacaacctgtttcctgttaaccaactccttttccttacccctccctagttcctgcttttccacacatggttacctttcttgctatataaactcccaattttagtcagtcagggacaaggatttgagactgatctcctatcttggctatggcactcatttaaagtcttcttcgctggcaatactccttgactcagtgattggctttctgtgtgcagcttcaaatcctttctgcgatgtagcaagatataaatacaaattactgggaatagccatcttggatatctaccccacaggtccttaaaattcaaaactgattaaaataacaagaatgagtctgggttccaaggtgatgacaagattaacacaagataattcaataaatacttgctgactgaaggaatagaagaataagtgcatgaatggtgaagag

SEQ ID NO: 14393 - DNA, 470 bp, Homo sapiens
atttttaggagagacggggtttcaccgtgttggccaggatggtctcgatctcctgacgtcgagatccacccgcctcggccccccacagtgctgggattacaggcgtgascaccgcgcccggcctgttccttttatttcttaattcaggacactaaaccatgactgcaagggatttccttagtaaaaagaaaagattctcagagtcaaaatgttcttacaactcgggcttgacggcctttgaattatgaatggattgttcctctctctaagcctattgtcacatgggtttttaatcctggccttgctgctagaaatctgtgcttgaagtcctctctttctgctggtagcctaccagttaaaagtcaagacttggtggaactcagtttaccagactctttagcctttgagctaaactgtctgagcaacctcttagatgtgcacacaccactttgtatgaaagggttctctag

SEQ ID NO: 14394 - DNA, 474 bp, Homo sapiens
aaaacaaaaaataagaaataaagtgggcttgctgagtgctttcatactgcatcatttattgtgcatttgtatgattattatatactttacaaattttcgttttacagtaatttgtattcattcgtttttcaacctgcttatttcagttcagtgtcttgggtagstggagcctatcccarcagctcagggagcaaagtgggagccaaccctggacaggatgccttttcatcacagggcgcactcacacggcacacacacgcatactgggaccatttagctgtaccaattcacctaacgtgcatctttgggaattgagaagaaaccagaatacccagagaaaactcatgcagatatgtggaggacatgcaaaattcacacagacagtggccctggttgtaaataattgtttttcatcaatgttataatgaaattacaggccgggtgtggtggcttacgctgtaatcccagcacttt

SEQ ID NO: 14395 - DNA, 442 bp, Homo sapiens
  misc_feature 353,377: n=a, g, c or t
ttatttaaggagggctcaatcaacaggtttagatggtgtgctattcataattattgcaaaaataggccgggcctgtgattccagcactttgggaggccaaggcaggtgaatcacttgaggccaggagtttgagatcagcctggccaacgtggtgaaactccatctctactaaaaataccaaaagtagcgggcgtggtgacaggtgcctctaatcccagctactcgggaggctgaggcaggagaatcgcttgaacccgggagtcggaggttgcagtgagccgagatcgcgccattgcactccagtgtgggtgacgagcgaaaatccgtctcaaccaagaaaaaagaaaaamagnaaaagaaaacttaactggcctttngggcacatgcctgtaatcccagcttcttgggaggctgaggcattagaaaaaaaatwaacctggga

SEQ ID NO: 14396 - DNA, 372 bp, Homo sapiens
  misc_feature 344: n=a, g, c or t
agatcatgaggatggtggttaggaataggagcactgacattttaagactttgagtctaaaaactgattatgtggttcacttcttgttttatttttgccacttctgttattaccagggaatgatattattgaactctaaaaaaaaaaaacatacgcctttatgccagccaagcagaagagtwtacaatatstttgatatgctgaaagaaattgaagttaaatgaattactgtgtctgggagggaatttctattasatcacaatgttacgggatccagtgtcacgttacctgagcgagtggaaacatgtccagagaggggccacttggaaaacctctcttcatatntttgatggaagargscccaccccagatg

SEQ ID NO: 14397 - DNA, 122 bp, Homo sapiens
ctagaggttgtgggcagcatggacagtcccccactcagaagtgcaagagttccaaagagcctctggcscaggmssctccccamsagggctttgcagatgtccttgaaagacccaccctagag

SEQ ID NO: 14398 - DNA, 457 bp, Homo sapiens
tataaatatatatcttcctgattgcaatttggagaacacaattatttacttgaccttcattcaaggaccaaattcagagggaagcatcgctgatttcagtgcttgagatactgaaaacagtgagaatatggtatctgccctacctaaaagatctggcaattgaatgaaacagagaagcatataaaagataaattgtgaagcatactacttattgctgaggaagatggtatcagggagtgggtagatctaactttttagggtgagtgaagagttttcgagtaaaaagtgggaaataattatacaaatagaggatatgacatatgcaagtataatggaggcaggaaagggttggaagttggaggaaatggtgatggcaccactgcagtgaagactaaggtgcaaaagatgaagatacaatgagattttgatgagccttttccctgtataaacatgctat

SEQ ID NO: 14399 - DNA, 457 bp, Homo sapiens
  misc_feature 423: n=a, g, c or t
ttttthttgatcttggggattctggctgtgaattttgtgcacgacaattatggtaaaaaaacatttgcttggtctaaagaagatcattaatgttttgtgaccatacaagttgtaacagtggattgtttttatgtgtaggtattgttaaatacagggactgtttccaggcacaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggnaaaggtctaccctggagccaggagcatcagggtt

SEQ ID NO: 14400 - DNA, 296 bp, Homo sapiens
atgttttgaggtttgaggctttttttccccttatcaactcaagwctttcctggttatcctgggctgtcagtatttggttatggactacattaattactgtagcttacagaggaaaagatgtgtgttttagataaaaagagctatttcgagctaaaaattattaacagatggccaggtgsggtggctcatgcctgtaatcccagcactttgggaggtcaagdtggatggatcacttgaggccaggagttcctgaccagcctggccaacatagtggaaaccccatctctaccaaaaaa

SEQ ID NO: 14401 - DNA, 170 bp, Homo sapiens
acaaaaagttagccgggcgtggtggtgggtgcctgtagtcccagctactcgggaggctgaggcaggagaatggtgcgaacccgggaggcggasttgcagtgagcccagatggcgccactgcactccagcctgagtgacagagcgagactctgtctccaaaaaaaaaaaaa

SEQ ID NO: 14402 - DNA, 379 bp, Homo sapiens
tggaggaactgcttcctgtagggcaagaactggaaaatgcaagcgccctgaacttttttrgtacttgaactaatattaattgtttaggggcttctttctttgtcactaccaatcctccaacttgatgcagaagaaacacaaacagtaaaataggtcacagacaaatagtttagagatttaagagatacgttagagatttaagagactgaaaactattaaagtcaaattggctgatctttccgttgcattcatgatgcaaaatcagtggcaaggtgccgggcgcggtggcttacgcctataatcccagcactttgggaggccgaggcgggcggatcgcttgaggtcaggagttggagaccagtctggccaatatggtgaa

SEQ ID NO: 14403 - DNA, 477 bp, Homo sapiens
  misc_feature 337: n=a, g, c or t
catagcagcactagtcacaataaaggtagaaacagctgatcacaatggttcactcctgtaatcccaacactttgggaggtcgaagtgggaggattgcttgagcacaggagttcaagaccagcctggacaacatagtgagacatggtctctgcaaaaaaatagaaaaatcagcagggtgatggtggcatgcacgtatactcccagctactcaggaagttgagtgagaggattgcctgagcccaggagtacaagactgctgtgagctatgatcatgccactatactccagcctgcgcaacagagtgagaccctgtctggaggggtggggggagaaaaanacaccatagaaacaacccawatgtccaatarcaaattgtagtccatccatacaatggactactactcagccatgaaaaggaatacagcactcacatatgctgcatgtgaatgaaccctggaagcattatgctcagtgtaa

SEQ ID NO: 14404 - DNA, 419 bp, Homo sapiens
aattgtaaagccaggaactatccttttcgctcccctccatctccttccctcatttcctcaattcctctccttaggcttttcccctcctccatccgtagtgttgtgtcatgggaggaaagaactgagcagatctgaagaaactgagctggccagccagaggcaactagaactattaggaaagcatagactctgaaagtccctaaagagattaccaaggtttaccctctttctaattccccctcctcccgcggagcaaagccagacatggccaactggacagctcccaggtatttgctgacctgtttgaccctgtgatccaagagcgacacaatggatatgacccccggacaatgaagcacaccacggatctagatgccagtaaaatccttctggctactttgatgagaggtatgtattgt

SEQ ID NO: 14405 - DNA, 481 bp, Homo sapiens
ttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagcttt

SEQ ID NO: 14406 - DNA, 477 bp, Homo sapiens
ctgatcttcatttaatgcccagtctgtaactaatgttctgtttaaagctctcttaatttgttggctatgagtgatttgtgaatctgggatgtaaccctgagtgaggagaaaagggcattgagccagcataaatctgaatgggcagaagccacaaacaaatgggagcagaaaagaagggcgagctcccccgcgccgcaccccgtgtataatccagtgttaacctctgaggaacacctcggctctcccaactgaggagagacaaaagagggattctttttacacccaggctggcgcattttcaagtgacaatctcgggctctagttgcctttgagatatccactctgctctttctcccaggcctcagaccaagaaaaacatgctctcaagattagcccataggcagttcttgtgacctggctgaagaaagaaaggagacctgtttgttttaaaagtcgggcgcaaagtgtcaggtggct

SEQ ID NO: 14407 - DNA, 474 bp, Homo sapiens
ctttcctggctgtgtggtggactcttcagggacacagcagtcactgcgctgcagggacagtccccaagtgccaaggcacagcctaaaggggcctgttcccaccatggcatccgtgacaagaaccaggagccagaatgcaggtttctgggacttgtcagctcscttctgagtgccctgttgaggattcctagaagtccagacacctcacccccctaacctggatgcaccacgcagagccaataggaatacttttctgtggacgtgccatgttggaatcccagatctccctgccctgccagcccctgccagcttcctggggacccaactgaccctgaagaaagcctctgatgggcctagaacagagaaggtgacccaggaccttgcccagcctttctggacaactggaagacagttacgcttcgtcctccacctctccctccaacaaaaggatcttagcaagtgttggagaggtgc

SEQ ID NO: 14408 - DNA, 356 bp, Homo sapiens
actacatcaagcgccctggagacgctcttcgtgcaccgcttctcccatggcactatgcctttgcgcaacatcttcaagaactgcacctactactggggcttcgcgcgtggatggcctattacatcaatcaccctctctacactccccctacctacggagctcagcaggtgaaactggagctcgcatctttgtgatctgccagctcggcaacttctccatccacatggccctgcgggacctgcggcccgytgggtccaagacccggaagatcccataccccaccaagaaccccttcacgtggatcttsstgctggtgtcctgccccaactacacctacgaggtggggtccctggatc

SEQ ID NO: 14409 - DNA, 478 bp, Homo sapiens
  misc_feature 437: n=a, g, c or t
tactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcgaaatgttgactttagttaacatatgggtttagcatttccagtgcagcattatcagtgggcctttaaaaatacttcgtaagtacattagctttcactttgttgttaaattatagcagactcattatagagaacaagtttgssttgattttgtttaaaatgacttctgctaagcacccagaagataaaattgacatatttttataatataagcatactttttttgtacattgtgttcattcttgaataaaatgagttctgtgtwggmttgtagatactagasagmnagtattgattttgattcagtaaatgttttctttcaatcctg

SEQ ID NO: 14410 - DNA, 460 bp, Homo sapiens
ctataaagtgctgcagctccttagctttgctgttgttatagtgtagctggagccatagacagttagttagttatgagtgagcacagctgggtgccagtacaattttaatgatcaagactcgtggcaggcagaacaaaccatcatttgttgatcctctgcttgaaagcacgaataagtgagaacagagcagtcatatggtttcagaaagtgttattctgggatttcaggataaattttgtaaaactagtaacaaacaacacacaggaaactaatttggtataagaaacgacatatccctaaattgcttatttaacttcattataaatacatctacttaacaaaaaaatatattttgtgatcttgaggtcacttcgtttaggtcattatctcaacccaacctccccaaactctggtttgagccaatatgtgttctattgttctcagagcaccagccgactgt

SEQ ID NO: 14411 - DNA, 220 bp, Homo sapiens
taattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtg

SEQ ID NO: 14412 - DNA, 320 bp, Homo sapiens
cattttacttattgttttcattcaacaaactgtgtgaaaattaacctaacaagatctcatttacttttggtgatgcactgtattcaaagatagaggtaggagagacatgattagaaagatcttcagaaagttaatatgggaggctgtagggcattcagataggaaaatgaaagaggmatttggatgtgtagtcctgaagcttagaaaaggaagctgtggtttaaatttaactggtcaatagttaatctcatgagatcgtgtatccagggtagatggggatactgggagaaaaatgagaaggcaagcttgattggtgacat

SEQ ID NO: 14413 - DNA, 441 bp, Homo sapiens
  misc_feature 281: n=a, g, c or t
tgagattctaagagtgtgtgtgcatcttgacaatattagaggaggctgagcccaagcaggcacattctcttcgacccctccctcattcagtctgctttggagtctactgaacatcaagcttgctatgagcaggatcttagagctgaggaattgacctcccaatccgaacagttgttataatcctttcttaataggttgtgctgtggacccaatgtgagggctgtgctggtgtaaatggtgacatattgagttggggggatgctttcggggtggggggactngttccattccatcaaaggccctcttgagagtctatccagggacccattgttttactttaacagaccagaaaagatgtttgttttccatgtcattacccccaggggataccgaatgtgtgggtagaaatttctctgtagattaacaatcagatttttacat

SEQ ID NO: 14414 - DNA, 476 bp, Homo sapiens
gccccagcaggaagtcccagttctggaggcagcataggaaagagaaaatcctggtctcctgttagaagtcagagcagcagacctagagaaggtgtattcagttcttggggaggaggatgtgaggatcgggagggaggtaggaggagagagctcaaaatcccaccagttgaaggcctgtgtgagctttaattttggccatttaaacaattcaaagaggctgggagtggtggctcacgcctgtagtcccggccctttggggggctgaggcgggcggatcacttgaggtcaggagtttgagaccagcctggccaacatggtgaagcccggtctctactaaaaatacaaaaattagccaggcgtggtggcaggtgcctgtaatcccagctacttgggaggctgaggcaggataatcgcttgatcccagaaggctggaagttacagtgaaccaagatggggccactgcactccaccctggg

SEQ ID NO: 14415 - DNA, 301 bp, Homo sapiens
gcattttcggccgggcacgtggctcacgcctgtaatcccagctctttggagggccgaggctggtggatcacctgaggtcgggagttggagaccggcctgaccaacatggagaaaccccgtctctactaaaaatagaaaaattagctgggtatggcggtgcatgcctgtaatcccagctactcaggaggctgaggcgggagaatcgctttaacccggggggcagaggttgctgtgagccgagattgcgcctctgcactccagcctgggcgacacagctagactccgtctcaaaaaatmaaaa

SEQ ID NO: 14416 - DNA, 169 bp, Homo sapiens
ccagttattcaggaggctgaagtgggaggatcacttaagcccgggaggttgaggctgcagtgagctatgtttgcaccactgcactacagcctgggcaacagagtaaaaccctgtctcaaaaaaaaaaargaaggaaagaaagaaacatttatkrtgtttctacttacta

SEQ ID NO: 14417 - DNA, 439 bp, Homo sapiens
  misc_feature 173: n=a, g, c or t
cgcattatggacagacttcgtgaatgggaatttgcttagaattgtgagtagttctgaattagaaaagtatgtgaaggaaaggcagctgtaaacgtattgtgccctggagagttgtacacatgttgaatgtaatctgggcttacctgatccatttcgagtggatgtcactgccnagtctgttctcacatggaaccatgtgtgtggggtcccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatactttttttttttaattaatagttacaggcttgttggtccagtgggatttgggta

SEQ ID NO: 14418 - DNA, 343 bp, Homo sapiens
  misc_feature 180,263,297: n=a, g, c or t
cagtacctccaaggaagtctcctttgcagttgatttatgtgtactgttcccagagccagcccgtacccgcgaagagcaacacaatctgccggtcccaaaagcaggaagtgtcaaccttgcagcaggatttggacactccaggagccaaactggatgtggaagstcsaaaggtgcagaaanagagactccaaaatgttgaattttasstctgtcstgggaatsaccctgasactagctgtcgagatacttaccagtttttctgncctgattggacatgtgtaactktaagccacctantctgggggatcaaccagatcttcattccataactcgtgmttcwsgt

SEQ ID NO: 14419 - DNA, 404 bp, Homo sapiens
tttttttttcagtttttgtttttacttttgtcccgccgagtactatgtattaccagccccccaccccacagatcagttttcctagtctttgggaaacgggttgtgttttttttsstttgccgtgttggatttscggtcccggctgacacctcccttsgtgtgtgcgcccctmcccacccctgcctttrtttcggtgccctgtgtccgctctctcatgtggggatgtttgtgctgcagacaaaaagaacaaaaaaaaatttttaaataccacaagatggaaaaaaaaamcaaaaaaatttaaaaagatggaatgtagtgtttacattaaagcsgcsgttttsatgaccaatcctatgtsatttctactttgamtaatacccaaaccctaaacctcttcacggttt

SEQ ID NO: 14420 - DNA, 463 bp, Homo sapiens
  misc_feature 417,454: n=a, g, c or t
ccagaaggatgtatttagatatgaaatgacatggtgtcagggacttgttttataataatgcagccaaaaaagagagaaggagaaagaaaagggggcaagggaaggaaggaaaaaacaaaggaagaaaggaagtcagaagtaaaatgttttaattgttgaatctgtaggatggggttcattatactattctctctacttgtggttaaaaactttcattaaaaaaaagtcaggctgggccgggcgcggtggctcatgcctgtgatcccagcactttgggaggccaaggtgggcggatcacgaggtcaggagatcgagaccatcctggctaacacggtgaaaccagtctctactaaaaatacaaaaaaattagccgggcatggtggtgggcgcctgtagtcccagctactcgggaggctngggcaggagaatagcgtgaacccaggaggcggacttncagtgagcc

SEQ ID NO: 14421 - DNA, 402 bp, Homo sapiens
  misc_feature 31,46: n=a, g, c or t
aatatggattatgatttcaaggcgaastggncggcggasgggaggngtggaggatttgtttgagtacgaagggtgcaaagtgggacgcggcacctacggtcacgtctacaaggcgaggcggaaagatggaaaagatgaaaaggaatatgcattgaagcaaattgaaggcacaggaatatcacatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttacc

SEQ ID NO: 14422 - DNA, 497 bp, Homo sapiens
ctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaa

SEQ ID NO: 14423 - DNA, 447 bp, Homo sapiens
ataatctaggtaagacacagtagagtcctgggtaaatcagtggcagagaatgaagagatgattagtggcattttggagacaaaattaacaaaattaatttgatgtagagagagagagaaggccaggataactccaaatttcatcttaagaatgcaaccttgagctgttagaaactatatwagtgtttgttcaagtcttttgatatgtgtgtatgggtgggaggggggaggatgtggatgaaatcagttgtgctgagagtctgtagtttttatagcccaaggtggagactttgccagtaaatgggctcagaggaacctggctatagttagtcaggaaaagtattttgtcaatcttcctatttctcttatatacttaatattttttaaattaacttaccttttatatgtaaatgaatttttaaatagaaaactttgtatgattaatata

SEQ ID NO: 14424 - DNA, 455 bp, Homo sapiens
  misc_feature 346: n=a, g, c or t
caacagtggaatataatgtttaataacttgggggggttatgtgttttgtttgtttttttttttagctcttcagagaagtaagaataatgaagattttaaatcatcccaatataggtactttctgcttttttaaatattttggggtctaaatacgtacttgaaattatgtcataaagctaaacacgtattctagaaatggtagagtacacttctagtaaaatatatawacaagttgttgatcatttgtattagctttttgaaattgctgaagacaggttaaaagcttaggtattaaacgttgaatttaaagctttaatctggtagaaacatctgtactctgattatnattttctaatttttaagtatattagaaaatrtaattgtatggcatgagtagatagaagggaattctmggaagtcagaattaatattttcaaaggggctgagcacagtgg

SEQ ID NO: 14425 - DNA, 173 bp, Homo sapiens
tgaaaaagcaagtcatggccaggtgcggtgactcacgcctttaatcccagtactttgggaggcggaggcggtcggatcacttgagatcaggagttcgagaccagcctggccaatatggtgaagtcccgtttctactaagaatacaaaaattagcgaggcttggtggcaggcgc

SEQ ID NO: 14426 - DNA, 373 bp, Homo sapiens
aaaaaatgacaagtgaagtttaaaggtcaattgataacgggggggaaaataatatataacaacacattaggttaaatccttaaagagctgcaacatggctgggcgcggtggctcacgcctgtaatcccagcactttgggaggctgaggcgggtggatcatctggggttgggagttcgagaccagcctgaccaacatggagaaaccccatctctactaaaagtacaaaattagccgggcacggtggcgcgtgcctgtaatcccagctactcaggaggctgaggcaggagaatcgcttgaacctgggaggcagaggttgcagtgagccgagatcacgccactgcactctagcctgggcaacaagagcaagattca

SEQ ID NO: 14427 - DNA, 415 bp, Homo sapiens
aaaactgtcaaccgtcactttggaaatggawgcatttccagcaaagctttcccaactgaaaaggaagcatccaggctccttcatggccctgcccagagtggtggcccacggggaatttcccaggaaagcatgaaagcgtctaatgcttttgtgacacaatcaggtcaaacatgataagaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccat

SEQ ID NO: 14428 - DNA, 213 bp, Homo sapiens
tatttgatcctcacagcagccttgtggcatgggcagcccaggccttctgcttacctcatttcatatacaaggaaactgatcctcagagaagctaagcagcttgctgcagttcgtgcagtggaggagagccatagctctcaggctccaatgttcagcacattttttcatttgtttttataaaatatttacttttaagaagtagcattttttttt

SEQ ID NO: 14429 - DNA, 442 bp, Homo sapiens
ctccaaacttactcttcattctcttgcctctgtgttttgcaagttctgaagcctctatctcatatttcctcacttggtaaactccctctcatccccacaattaaagccaaaggstcacatcctctgagaagttcttcttgactcaaggccttccttgtctgcatcaaataaccttaaagactctttaaagtaattattgtcttatttatctattttgtccactacagttgagtacaggtgccatgtctttcctacgttgagtgccagaggctaagctggggctcagaaaacatgttgaatgaacacatgaatatatccatactaaaattgcactaggccaggcacagtggctcacacctgtaatcctagcactttgggaggccaaggcggatggattrcctgagctcaggagttcaaggtcagcctgggaaacacggtgaaa

SEQ ID NO: 14430 - DNA, 465 bp, Homo sapiens
ctccagttgaaggtgagaaatctgtaccaatcattcaaaaagggaatctattgttttgaaagaaactctctcatatttcctttaaattgttaatagttgttatgcaactaaagaatgttatgaagaaaaatagcattgcaaaaagtaccattggccaggcttacaagtcagccacaatcagtcggtataactactgtgttattctttttctagacaaattttgactcttctacttttatgtgtaataattccagtattctatttatttcagcattatgtgaaaaatgataagaatgttaaaaagaaaataatagtgtggtttaattggtatgagatacctgcttcctcctcctcaaaggtttgactgggtgtatctctcctatgtgtgacattatgtctcctggtgttaacacaggaaatgagtgctcctttttaaaatttctttcttccaagtttttttttcca

SEQ ID NO: 14431 - DNA, 256 bp, Homo sapiens
tagtttgtctcctcttcttgttcttctttaaaatcatcgctactctttgtgttttgcttttccatatacattttagagttctgctccatgaaaaaccctcctttgattgaggtcatgcattaactatatagattagtttgaagagtaatgatattcttatgggatagatatttcctgtgtatgtcttctttaatatctatatttarggtctttttactgtatasatcatttttagtaactttttaaatgttaataa

SEQ ID NO: 14432 - DNA, 295 bp, Homo sapiens
gcattttcrgccgggcacgtggctcacgcctgtaatcccagctctttggagggccgaggctggtggatcacctgaggtcgggagttggagaccggcctgaccaacatggagaaaccccgtctctactaaaaatagaaaaattagctgggtatggcggtgcatgcctgtaatcccagctactcaggaggctgaggcgggagaatcgctttaacccggggggcagaggttgctgtgagccgagattgcgcctctgcactccagcctgggcgacacagctagactccgtctcaaaaaa

SEQ ID NO: 14433 - DNA, 398 bp, Homo sapiens
aataatgcaagctgggaagaaaaccctcactgaactcaacaatgctggcactctgactccaacctccagacaagatggagtttcaccgtgttatccaggatggtctcgatctcctgacctagtgatctgcctgsstcggtctcccaaagtgctgggattacaggtgtgaaccamcacgcccagccaagattatgtttaaatgttaagtgaaaaaggaacataaaatggattcaattcctsgagggctattagactgagggcctgagttcctcactggctgttggctggcgaacactctcaattccttgstatatgtgcctctccaacatggcagcttgtttcatcaaagccagcaaaagtgggaggaaggaggaaggaagagacagaatgaatctgct

SEQ ID NO: 14434 - DNA, 477 bp, Homo sapiens
  misc_feature 443..444: n=a, g, c or t
aaaatattttcattaccccaaaaagaatccgtgcagccattagcagtttctcaacatatttatacattttttccgcagtttaatttttttatttgtataaatttaatgggtacaagtgcaattttgttacatggatatattgagtagtcatatgttttttattcatgtcttgtatttcctaaaattcttgcaataattgttacttttataataaaaataaacatctgttacaaataaagttaatgcaacatatactataaaaataaacataggctgtgcacagaggttcattcctgtaatcccaacactttgggaggctaaagagggaggactatcctgtaatcccaacactttgggaggctgaagagggaggactatttcagatcaggagttcaagaccagcctgggcaatatagtgagacccctatatctttgaaaaaagnnaaagaaaattagccgggtgtggtggcgcatgct

SEQ ID NO: 14435 - DNA, 343 bp, Homo sapiens
  misc_feature 62: n=a, g, c or t
ctgaaattataaaatgttgtgattctagctctgctatgttatgccatcatccagtgcaagangtgctcagtttcctcgagcccaagacaaagttcattactacataaaactgaaggacttaagagatcagttgaaaggcattgaacgaaatatggacgttcaagaggtgcaatatacatttgacctacagcttgcccaaggtatgttactgtcctcattccttttattcattttgtgtgtgtatatatacacatatatacttacatatatatacacatatacatatatacatatacacatatacatatgtgtgcacatatatgcacacgtgtatatatacatg

SEQ ID NO: 14436 - DNA, 119 bp, Homo sapiens
cacacctataatcccagcactttgggaagccaaggcaggaggaacacttgaggtcaggagtccaagaccagcctggcctatatggcgaaaccccgtctctgcttaaaaaaaaaaagaaa

SEQ ID NO: 14437 - DNA, 200 bp, Homo sapiens
actgttgcctggcgacgggtccctgcgtcatggcggagaaggggactctgtggacgtgcatcgssgttggactctcgcctgtsttctctgaaggatccatgggatagtsscgcgatcctagaagtgtgctggggcgacccasctgaagaaacctcaagcggasccaagggatacagcgcaaaattcctaaggatccgcag

SEQ ID NO: 14438 - DNA, 116 bp, Homo sapiens
agaacaggaagcggaggcataagcagagaggattctggaggtctctttgttttcttatccacagagaaagaaagaaaaaaaattgtaactaatttgtaaacctctgtggtcaaaaa

SEQ ID NO: 14439 - DNA, 470 bp, Homo sapiens
tagatattgataagacactgatggtgtaaagttatgagccaaatctatgtaaaaatgtaccagttaacaaaacctgtggctattatgaaaaacttacttgaataagactttctgcttttgtgttaatgtgtccagaacccacctgtagaagttctttgtgtatgcagtcttttcaccctacagtgctttcattctgatacacttaatcagagatagtagttttctgggttaaatctagtcgcttatcctcctggatatagcagaaagatagtgggatatataggtgtgttgtataacttttststtttacaccttttcctttttttaataagaaaactgggattgaaatagaataagttgaagttaatggtaaaaattccaaacctggctgggcaccgtgactcatgcctgtacccagcacatgaggccaggagttgaagaccagcctgggcaagatgatggaccccgtc

SEQ ID NO: 14440 - DNA, 396 bp, Homo sapiens
tgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgmacacacggaaatctttaagttatttgttgaggtaccatatatttagggtgctaggggcaagtaatgttaatatgtgcaataggaactactggtttgaatgtgtaatgggtgatctctctgagtcctggcaacatccagcaaaactactgcttattctccaaagaatattgggagctctcaatcctcggtgatatgggaaagagaaatgagtatttgccct

SEQ ID NO: 14441 - DNA, 435 bp, Homo sapiens
taagaacatgtgtgggcacagatggacccagagtgcctgaggaaaaatgtccatgtaaaatgaaagaacggagcaggtagagggttgagctgaagcctggacaccagaccagtgtgatgggattcagtaggtatggcctctagggccagaggaaccttgctaccccacccatagtggssactctgccccaactgaggcatggcctcaraacatcaaagtgtgtcccagagagcaagagtacccaggaagggaagggtaaaaaagaggcattaggacagaaaagattctgtgccgacctggtagaagtgttgtatttcaaaaatcatatacttaatgaacataatgagacaggagcagagagaagctatgtgacattccctggcaacagtgcatttcatatgcagtgggcataacaagtttcagaataatcttgtg

SEQ ID NO: 14442 - DNA, 336 bp, Homo sapiens
aaaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggraggagaggaaagctggaagtcctggagggacagggtcccagaaggaggggacagaggagctgagagaggggggcagggcgttgggcaggggtccctcggaggcctcctggggatggggctgcagctcgtctgatcgcccctcgagcctagtactcggct

SEQ ID NO: 14443 - DNA, 482 bp, Homo sapiens
  misc_feature 412,416,420: n=a, g, c or t
ctaaagtggttaagttgagaagtaaaagtataagcatataatatagtgttatggatcagaatatctaaagagaaattaaaagaaatttctctttgaagtagaggtaaagagggttggatcgggagacttgcttctcatcacaccttcttcaaaactatgaactgttatcatgtgcatgcattattaatactttagttttaaaaattaaattaattatttcaacaaacttgccttgagtttatgtaatgtgttaggcatggtatctggaagcgtgaaaattgaaacctttgtctgggcacaatcgctcatgcctgtaatcgcagtgctttgggaggctgaggtaggagaattgcttgagcccaggaattcaagaccagcctgggcaacatagaaagatctcatctctacaaanttanatwntcaaagaaaactagctgggcatggtggcatgcaccctggtcccagctgttcaggaagctgat

SEQ ID NO: 14444 - DNA, 469 bp, Homo sapiens
ctacagaagcatcagacagatactcaaactctcactttccccaaatcacatctcttaacttttcaacgccctccaccctcagctccctgcacaattcatgggaggactcatttcttgcsttgaataaccattttctaaacatcgagctcttcaccttccccaaggtggccaacagcttmcctggctgccatctttccttttgascttatctttccccattagtccctggtggcacctactctcagcccacctccctcacsacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtag

SEQ ID NO: 14445 - DNA, 419 bp, Homo sapiens
  misc_feature 322,390: n=a, g, c or t
ctcagaccaattagttcagagaaatgaagctgcaaatgacctttggtggctggtcagagtcctctcagccctgttgctgtcctaacaagcccagtaattgagttgcttgattagcacagtggagctgtttgagsctgctcccggatctaacaaggaggaaaacataacagggagtcaagtggtgggagaactattcaaatcaaatcaaaagtctaaacaaaagacaacacctctatttctgagagttctgaaaatgaactaattggaaattagtgattggaaattgagagctgtgcaatttcttccttggatgaggcatcantttgcataactccagtagatccaggagactttctctaagrctgcgcattgactctccacatagatatncagtaaagacaggttcttgctgcacgatg

SEQ ID NO: 14446 - DNA, 418 bp, Homo sapiens
atggtggccaagcagcacgggaaggtggtgatggccaaggtggatattgatgaccacacagacctcgccattcagtatgaggtgtcagcggtgcccactgtgctggccatgaagaatggggacgtggtggacaagtttgtgggcatcaaggatgaggatcagttggaggccttcctraagaagctgattggctgacaagcagggatgagtcctggttcccttgcccgctgggaccccaatagaactcagcccttccatgccagcccttcctgctgcctccctcctgtctggctcctggggcccatgcttagagcccaggctccagcctgagtgcttccgagctggcggactgcccaggggccatcagaggatggtggtgctgctgctgatccggggacgctgtcttccctcccatatg

SEQ ID NO: 14447 - DNA, 435 bp, Homo sapiens
atctatttttactccatgggcctctgatatgctgagatgtggcacggttatgattatggtatcaccgttacagaggcaaagggataaaggtctaccagggccaacgtaaccagaatgtgaggagagtgaagattcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagccctttattgggttttctgtttgaaattggcccctactcctctccagtgtctgctttttgaatccttctgttcgtgtgtgtgtgtgtgtgtgtgtgtgtyccctatgatac

SEQ ID NO: 14448 - DNA, 310 bp, Homo sapiens
atacttcatataagatatacataaggccgggcacagtggctcacgcctgtaatcctagcactttgggaggtcgaagtgggtggatcgcctgaggtcatgagttcgaggscggtyctgaccgacatggtgaggctctgtctctactagaaatgcaaaaagtagstgggcgtggtggcgggcgcctgtaatcccagctasttgggaggctgaggcgggagaatcgcttggacctgggaggtgaagtttgcagtgagctgagattgagccgctgcactccagcctgggtgacagagtgagactccatctcaga

SEQ ID NO: 14449 - DNA, 458 bp, Homo sapiens
aaccaaaattcaaatctcagttcctcattcaccagctgcgtmgcttgagaaagttgcttaacctttgaaagcctcaattttctcacatgaaagaaagctatcttgcagaggtgttacgaatgttagaaaaaaaattataaaaatcgccagcccaatgtctataacattttagctgcagttagtggtaaccaacttattattgtcagttttgtaaaattattaagttttctgataattaaaataatattgtacctatataaaaagtatcaaaaagcatgtaaagagatgagaacacatggacacagggaggggaacatcacacaccggggcctgccagaggctgggggcaaggggagggagaacactaggacaaatacctaatgcatgcaggtcttaaagcctagatgacgagttgataggtgcagcatatcaccatggcacatgtatacctatgtaac

SEQ ID NO: 14450 - DNA, 432 bp, Homo sapiens
agtctgccttactaccatgccgctctacgagggcctggggagcggcggggagaagacggcggtcgtgatcgactgggagaggcctttaccaagtgtggatttgctggagaaactggtccaagatgtataattcctagtgtgataaaaagagctgggatgcctaaggtatttaaaaaaaaaattagcaaaataaatgccatactataaaatgttttaaaatatgacttcaagtaagattgattaaaacagtactaaaggccagccgtggtggctcacgcctgtaatcccaacactttgggtggctgaggcgggtggatcacctgagatcaggagtttgagaccagcctggacaacatggtgaagccctgtctcaactagaaatacggaaattggccgggagtggtggcaggcacctctagtcccggctcctca

SEQ ID NO: 14451 - DNA, 443 bp, Homo sapiens
gagatccgaacgagacaccacgtcaaccggcgcggggagtcccgtgaagacatgagggcgccaggagcgcagtactggaatacctgagttttggctgggcacagaactgtctggaatacagactgcaattcccagccttctgtgcagttctgtgtggccatgtgactaagttgtggtacaatatgagtcacggaagaatagaagaacaactcagaggaggaagaagtcagacatagccagacacggctgctagcagttccaccaatgaaagaggagaccaggatgtttaaaacaggcaaacacaaggtgcgaaaaaccagaagcgaaaacttctgaggtcatttaagcaaggactatcgttatccccggaagcagagagaagttccctttgcccaacatcacactgcaagcacgtgttggagctgagattcaaacccaggcat

SEQ ID NO: 14452 - DNA, 415 bp, Homo sapiens
tattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctsggca

SEQ ID NO: 14453 - DNA, 433 bp, Homo sapiens
  misc_feature 349: n=a, g, c or t
aaagagaaaaattgattaatcaaaactgactcaaaacagacactgatgctagaattagcagaaaagcccactaatatagcaattataactatattccatgcccaaatcaaaattatagagattaaaactacaatgggaccattatagatatttaaacaatctaaaagaaggcagaaaaagagcaaaaatggaaccaaaaagccaatgggacagaaagaatagaaataggtttaaaccttggctggctgcagtgcacgcctgtaatccttgcactttgtggggctgatgcaggcggatcgctgagggtcaggagttcgggaccagcctggccaacgtggtgaaaccatgntctctactaagaatacaaaggttagccacatgtggtgacacacgcctgtgatcccagctacttgggaggctgaggcacaagaat

SEQ ID NO: 14454 - DNA, 447 bp, Homo sapiens
ctttgggaggccaaggcgggcggatcagctgaggtcgggagttggagaccagcgtggccaacatggtgaaacccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaactcgtct

SEQ ID NO: 14455 - DNA, 461 bp, Homo sapiens
taattaaccaatgccggagctctacacgagccagactgttctgattgctgctttgcctctgctgtccattagggtagctgtgcccacctgaccttatcatatctagtttttgaaacatggcagggaaaatgattccacgtaacctgaccatatcagctgggtgactgaataaaacaccttctcagctcgctttcctctggcctgaagctttttgctgtagctgcttttgcaacaaaggacacagttgtaggcagtggatcctaaatggaggtttcctgggggactttagggaaagcttatattttcctgataaaactgtcaagtgtggccaagataatacttccccgttttctgactttaatgaaaatacaaggccctcaacagagatagctgacttctgactttgggagakaggtcagggaacagcagtgatgctgtcgctgatgtttttgagctattgt

SEQ ID NO: 14456 - DNA, 322 bp, Homo sapiens
gatagaaacatccagtgtaaaaaggaagttggaatgggagttggcgggcagtgaacgagtgtggggaaggattggtgctggggcaacaggaaggggcctggggcgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgaaaaaaaaaaaaaaaaa

SEQ ID NO: 14457 - DNA, 473 bp, Homo sapiens
ttctccagctctacaagaacttctagtgctctgggcagctgcgaggggtcaagaaaccacatccccaaatccagcgggatctcagagagaaaggctgatgggaagctgcccagggctgacctggcacatgctgggaaaacccctcggtgccagggcaggaggcagagcgtctgcagctcctccctccccaacacagggggtaaggaatacagcagaacgggaatcgggcgccttcatgctgctgttaccgcccttggttcatggcttctttcacttggaaaccccaggaggtgggcattgctgtaccgcatgtgctactgaccaaaacaggccaaagctcagcgaggggtgggatcacctaaggttgtgcagcacctacgtggtggagtgaggatccgagcctccatctttcatgcattaattcattctgtctctggattcccctagaagcagaccctgaggcaaggatccac

SEQ ID NO: 14458 - DNA, 374 bp, Homo sapiens
tataccaaccatgggagaaaagggtggagtgagaacatagcaaataagaactggagtatttggtgctgcccagaaagctttgttggaaaaagatttgaagcaattggtggagtcaacagaatgggaggttagagaaagattaatgcgacggacttaaaatgggtcagagcagggatcccagbatgtccagactgaatggagggtggaaagagattaagtacaaagtgaggaagatggaagatggttgaatagtgctgaatatcaagagtgtacatatcatccaaaagagatgtttatatccactaaatgatacagctgaatgaagaaagaatgctggagaaaatgtaaggagtttgcagccaaaggagaaagag

SEQ ID NO: 14459 - DNA, 457 bp, Homo sapiens
taaatttatctttcagccaccgtgcccggcctcacaatgtagtcatttgtgtctgatctctctcagcataccgtgagtttgttccatgttgtagcatgttcaggaatgtgttcctgtgtgttgctgagtcgcattccattgtatggatgtaccacattttgtttatccatttgccagctgatgggtacttgaatggtttccagttttgactattatgaagaatgctgatatgaacatccatatacagttatttgtgtagtcatccgttttcatttctcttggatagatacccatgagagggattgtttagtcatatagtaatttatattgaactgtttaaggaactgttaaacaatttcagaatatctttttttttaagatagtgaataatgaagaggaggcagaattacccttagacctgtaatcccagcactttgggaggccgaggtgggtggat

SEQ ID NO: 14460 - DNA, 292 bp, Homo sapiens
  misc_feature 290: n=a, g, c or t
tatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaangy

SEQ ID NO: 14461 - DNA, 112 bp, Homo sapiens
actccccgcgccccgccatgtcgcgatccaaccggcagaaggagtacaaatgcggggacctggtgttcgccaagatgaagggctacccacactggccggcccggattgacga

SEQ ID NO: 14462 - DNA, 381 bp, Homo sapiens
  misc_feature 180: n=a, g, c or t
tcggttcattcccagctcggtccgggcccggccagactgggtggaaatctggctgaccttggtggtctgtcttggccagctggagcaaagggatgccaggggacgggtctcggtgcagtgactgccattagcttggggccgcagaaagtttctcccctttctcgggctcctgccaggccnttggctttcagagccaggcccgatttctagataacatttaagtttgcagaaaaggggatgccaagtcacggtggtcacggctgtgcgatgcagcctctgagatttgtattaatttttgtgagccggggaaaggccttgctgctttctccgccagactgatgtgtcttcccaagatgaaagtgcctggtaagggcgaggggc

SEQ ID NO: 14463 - DNA, 463 bp, Homo sapiens
agtcagttgtctttataatttttgtagtgctcaaattgttccattttggctaagtaacttcatattttttgttgtggttttgtttttttcaacccctttggtagttagttaattgctttctggtatacaatattccaggcccattttgtacatttcctgcctcagacctgaaatcaaccatatctctatggaagcctgtttccttgaatgggagtagtattttaatcacagtctagggcctagggaccatactttttaagatgataaaattttggctgggtgcagtggctcatgcttgtaatcacagcacttggagaggctgaggcaggaggaccacttgaggccaggagtttgaggtcagtctgcgcaacatagcaggacmwctttctctgccaaaaaattaacaaaattaacaaaagaagtagttgggcatggtgatgcatgcctgtagttctagctatgc

SEQ ID NO: 14464 - DNA, 449 bp, Homo sapiens
ctcccagtgggctgtaggcagggtcctccatgggtttccaacccccatcactggcaccaggatctcccacaggcactggtggtgtcatcacctgctggccccactacagcctgagtaggcctgagtggccgtggcaggctgagacctgtcaggccatactgacaagcagaggtcagagacactggtggggagctggcaatgaaaccctgtcctgggacatgggtttcatgttcttgtacacttcccctctggatcaggtgaggggtccagacagctgaccagacagcttgacagctggtcaagacggtcacgggagctctaggtgggcacaaccaacccctctcctgggaggcccctgccccactggggataggagcctgtgtccctggtgctaagcactctcttcacttgggccattgttggtgggggctcctttccggccagaccac

SEQ ID NO: 14465 - DNA, 96 bp, Homo sapiens
aggcatcattattatcctctttttatagacaagtttcaaagacactaaagaacctggacagagttgcaaaggcagctaaatgattcctgtgggaca

SEQ ID NO: 14466 - DNA, 444 bp, Homo sapiens
cattttcttagcaaattagccccctgtaccaataaagctcactgtaccagtgtaacagatggccatctaaatcagagatccttggagcatatcagcttctgcatatagatcagcaagtaaaagggctgagaggagcaggccaaaaatggagtttgggtataagatagtttggaaagcattgtgttaacatctctatgcaagtgggaactgttttgggaaaacaagcttttctccctctgccattccatcataagcaggcactttggagagcagctcaaggatgttgccatctggctcacatatgttgtcacgtttagggggcaaaccctccattctgccaaagaaagtcataattatgtatatttgtgagtgcagtgaaagggtgtaaatttaatgcagggctcatgtggctccatcagcatattcatgtgaaaaaccggagga

SEQ ID NO: 14467 - DNA, 461 bp, Homo sapiens
ttatttctgagctgaggttttttggcagaaagtttagttgaatcctcaaacacagctggctgtatgagctggagttttccacctcagggaactgaaatatattaattcaatcaaaaatagtttacttcctcaggggaagtgaactgattttgttttgtttacctccctcccaccccagcctttcactgtgccaagtcattgcctaaatttaatagcttgacattctgggaggccaatggctttcacctgcggagggagtggggcggtcagcaaggggtgcattttcagctcaccgtgctcaatttgagaaggaaagagacggacttgacacctcctaaggctttcaacccagtggagtagaaagccccagacactgcaacattcctgcctggcaagaggtcccctctgtgcctgaacctcactgaactgactccaccccaggctgtgccgcttcacagttt

SEQ ID NO: 14468 - DNA, 448 bp, Homo sapiens
tgattattttaataagggaaaacttcagcactctgggcaaaaattgcaacacttggatttttgtgttaacatagcctcagcttgatgttcacccacaacagtggcccatttctggggtccgatcttcttgttacagctaaagcttgcagccaagtgactaacagtgtccatcattcagaagcttagaaaatcggcatcgctaagacatttgggccttgacggagcaggaatgtgagctaaaaccctgtttgtcaagataggtttgtgaagtttgcttacctttaaattctaaarctttaaaaacttttatcacaattttttcactaaataatttgagcaggcagggcgcaatggctcacacctgtaatcccagccctttaggaggctgaggcaggtgcatcacctgtggtcaggagttttgagaccagcctggccaacatggtgaaac

SEQ ID NO: 14469 - DNA, 233 bp, Homo sapiens
atagctcactgcagccttgaactcctgggcaacatggcaaaattcaggctctacaaagaatacaaaaaattagctaggtgtcatgacatgtgcctgtaatcccagctacttaggaggctgaggtgggagaattgcttgagcccaggaggttgaggctgcagtgagccaagatcgtgccactgtactctagcctgggcaatacagtgaaaccctgtctcgaaaaaaaaaaaaaa

SEQ ID NO: 14470 - DNA, 466 bp, Homo sapiens
atactgagtgtctactctttattgagcctgtgttgtgtgtcaggaccagcagccaattctggatggaatgctgagcagttcagtcattcgttagaaagcagttgtcagcaatgggggactttttctttgctggggagtgctagatgactgaggttatattttacaaagattagtccagcagggaagatgaacaagaaatgaaaggagaccaattcagaggttatggcctaaaattcacatcactggtcacaagagaaatacggaaggcttgagctggatattgtcaaaaggggtagaaagaagagggtaaatgtgaagatgcatttaaaagcaaaaattcaggctgggcgcggtggctcatgcctgtaatcccaacactttgggaagccggggcggtggattacgagatcaggagctcgaggccagcctgaccaagatgttgaaaccctgtctctactaaaaatgc

SEQ ID NO: 14471 - DNA, 448 bp, Homo sapiens
caagagagtatatatttgcttttaactgcccctcactgttcatggccagtgtagtacatcctagtgaaaggaagaccatgcatcagaatgtttgttttgagcatttatttttagcagcagatctagaaattatattttcattttagggtatatattttttatttattatgaacattccaagactaaataattttagacatgcgtatgtgagtgcatgtgtacattgcatgcacgtgtgtatgtgtatgtgagagagtgagagactgagtctgagactgtgtgtgagagagaaggagagggagagagagggagagaaaagaaaaagacattcccttaatagcaggaggggtagaggcttactcagtctattatcataaagctctgctaatgtagcttctgagtcatgtgactgcagaaaaggctattatctcaatgaaaaggaaaccgg

SEQ ID NO: 14472 - DNA, 375 bp, Homo sapiens
  misc_feature 73,338: n=a, g, c or t
ctcttgcttatctggctgggcttttcccctgttcctctatctctccctgtctttgtgcctctcccttadmcantctgtttgtaagctgctttttctacacattcagtcctgaattttaattatccgatgttgccattttccatctctgcctgcctgtttttcctaagagagtgtgcatgtctgtctttctcttcctccctctctccccacttttcatttgcattcttcattagaatttgactagactgaatagaaattaaatgatactttgaagttctctagaattaaagaatgttcttttgaagtaaccagtgatcttttttgcttaccctcatcancagaatggatgaagatagatttgaastgtgtgctttt

SEQ ID NO: 14473 - DNA, 369 bp, Homo sapiens
acaacaattgaaaataaactgatatatttcatcacattaacaagaaaaagaaaaaaaacaatatcacatcaccagatgcagaaaaacatttgacaaaatccaacatccattaacgataactctcggcaaattaggaatagagggaaacttcctcaaagtgacaatgtctataggaaacctacagctaacatcatattccctggtaagaagttagatgctttcctggtaagatgaaaaacaaggcaagaatgcctgctcggccgggcgcggtggctcccgcctgtaatcccagsactttgggaggccgargcgggcggatcacgaggtcaggagatcgagaccatcccggstaaaacggtgaaacccgtc

SEQ ID NO: 14474 - DNA, 451 bp, Homo sapiens
ttccattcattctagaaaattataggggtagacaacagttgcgagtttgccaagaattgagctgaggtgggttgtcagccagaaaggggtacacaggggacttttagagtgaaggaactgttctgtgtggtactgtgtgttatacgcagtattagcccattctcacgctgctgtgaagaaatacctaaggctaggtattttatgaagaaaagaggtttaattgactcagttctgcatggctagggaagcctcaggaaacttacagtcatggtggaaggcacttcttcacagggtggcaggagagagaataagtgcaagcaggggaaatgccagaagcttataaaaccaccagatcaggccaggtatggtggctcatgcctataatcccagcattatgggaggccgaggcagggggatcacctgaggtcaggagttcaagaccagactagcc

SEQ ID NO: 14475 - DNA, 458 bp, Homo sapiens
ttacaccaagcctgcctcacaaggatgccaatctctcatcacttactgggaaagacccactcctcccattcatgataaggtaatgctatccaataaaaaccccaaagcaggcataaaatatgaagtagcgaaactcaggcaggcagaaagcagagtggtttagacatggctgctgtctgcagcagggmgaagttcctggcaacatgaccctgaaaataacaatgagtgactgaagctaagaaggaagaatcttccaaggactctgaaactagatattttctcaagccccacctatggacaaacacaaatcatggagaaataaagatgccagtctccaggaagcaccagagttaaattcattctggaatttaactcctggcattaacagttagctgggagattaaaacaaaccaacacaaaaacacaaaaaaataatcagtggaaaaaaaaaaaaaaaa

SEQ ID NO: 14476 - DNA, 197 bp, Homo sapiens
aaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaagaaaaaaaatgcactcaaaaaaaaaaaaa

SEQ ID NO: 14477 - DNA, 441 bp, Homo sapiens
  misc_feature 233: n=a, g, c or t
tgtgatgatttgattcaggtatagcccaaattagtaaggggctttagctgtaaactgaaaacaatattcacaccctctcctgggcctgtaagtctaaggtgagaatttcaggatggaaaatgcaatgtaaagcttccacaggaaagtattcgggtatgtaaggtgttatttctgaccagagccctagttctgcaataaccaaaaccaaggagtataaataacaatcaggctcngggggaatagaaagcaggctttagacaatctgtccatttctacagtaaaattggagtgagtgtgtatatctacttaaaacttaatagaagtgacttctactttttgggctattccagaagtattttaaaattattatttaaaattttgaagccccatttcaaatcttgccgaccttagttcaaagccccctgagagatcacttttaga

SEQ ID NO: 14478 - DNA, 61 bp, Homo sapiens
tatgtcaagaaattacattttgcatgtcttatggagatgctgttaattgsttcagtgagtg

SEQ ID NO: 14479 - DNA, 151 bp, Homo sapiens
cactttaaagtttctgcagtcctttgacacataggatctcatggagcctcacgtctactcccttctgcagatgaggmaaccgagaraagtggcccaaggtsacgcaactctgagatgccacatttcatttgatcttgtacacattttcttt

SEQ ID NO: 14480 - DNA, 422 bp, Homo sapiens
tacagccggagtcaggccaaggggttgcttggaaggaggctctgtcgtagmgggccaaggagacctgcctcattttgctctggtgtaggatggcctgtgggtgcccccagccttgcagacctgtgcacccctcagaggtgccagccttttcttggagagaggaggcagcccggctgctggaacaagcacctgtaaacctggattagaaactgcctggagctgagcatttctgagtgtgcctggcacgccccctgctggccactggctactggtcaggcgacacccctcggagctaggaaggaagcggtccaggaactgacccctgctgtgaccgtggctatcccattgaatcctcccaggaacccccagcattgcggggattcacacacagagacctcctttagcacacaggagcccggaaa

SEQ ID NO: 14481 - DNA, 329 bp, Homo sapiens
ccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtgtcgggcgcstgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaagtttgggg

SEQ ID NO: 14482 - DNA, 93 bp, Homo sapiens
aaagcttgttcttttaagtacttttttaaaagtttaaaagttttcttttttaagaaggtaaagcagctcaatctgcaaaactgtgtctttctt

SEQ ID NO: 14483 - DNA, 118 bp, Homo sapiens
aaaaaaaagagagagaaggaaaggagagaaggcaggaagaaggcaagggacgagacaaccatgctgtgctgtatgagaagamccaaamaggttgaaaaaaatagatgacgaccaaaag

SEQ ID NO: 14484 - DNA, 401 bp, Homo sapiens
  misc_feature 337: n=a, g, c or t
taacttttacttactgagcacctactctttgttgggcaatgtgctaaatgtttctaaactaagaaagtagtacatgcttaaggtgaaaaaaatattaaagttttttaaaatataaaacaggtcttacscgtacaccagaacttctagcctccttttcagaagctaacaatgttttwwtgcatatttttctagaaatgttatacacatgttggccgggcacagtggctcasacgtataatcccagcactttgggaggccgaggcaggcagatcacgaggtcaggagtttaagaccagcctggccaacatagtgaaaccccatatctactaaaaatatnaaaaattggmagggmttggtggcgggcactgtaatcccagctactcgggaggctgaggcaggag

SEQ ID NO: 14485 - DNA, 344 bp, Homo sapiens
cagttgagtctaggatgtaaggcattctaacaagtcaactctcctgatcttttagaaaagctagtgtcggctgggtgcagtagctcacacctgtaatcccagcactttgggaggctgaggcgggtggatcacctgaggtcaggagttcaagaccagcctggccaacatggcaaaacctggtctttactaaaaatacaaaagttagctgggtgtggtggcaggtgcctgtaatcccagctactccggaggctgaggcaggagaattgcatgaacccgggaggcagaggttgcagtgagccgagattgcgctgttgcactccaactggggccacagagtgagactc

SEQ ID NO: 14486 - DNA, 143 bp, Homo sapiens
tttgtttgtattatgtctgaaatgtgtgagagtattcgtgataacggtatttggttccaaaatcccagtaacaccacaaacagatgtggtgtattttctgctttatgatttcttatgaagtttctttsktkctttttttgttt

SEQ ID NO: 14487 - DNA, 460 bp, Homo sapiens
accgtatggattttccaagtgttccattaaaaccaggatgtagagcaccaaaagatcaggaccacgggaggagcagcctcctccacctttactaaggcacaacctggcattgtatgcaatttagtacttcagagtaaaaacctgcatgcccaatgttatgcaaagcgattctagcatgaaataaattttgtatcatggtttctgtatagtctaaagcagatttgttttcctgaagcagtcggaggtttgcagagacacacttctgcatctcgaataaatatagtattttcccaacagaaacagaggacagtagcttggctttggtctgattctaaaattagtggggtgggggggaaggatgatatttttgaaaaacacatgcttgagttgaaaaaatgcaacatctcaagctttcactgcagctcacaacatttcctggaaagagagcaatgatgcttta

SEQ ID NO: 14488 - DNA, 441 bp, Homo sapiens
caaaaccaaacaaacaaacaaaaaaaaaccacacccaccttgagccatgtacagttcagaattgtgggaatacagcaatgaaaacagtagttcctgctctcatgggtcttacatggtgagggggacaggcgatacacaaatgtacaaataattacagtcagagtccttatcatatgagaagggtcatctcagaaagtaaatggtgatgctgaaagaatgggcctcaccaccgagctttaatgggggatggttagtaataaagaaatacaagataatgtgggagctctsstcctcctctaaacattttcctcctttggtttccattttgccgacgattggctattttggcacttcctgagggcttactggggagggcagatggtgacctggcttaactacttaccgsactgcagaggtgccagcgtgatacaagccaagtga

SEQ ID NO: 14489 - DNA, 334 bp, Homo sapiens
  misc_feature 272,289,297,303: n=a, g, c or t
tttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttcattttgccctcagtgccagccaatccgggcaggaccctcgaagagagaccgagggtcccagaggacaatgctacaagccagcaaatgctgccacatctctgcctgatngggggtggggatgggtngggggatnggactnggccaagggatctgggtgggcatttttaact

SEQ ID NO: 14490 - DNA, 443 bp, Homo sapiens
ttttagaaacggaggctgatgacaccttttgagtacttactgtataccattctttctgccaaaaaagtctcgtgtattgtttcttgatcctatgaaggtagacacaattatccctgttttgcatttcaggaaaccaaaagcttaaagaggccataccctcaactttttcaatttagcaccaagctaatctgagagtgcttgaaggcttctctgatgagcccagagaaagacaagaggaagctgacattaaggatgaggttgatttcatttcctatgtgatacacggagtttaagatacagttgtgggccaggcacggtggctcacgcctataatcccagcattttgggaggtcgaggcgggcagatcagttgaggtcaggagtccgagaccagcctggccaacatggtgaaactccttctctactaaaatacaaaaattagct

SEQ ID NO: 14491 - DNA, 420 bp, Homo sapiens
cacttggcaagataataatgtaattgaaatttcataatcagtagctcctgctggaaacttgactaagagatcctttaatatccattggttaaatagtaaaacaggccacatggtaataacagstctcacttaattctctctcatcatttgatgtcttcaattgtttatctttaagcctcagtgtatgtctcaataccattatttaaactgggattttcatactactattatttttactttgttgctgccgttggttgttgttgtctgaracggggtctcacacggtcacccaggctggagtgcagtggcaccatgggtcatggctcactgaagccttgatatttttactttgtattttccctttttraactttgtatctgcaagccctgtggtcccagctactcaggggctgaggtggga

SEQ ID NO: 14492 - DNA, 354 bp, Homo sapiens
aagcgaagagatgggtctgcactttggaggagccggacactgttgactttcctgatgtgaaatctacccaggaacaaaacaccagtgactgcagcagcagcggcagcgcctcggttcctgagcccaccgcagctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagcagaagatgccatctcat

SEQ ID NO: 14493 - DNA, 324 bp, Homo sapiens
cgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatg

SEQ ID NO: 14494 - DNA, 408 bp, Homo sapiens
cagttttaaaaattgaaaacaaagatctttggagatcagtgtgtggttgatggtagcattaaatgtctttcaccatggaataactttttaaattattatatcattaagaatataaaaacatcctggttttggccgggcgcagtggctcactcctgtaatctcagcactttgggaggmccgaggcgggtggatcacgaggtcaggggatcgagaccatcctggctaacatggtgaaaccccgtctctactaaaaatacaaaaaaatcagccgggcgtggtggagggcgcctgtagtcccagctactcgggaggctgaggcagggaaatggtgggaaccagggggtggagattgcagtgagctgagattgcgccactgcactccagcgtgggagacagagcaagactctg

SEQ ID NO: 14495 - DNA, 417 bp, Homo sapiens
aaaatgtgcttctacctttgctctaaaaatgatatttgtaatattttatgttacaatatgcagtgtctctcctgcagagaaatacaagagaaattttctttttgactttaggttcaaacaaaaacaaacaaaaaatatatacacccagcacagtggctcacgcctgtggtctcagcgctttgggaggccgaggtgggagttcaacccaggggttcgagaccagcctgggtggcatgatgcgatcccatttctaccagtttttttttccattgcccagtgtggtggcgtgcacctgtggtcccagctactcggggggctgaagtggggggatcgcttgggcccgggaggttgaagctgcagtgggccgtgtttgtgccgctgcactccggcctgggcgaaagagtgaaaccctgtctc

SEQ ID NO: 14496 - DNA, 446 bp, Homo sapiens
atttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatg

SEQ ID NO: 14497 - DNA, 306 bp, Homo sapiens
gatgggcccaaaagcacaagaactggaggtttcagaagacgaggcagacgtggctcctgcttcacatgtatgacagtgacaaggttcccgatgagcacttctccascctgctggcctacctggaggggmtgcagggccrggcccgagagctgacggtgcagaarrcggaagcctgatragggactggatgagaagggctctgatccccccctgccggggagggcccagcgcatccgacaggtgctgcagctgctctcctagtgggttcagcgcggggcggggccgctgccagtgcagggctgcctc

SEQ ID NO: 14498 - DNA, 433 bp, Homo sapiens
taagacaggatcttactatgttgcccaggctgctcttgaactccaggcctcaagcagtcctcctgcttcagcctcccaaaatgstgggtttataggcatgagssaccgtctggcaacagtggcttcttgatggacatttgggttgtwtccaaattttacsataatcactgctttmttttggaatgagagtcaaagtgtttcatggtttttaaatgtttatatctagtaatcaatcttctaggaatctatcctaaggaaacaatcgcagagaaagaaaagcaaaactatccacagagatattcattgtcaggttatttagaatattgaaaaactggaaactatctggccaggcgcagtggctcacgcctgtgatcccagaactttggaaggctgaggtgggtggatcacaaggtcaggagttcaagrccagcct

SEQ ID NO: 14499 - DNA, 453 bp, Homo sapiens
  misc_feature 396: n=a, g, c or t
actattactgcacgtccattttctagaaaattcctggcatctgggttctatgtaaacgtaagaacttttcctttactgtgagttagcaatccggatgtgttttgtggaagattatgccctaagcccttagaagggaggacactgagtttgggaaaagtcactacctctgggmttcattttttgccctaaggcaatgaggttatcctgatgctgaggaatctatggcaaattttcctttctccctcaaactatcctgtcaaccttttcatattagaaggcagagaatggaaaatacacatacacattctcctttaaaaaaaaaaaatssaaggagccttgagaaatggacatgatccgtgtatttcttgacctctgagataccatggctaatcccanccaaccytgcagaaatactgcttctggargttccatttgcctccattctgagtgctt

SEQ ID NO: 14500 - DNA, 171 bp, Homo sapiens
agcgaaattagccgggtgtggtggtgcatgcctgtaatcccagctacttgggaggctgaggcaagagaattgcttgaacccagggaggcagaggttgcagtgagccgagatcacgccattgcactccaccttgggcaacaaaagcaaaactctgtctcaaaaaaaaaaaaa

SEQ ID NO: 14501 - DNA, 453 bp, Homo sapiens
cagggatattttctcaaaatttcaaatataccacattgaggaataattttcaaaggtctttcgtgatataaagccttttctactaccatgggcttcttggaagcagaagtgagaaattgctagataaaactgattatgttgaagccattcacttcttactgtgtggtacgwwttttaaaagagcaatttttggccaggcacggtggctcatgcccgtaatcctagcactttgagaggccgaggtgggtggatcacttgagctcaggagttcaaggccagcctgagcaacatggtgaaactctgtctctacagagaaatacaaaaattagccagacatggtgccacatgttgtagtcccagctactctgaatgctgaggtaggaggattgcttgggcccaggaggttgaggctgcagtgagccatgatcatgccactgcactccagcctgggca

SEQ ID NO: 14502 - DNA, 374 bp, Homo sapiens
ttcattatctttghtaacattgtacttttccttgatgttcttaaaaggtatttccctcagattactcatgtttatgttgtgagsatgtagaaacagtaatgctaatgcatggctagttgcctttttaagattgtgacaccaggcttacctatttaaagtttagtatatagagacaatytwaatggaaataactacwtgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggaattgcacctctgt

SEQ ID NO: 14503 - DNA, 298 bp, Homo sapiens
  misc_feature 171: n=a, g, c or t
tgatttattctctgatgatcttgtttattttcttttagaattataagcagaggctgggagtagtggctcatgcctgtaatcccagtactttgggaggctgaggtgggaggattgcttgagcccaggagtttgaagccagcctgggcaacatagtgaggccctgtctcaccnaargrtaaaacaaattagcccagtgtagtggcacmacatgtagttttaactacttgggaggctgaaacgagaggattgmttgagccctggagtttgaggttgcagtgggctatgatcgcactactat

SEQ ID NO: 14504 - DNA, 475 bp, Homo sapiens
  misc_feature 78: n=a, g, c or t
cttttaactgcagatgtgtccgtctgagtgggaacagtgaacctaggggtacatatgtttgavttcttgtatttttanagaacaaaataaacatcttagtggactttggatgagaagagtcccattcgacatgaaaaattgatttattttctccgcaaaggaaaaaagggggagtgggggggaaccttttaaacaagtgagccttccaagtgggacagccctggccagtccttttgaccttagaatgaatcaattacttttactttgaagaccttaaacagagtgttgctttttttcagggaactaccccggttactgagaatcagtgtccccgctccctaatgggtcagcctgtttgagtaagccttccctagcataragaaacaacttcccaagtgacttatctctatgccaacgttttttcaatgatgagrtactttatragctctccaaggcagaaagttctcatgttaat

SEQ ID NO: 14505 - DNA, 416 bp, Homo sapiens
  misc_feature 224,256,261: n=a, g, c or t
atggcggcggcgccccaatgccggaskcggcccctgagacagcgggttccgccgaagctccgctgcagtacagcctgctcctgcagtacstggtgggtgacaagcgtcassccggctcctggagcctgggagcctgggcggatcccaagtccagccaagaktgaggagcagaagatgatcgagaaggcgatggaaagctgsgctttcaaggstgcgctggcstnsgtgggaggatttgtcttaggaggtgcatttngggtntttaccgctggsatcgataccaasgtgggctttgaccctaaggatcsttaccgtacaccgactgcaaaagaagtgctgaaagasatggggcagagaggaatgtsctatgccaaaaatttcgccattgtgggagccatgttttsttgtactgagtg

SEQ ID NO: 14506 - DNA, 432 bp, Homo sapiens
tacaatgtgttgaaaatagtactttacttttgtggcttcttccccaaagcccataacctcagtctaatcatgtggaagacatttattctgcagaatgcstgaccagtatgcctcagaactgtcaaaggcatcaaaaacaaggaaagtctgagaaacataagaaccaagaggagtcsaaggagacatgaggactaaatgtggtgtggcattttggatggggccctggaatagtaaaagaactttagggaaaattacataaatctgaattaagtatgaactttagttaataataatgtatcaatactggtcattaattataacaaatgtgccatactaatctaagatgcttataataggagaaattaggtcctaaaagataaaatttatttattttttacaacctaatttttaacactagaagttttttttttt

SEQ ID NO: 14507 - DNA, 350 bp, Homo sapiens
  misc_feature 102: n=a, g, c or t
gttttcggctgcagaggggaaggcggctaccagtgtaaagccagcctgaggttcttgatagtccacaatgggtgaaccacagsaagtgagtgcacttcsasnacctccaatgcaatatatcaaggaatatacggatgaaaatattcaagaaggcttagswcccaagcctccsccawccaataaaagacagttacatgatgtttggcaatcagttccaatgtgatgatcttatcatcsgccctttggaaagtcagggcatcgaacggcttcatcctatgcagtttgatcacaagaaagaactgagaaaacttaatatgtctatccttattaatttcttggaccttttagat

SEQ ID NO: 14508 - DNA, 342 bp, Homo sapiens
agttgggacgacaggcatgcaccaccacacctggctaatttttgtatttttggtggagacagggtttcatcatgtgggccaggctggtctcaaattcctgacctcaaacagtccatctgtctcagcctcccaaagtgctgggattacagatgtgagccaccgcacagggccaatcaatcaatcaaccaatataaattaaaaaaacaaaaaacttttgcgtcatgaacctccctggggatcaactccagataaagaactgctctgggactgtaatttgccagattccatttcatgttaaatacaaaagacttggggattttccaaaaaaaaaaaaaaaaaggc

SEQ ID NO: 14509 - DNA, 369 bp, Homo sapiens
  misc_feature 338: n=a, g, c or t
attaaattattttcccctgcttaatcaccttcagaggcagcccaggatgtgttgagttacatcgmactgcacagcccatgtctcttccacttggctgttcagcgtgatctcccctctcctcgacacggccagcccacaccggcctccgtggccgccctccccatggcaggcagggatggaggcaggctgaggcacctgtcctctgaggcctgcggaggctctctctcctgtgcttctctgaggatgtcgctccgccctactcaaggagtactagacccctctgtctgctgaggtcagcatcccagaacacggctccagctgacgattgcacttggcanccatatcytccgtgcgasaaactggtgtcag

SEQ ID NO: 14510 - DNA, 450 bp, Homo sapiens
  misc_feature 387: n=a, g, c or t
tgtttgttgagtaccttctatgtgcttggtattctgtaaattttaggcatatgaaatagaatgtacacattgttgacctggtggaacttaatgtctggacagacaggcagtaaacaaaccaataaatatctcttagttggtggcscagattctgaagaaaaatgaagtaggamaaggagtataggaatgctgtgtgtgagggtggttgggtgagttgcagaagtttgtatttgtaaaaattgataaggggctgggtacggtggctcatgcctgtaaatcccagcactttgggaggccaaggcaagcggatcacctgaggtcaggagtttgatatcagcctggccaaaatggtgaaacgacgtctctgctaaargtacaaaaattaanccggcatggtggcacgtgcctgtaatcccagctactctggaggctaaggcaggagatttgctg

SEQ ID NO: 14511 - DNA, 89 bp, Homo sapiens
actagaattacagaaacaaaattggccgggggtggtggcgggtgtctgtvgtcccagctgctcgggaggctgaggcgagagtggcgtga

SEQ ID NO: 14512 - DNA, 322 bp, Homo sapiens
tagaagcactgagctccctgtctctggaagtatttaagaaaaggctgggccaggcacgatggctcacgcctgtaatcccagastttgggaggccgaggcaggsggatcacctgaggtgaggagtttgagaacagcctggccaacatggtgaaacctcatctstactaaaaatacaaaaattagccaggcgtggtggcaggtgcctgtaatcccagctacttggaggctgaggcatgagaatcacttaaacctgagaggcagaggttacagtgagccaagatcgtgccactgcattccagcctgggcgacagagcaagactct

SEQ ID NO: 14513 - DNA, 249 bp, Homo sapiens
ttatggatgccatgttatgggagcctgtcacctgctaaccgagatgagaaattacaggttataatccccttcctgctgtctgaggagcccagcttcaaagatagccaggcaggagttattttatagaatggaagtaatttctacggggccaagcaataataaggaaattggaagtcaaggactatcttccgaatggagaagaagctccatcaaccacagaaggaaattatgatcactcctgccatcctg

SEQ ID NO: 14514 - DNA, 418 bp, Homo sapiens
  misc_feature 406: n=a, g, c or t
cacttagcaaaaatttgggcccaaaaatatatatataggagaagggattgttggtgggtagagaggcctggagatcaagagcaagagatgagataaacacaagtttggaagccattggsttgtgaggggacctgagcacttagaatagaggagacccctcagggagagcttgtatggaragagagaaaggtgcatcctgaccccatcctgggcatttctctttgaaactcagccttgttataattcatttctaattctgatatcggcagtgagggttcatctaatctattctcatcacttcttgagccgtctcagctctcactggtcctggmtcttgsctggagatgattttactcaaaattctagtccaggatttagaattggtctaartacagatgtgcatcangaggctatttca

SEQ ID NO: 14515 - DNA, 373 bp, Homo sapiens
taaagaaaagctggtaccattccaacagaaactattacaaaaaattgaggaggagggactctcccaactcattctatgaggccagcatcattctgataccaaaacctgtcagagacacaacaacaacaaaaataaaaagaaaagaaaaattcaggctgatatttttgatgaacatagatgcacaaattctcaacaaaatgctagcaaactgaatccaacagcacatgcaaagttggtttaacatatgcaaattggccgggcacagtggctcatgcctgtaatcccagcactttgggaggcctagacgggcagatcacgaggtcatgagatcgagaccatcctggctagcgcggtgaagccctgtctctactaa

SEQ ID NO: 14516 - DNA, 402 bp, Homo sapiens
tgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagatttmmmtgttstaggggactagccaaatgcctacatcagctgtcccstccctgttgtctccaagtaagtttgccagaaaaggttttagcaaagtgctacaactgtgtctttataggaggataggcctct

SEQ ID NO: 14517 - DNA, 440 bp, Homo sapiens
ttagaagtgcgccttctttttgtgttatagtggtctcccagccacagccaacgctccaagtccccagctgtgacacacctactgaattactaccgtgggtgggaggccgccgtgggsctttccattacgagcctgcttgccgagccctgggcttgtgcacagacaaactgcagarmtggtggaggccactgccaggccgagataagaaagagatggggagctgctaatctccccctgtccagcctgttggtgagggctgggatctttgctcttgcagtcattccagagccctggactaggaggtaggaagatctgaattgtgggcccmaactctctttcggttattagctctgtgaccctaggcaagtcacctsatcccttggatgcsasscgttgcttctrtaacatggtcccaaaggtgcctgtcttgtccacctgat

SEQ ID NO: 14518 - DNA, 147 bp, Homo sapiens
taaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaagg

SEQ ID NO: 14519 - DNA, 461 bp, Homo sapiens
tctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagactgtttagattccgtagttcgtgggtatcagtttcggtagaggtgcagcatcgtgacacttttgctaacaggtaccacttctgatcaccctgtacatacatgagc

SEQ ID NO: 14520 - DNA, 448 bp, Homo sapiens
  misc_feature 253,290: n=a, g, c or t
cattgatctatatgtatatatgtgatgttttcatatatatatgtgtgtgtgtttaaattttgtatcatcaggactgacacccaatttgacactttttgtatstagaagaccctccaaaaaaggaaccacataagcacacaagaaaagagtgctatgatgttcttagcatttgstatcatagcctatttttatctagatttttaaatgtagcttgtcataacaaaattttaattacaattggsttgtatgagangaaaaagtatttttattgttttgagtgatgacgcagngactcagtgaacttgaaaatrgcattgcttcgtgcactttgaataccaatcaggtgttttctgtgctactagttgtcacgttgcattcatgttcacctcctgatttaagtatctcgggtgtgcccagccactaragcactctggactaatcgctaaag

SEQ ID NO: 14521 - DNA, 437 bp, Homo sapiens
ctgttgcctgtggagtctctgctgaaatgaatcaggattcgatctctaggrkgagacggaaaatgaaagcatgttgtttgccaggacactgtgggtttatattgatgtgtaacaagttgatttggaacactggactctcattctgttattctggttttgtttwttttgttttgttttawttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattktttttttgttttgattttttttaaactaaggctatataaagcttgtggattaa

SEQ ID NO: 14522 - DNA, 333 bp, Homo sapiens
agtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtagccagggcctctgtcmcccaggatgtcttgtggtggcggtcggccgttctgccccccagggcaccccctgttgtaggcactggctagggasgggcaggctccttcctgmccctcgagacactcttgggagatgcattttccgtctggctcac

SEQ ID NO: 14523 - DNA, 384 bp, Homo sapiens
attcattcctcttgtcgccggtgcgttctgcctgcatctttgctccagctaagccagctcctctaggcctctggctgcccaccgcagtgtgctctggactggactctggaccatgcgttgctgggtttgctgctgtgatgatggaggtgctgcttttgtctgtctgatgtttatactttgtgggtgtggagtgtgctaggaacatctcatatgtgccaggaactgstctttggaaaagtcagtccaggttagaaacatagactgtcgccgggcatagtggctcacgcctataatcccagcactttgggaagccaaggtgggcagatctcttgacttgaggtcaggagttcgagaccggcctggccaacattgtgaaaccccatc

SEQ ID NO: 14524 - DNA, 288 bp, Homo sapiens
gcggggcccaagatggcggccagccggtaccggcgttttcttaagctctgtgaggaatggccagtggacgagaccaaacggggccgggacttgggcgcttacctgcgacasgggtagcacaggcctttcgggagggagagaatacccaggttgcagagcctgagagcctgtgatcagatrtacgagagcttagcgcgactccattcaaactactacaaacacaagtaccccccagagaccaccagcttcagtggcctgtcgttggaagagtacaagctgatcctgtcc

SEQ ID NO: 14525 - DNA, 466 bp, Homo sapiens
atatgaaggatcaagatcctcaactcacacatgtagacaaacattagctctttactctttctcaaccccttatatgattttaataattctcacttaactaattttgtaagcctgagatcaataagaaatgttcaggagagaggaaagaaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttmcssctgtaggactgactgttggctaattttgtcagcacagctgtggtgggaagagttagggccagtgtcttgaaatcatcaagtagtgatgtgatctctttgcagagctataga

SEQ ID NO: 14526 - DNA, 140 bp, Homo sapiens
gggttggccgggtgtgatggcatgcgcttgtggtcccagctgctcgggaggctgaggcasgmscatcacttgaacccgggaggcggaggttgcagtgaactgagattgcaccactgcactccagcctgggcgacagagtg

SEQ ID NO: 14527 - DNA, 129 bp, Homo sapiens
cgttgtggcccacttctatgccaagcgtctgacgctcgaggagctgttggctgtggaggccggcgcaacacgcgcaaggaccacgggctggaggtgctgggcctggtgcgagtgcccmctgtataccct

SEQ ID NO: 14528 - DNA, 360 bp, Homo sapiens
  misc_feature 243,248,291: n=a, g, c or t
ctagaatatagtgagatactcaaaggaaaatgaatcattctcccaaaaagacacatgaactcgtatgttcactgcagcactattcacgataacaaagasatggaatcaacctagaaggctatcaatggtgcattagattttttttaaaaatgtggtacacatwaaccttcaaaaataatttatgactaagtcsccaaaagcaattgcaactaaaacaaaaatggacaagtagaacctaattanactanagaactttgccacagcaaaagaaattatcagcagagtgaaagntaacctacagaatgggagaaaatattcacaaactacatatccagcaaagatctaatatctggtatctat

SEQ ID NO: 14529 - DNA, 504 bp, Homo sapiens
tcgttttatttatttatttgtttatttattttttgtgacaaggtcttgctctattgcccacactggaatgcagttgcaatcatagctcactgcagcctccatctcccaggctcaagcaacccccccatctcagctactcaggaggctgagatgggaggattgcttgagcctaggactttgaggccacagtgagttatgatcacaccactgcacagcagcctgggtgacagagcaagaccctgactctaaaaataataacaataaaatwaaatwaatwaaaatgagtsactgcsgcttctatacccaatcatagaattgtcccctctttctgacagttacctaatttagggcaagtcaccatgaccttaggccttcctccaaaatcattcagctagcttcttccaaccagattctttctaacaccctcttactgacacaacccacaattctatatggtgtgtgttcttgatgcaatcagcaataatccaacatctttaactacag

SEQ ID NO: 14530 - DNA, 457 bp, Homo sapiens
cacagaccttggtgataactgtgcttcaaactgtcttaaacaatgtttgtcacctttcccctagttgatgtaaagtatataaattgttgctatttgtttgaactattattgatgctagccaagcagtatacttgatgtgaagatgtcatgctatcacaatatgctaagagctcacaamaataagatagaatttccaggacaaacatctttggaattgtgagtgaaggatatagtggcaggcttgtccctctttaattaatactcttggtatttgttgtgatgggaggatgctgttactaggagagttttgagatactgcagtggatgtgggatgtatatgaacttcttcataatgtactcstgggaactgggtaggacatatccatattgtagttcccaaggtgtctggttgagagttagagaacttttaaatttctttagccagacaggtctctat

SEQ ID NO: 14531 - DNA, 424 bp, Homo sapiens
taggctgtcaagagtgcgatttttatgcgttggggtgggtgggggaggggagttgtgggagggtaggggagggaggaaagctgtttttcatggtgagaaataataatgatgactaataataataaaaaaaactggaaaatgtaagcaaggtggacgcattgcttmtcggtactcagaaaargttatctgawtttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttcta

SEQ ID NO: 14532 - DNA, 61 bp, Homo sapiens
atggtggtcttgcgggcggggaasaagacctttctccccgstctctgcsgcgccttcgcct

SEQ ID NO: 14533 - DNA, 62 bp, Homo sapiens
cctgctcatcagctgctggggacactcggagccatccatgcgggmcttcctgctctctctgg

SEQ ID NO: 14534 - DNA, 392 bp, Homo sapiens
ctaaaatttgtaaattgaatacttttgaatgtaagcagttgaagtaaaacctgtagtgagttcttcagtcagtcaacactaaacctgttttgtaaatttgatgctagtattacactggactttctcaaaatgaagtacacctatatatgcatatagtatatgagcatgcgtatttgtacaaaagcccttcaaaaggagttcagcttttataaacaccaaaacactctctgcctgtaaaatgtttttgctgaaatttgtatcattaactctcaaatttacatcttcatgtttgagatacgcttttaggactgtctatgcatgtagactttggtcaactctctcctsstccctcaataaatcagttaacttaaaaaatatattgtgaccatttt

SEQ ID NO: 14535 - DNA, 55 bp, Homo sapiens
aaaaaaaaaaaaaaaaaaaaaaaaaaaaaaaaaaaaaaaaaaaaaaaaaaaaaaa

SEQ ID NO: 14536 - DNA, 72 bp, Homo sapiens
cgtgacatggssccggggagccgaggtgagcgttssagcttscggagmcggagggggcccggcgtacccagc

SEQ ID NO: 14537 - DNA, 321 bp, Homo sapiens
tgaaaaacattatttttaatagaaaataataggtgtaggctgggcacggttgctgacacctgtagacccagcactctgggaggccacgtcgggctgatcacttgtggtcaggagtttgagaccagcctggccaacatggtgaaagttcgcctctactaaaaatagaaaaattagccaragggtggtggtgcacacctaatcctagctactttggaggctgaggtaggagaattgcttgaacccgggaagtggaggttgcagtgggctgagatcgcgccaccgcattccagcctgggctacagaaccagactstgtctcaaa

SEQ ID NO: 14538 - DNA, 425 bp, Homo sapiens
acaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctycacgagtactcctgggtcaaggccaacctgtcagaggtgcttgtgttccarhgtcctgggggtyaacgtgaccagcactgaartctatggg

SEQ ID NO: 14539 - DNA, 453 bp, Homo sapiens
catagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcatagattaaaaatagtttgacattcaaagt

SEQ ID NO: 14540 - DNA, 498 bp, Homo sapiens
  misc_feature 399..400: n=a, g, c or t
ttattatgcttgttaaaaagcaggaaaatgtgactcttaaccagaatgaaaaagttgatagaaataaatatctaaaatgaaaaatccaccagggagtggtggctcacgcctgtaatctcagcactttgggaggctgaggtaggtggatcatttgagggcaggagttcaagaccagcctgaccaaaatggtgaaaccctgtctctactaaaaatacaaaaaaattagctgggcgtggtggcaggcacctgtaatcccagctactcaggaagctgaggcagcagaattgcttgaacctaggaggtggaggttgcagtgagccaagattgtgcctctgcactgcagcctgggtgacagtgtgagactcaatctcaaataaataaataaataaataaataaanngaaaaattcaccagatggatttagctgcagataacatactgtggaagawaggatcagtgaatttgaggatagatcaatgtaaaccatccaaaatcaaa

SEQ ID NO: 14541 - DNA, 480 bp, Homo sapiens
atttccaagctctttaagagggaaagaatagttgtctcatccaagacgtttgcttacatgatttgcttaattttatagttggaagtagagatgttttacttaaaatggagaatggcagtgtttaagtgggaatctccgcctaacagttgaaatttcggacctgaaggcttagaaaatatttctggggaaactaacgtgaaaacattaaaattctaagcaaaataaagtagataacattctataatttgtcttcatgtggtaggtacagtaggatatggaaaaagcatgctattttagacgtatgggcactcttcttccacactgcaggtaaagggcaaataaccatcgttggccaagctcgatggctcacgcctgtaatcccagcactttgggaggccgaagcaggtggatcacctgaggtcaggagttcaagaccagcctggccaacatggcgaaaccctgtccctactaaaaataaaa

SEQ ID NO: 14542 - DNA, 507 bp, Homo sapiens
acatagattatgcataaatacgcaattttgtccatgtcaatgaacctaacaaaatgctttttaaaagtatattttagattcaaacatgctttctagatcagaggttaacttgtctttttgaaatcctggagtcacttataagttagctgcaaactgtagtttcggtaattcaactgcttaagcatttctggactgtttatcaaaatatattacagaatgtgagactaaagtttaaagtctggacctttggtttaatttctagactttccaaagcttttttttttctttttaaaaagcccattgtcaactctcttagaacttcatcaagtaaatggtaccttgcaaatgtaggttgtgtctgaccttctttctttttgtgtgttggtgcctcagatgtatcatgtgctgcttgaactgattctctacagtgttccttcctagtctcaagctgatgatgtgctcaaagatgtatcaaaatccatgtaatgacaccttttagatgtttct

SEQ ID NO: 14543 - DNA, 226 bp, Homo sapiens
ttgtaatttgagccacattcccaactctaactcagcacacactgccagtcttccccaatatkycttcaattccccaccacaccttataaaattgtaatcaaagatatctcactctgtatgtatctaagaataaaaacactgactttaatacggttttactaagtttcaaccttctaattaggwgtctagtattctgcagatcactgctggtcttgatagccattaa

SEQ ID NO: 14544 - DNA, 541 bp, Homo sapiens
atggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggctcacagtgt

SEQ ID NO: 14545 - DNA, 523 bp, Homo sapiens
  misc_feature 501: n=a, g, c or t
agttgagggctgcccgctgcgtggggtggattccccagccctcacaggataattttatcacagaggacaacatttgtagttctgcatgagtggctctcctggcgagataaagaagagacagtgagctgaggctgaggctgagaaggctggcatatgtgatgtcttcggggatcggaagctgtaagtagcacagagggacacacagaggcctgtggtggtggaggaggggcttgacgggtcctggtaagtcctgtctgtcttcaaaacctgctccccctctgatggcttcctgccccttcagtgcctgtgagccttgccttgggacctgtggggcacatgccatgccactggttgccatgtttttcaaacgtttaacccattattgagagaatccttagtagaaagccaagcctatggggaatggacatcaaatggatatgttttcatgacaggtaaaataaatgttaagactaggagattttagagctggaagacaggtcntttttttattttttggacagag

SEQ ID NO: 14546 - DNA, 643 bp, Homo sapiens
aaagattaggtggggcgccagagccggggcacctgcgcaggcttggctgcgccctctcgcgccgcacgctctgcgggttcctcccttcttccgagcctctcctctggccgccgcgcgggaagagaggccgagatggcagatgagattgccaaggctcaggtcgctcggcctggtggcgtacacgatcyttkggrargatcatccgcaaggaaataccagccaaaatcatttttgarbwatgaccggtgccttgcttttccatgacatttacccctcaaagcaccaacacattttctggtgatacccaagaaacatgatatcccagatttctgtggcagaagatgatgatgaaagtcttcttgggacacttaatgattgttggcaagaaaatgtgcttgctgatctggggcctgaataagggttatcgaatgggtggtgaatgagaggttcagatggtggacagtcttgtctatcacgtttcatctccatgttctttggaggtcggcaaatgcatttggcctcctggttaaagcacgtttttggggataattttctcttcttttaggcaatgattaaagttagggcaatttccagtatgttaagtaacacacttatttttgcctgtgtatggagagattcaaga

SEQ ID NO: 14547 - DNA, 487 bp, Homo sapiens
attttaagagggggcagttagcactgtattcccttgtttatctgtttctctttgccactcaactactagtaaggttgttaccattggtccttctgctgctgcctccaatgagaggcaaagactaggctgatggggctggcaagtgggaactctctagggcctaaaggagaggaaccagatgttccttggtggaaccagagattcgtattactggtacagaaatctccacttaagagccatggctagaatgaatatataaaagccttcaaatcgcctgcaatcccagcactttgggaggccaaggcaggcggatcacgaggtcaggagatcaagagactctcctggctaaaatggtgaaacacatctctactaaaaatacaaaaaattatccagttgtggtggcatgcacctgtagtcccagctactgtggaggctgaggcaggagaattgcttgaacccaggaggtggaggttgcggtgagttgaga

SEQ ID NO: 14548 - DNA, 367 bp, Homo sapiens
atataaatatatatataaatcttttcttcttttgtcattcaatcaaattccaacaacccaaccagggccagtcaaatccaccacagtctcgcgctgagctaggaataaagttcacgtaatcacatgagagtggagaaaagtcccccatccggcaggatgctgaacggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaag

SEQ ID NO: 14549 - DNA, 505 bp, Homo sapiens
ctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggca

SEQ ID NO: 14550 - DNA, 166 bp, Homo sapiens
cattagccgggcgtggtgtcgggcgcctgtggtccccgctactcggaggctgaggcgggagaatggcgtgaacccgggaggcggastcgcagtgagccgagatcgcgccactgcactccagcctgggcgacagagcgagactccgtctcaaaaaaaaaaaaaaaaa

SEQ ID NO: 14551 - DNA, 487 bp, Homo sapiens
aatcttgatcaggaatactgatgtgtggtgtttttttcttatagtgtctttgtctggttttggtatcagaataatgatggcctcatagaatgcatttggaagtgtcctttcctcttcagttttttggaagagtttgaggagaattgatttaattcttcagatgtttgccagaattcccatatgaccctgggcttttctttcttgggaggcttttctttactacttcatgctcttgactagcataggtctgttcagattttccatttcttcatgattcaatcttgataggctgtgtgtttctaagaatttgtccagttcatctaggttatccaattctttgatatgtaattgctcatagtactcttaatcctttttatttctgtaaaatcagttgtaatgtctcctcctggtttttagttgtttttcttagtcactcttagctatcaacaaactcttggtttcatttatttttctctattgcttttct

SEQ ID NO: 14552 - DNA, 451 bp, Homo sapiens
aacggaggcggcgttcagaaatagggcgctggctttgcrgagcggctcctctccaagcctggcggtcactgccctgtgtccccttttgggcctctcctggtcctcctggttggattaggaggcctctcagcccggagtctgggtcgccgaagtacaggccccttcactgaagcgacccacggcgcaggggtttctggaagccatcgccaggctccgagtgttcagatgcagctgccaggctcaggacgcagagaactggcttccagctcgcaggagcgcctgtccgtggtgggtagggtcgcaggcgtggggtgtgcaggagcagtgggacagcactgaaacgcagtcggaagagataccacggtgtgcagggcacagggaaaagaccacgtgaggacacagagagaagacggccgtctgcaagccaaggagagaggcctcaggtgaaaca

SEQ ID NO: 14553 - DNA, 359 bp, Homo sapiens
taataaaaagggaataaatatatatcttgtatcatgtggatgccttaggctgtcagtaacagaacactccagtgaagaaaagatctcccagaacaagaagtccagaggaagggagagaaggaagacaggttcggggttggttaatttagtggctcactgatctaatcaaggaccccgacactttgcatctttatactctgccattctcagaatcttctctcatgattgtactctggctgtattgaatgcagactcaacagtgtcttatgaagaaatggaatatttcctcctgtacatcactttttgttagcaagacaacaatttcatggaaaccctccagtttttscctcaggtcctat

SEQ ID NO: 14554 - DNA, 447 bp, Homo sapiens
aactcatgaagacactgccttgatttgttgtcatgatttcaattccaaactctcaggagaagaaatctgactggcctggcttgagtcagtttgtatcctgggttcatggtaagcacatatgccagagtccatatgtttctggagatatggaatgcaatgtggaggtatggtctttgagaaagagggttcttgcaagctgattcattcaccccaaaaatgcaagtattatgatatataatggtgaagacttttattattttttttttcagtggggctgggttgtattgctccattaagatattaggggccgggcgtggtggatcacgcttgtaatcccagcactttgggaggccgagacaggcggatcacaacattaggagatcgagackatcctggctaacatggtgaaacccgtctctactaaaaatacaaaaaattagccgggca

SEQ ID NO: 14555 - DNA, 498 bp, Homo sapiens
cctatggaatagaagaaaatatatgcaaactatccactcaacaacgttctcgtgtccggaatctagaaggaatttaaacaaatcaacaagcaaaaaacaaataacccggctgggcacagtggctcacacctgtaatcccagcactttggggggctgagacaggcagatcacctgaggtcgggagttcgagaccggcttggccaacatgatgaaaccctgtctctgctggaaatacaaaaattagctgggcatggtgatgcatgcctgtgatcccagctactcgggaggctgaggcaggagaatcgcttgaacctgggaggcggaggttgcagtgagccgagatcgcaccactgcactccagcctgggtgacagagtgagagtctgtctcaaaaacaaaaacaaaacaaaacaaccccattaaaatgggggggcggcgaaggacatgaacagacacttctcaaaagaagatgtacaagcagccaacaaacatgaaaaga

SEQ ID NO: 14556 - DNA, 56 bp, Homo sapiens; identical to SEQ ID NO: 12139

SEQ ID NO: 14557 - DNA, 522 bp, Homo sapiens
tttctagttgttcattattgcactgaacaaataatgattcaatgaattcccctttatgtcactctttgctcatagttttgattcttctgaaagtagtattgctaaacaaatagtaaaataatcagctctaagtaacaaagccaactcaaaatgacttataccatatggaaaatgtgtcacatcatataacaaggtatccaatcatatcctaagctgcggaattgcttaattcattattttaaaaacatcatgattgactcaggtttttctgctctgtcaaccccagtgtgtgggctttgtctttaggctggccgtcctcttggtcagaagatagctgccatgccctcagacatttcctgtggacctggggacatcccttcctaagaatctcttaagcaaatattcccagatgcacaatgtaaatttctgctcacgtttcattggcaagaatgaggtcccatgcccataggttaaccgatcactggtgaagaaaatagttatcatgattgactgagattcttc

SEQ ID NO: 14558 - DNA, 464 bp, Homo sapiens
aaaaagtgtggttcaagcactcagggtctttgctccttccctagcccaagggcagcaagggtagtacctctgcagtggcagtggcagaggggatttcagttgcctctgggagctccacctcagagaaaggaagagttgatgctactgggaatgttcagccagggagtgggatggctgtgctgctggcctgagcctggggctctgcttgttgaggagaaggaggtccagggctcacagggaggagagactgggctcctgctcgtatggtgactgtggtatgctggaascacaggtctagggcacacaggatgtccctcatgtctgcaagcaacacctttcatagtgctgcattttctggctgccagatggagcttttctttcacactaaattgatttctgtgaaaagtctttgtcacctgcaatatgatgatgcttctaagtctatgcaccatcttaacagaagg

SEQ ID NO: 14559 - DNA, 471 bp, Homo sapiens
caaatgctgttaaactgtggattcagtcacctcttccgtgaaacctcctctcttaccctcaggcagtaatggtctcccawttctcaaagatacaaccttttattatggcatttaaattgtttttgtttttatcttccttacaagattctgtcattggacagctgattattagctagcagacacagtagaaattcaatcaattaatacattaaataatttatagaagaatgattattggcctctgccaccaagaaatggttatgtcttcttagtgatttgcctgctttttgtctccctggatttaggatgtagttttgaaaataacattgacgttccttcatagacgtwcgtacagttttcagtattcacaatggcagaagtatgatatttcgactgtgccctatttttatgctgggcaaggcctcaagaacaaaactcctgtgaccttacataggggtcttacactgaagg

SEQ ID NO: 14560 - DNA, 87 bp, Homo sapiens
atttaagattcagaataaatgggtttgatgtctggaaaaaaaaaaaaaaaaaaaaaaaaaaaaaaaaaaaaaaaaaaaaaaaaaaaa

SEQ ID NO: 14561 - DNA, 229 bp, Homo sapiens
  misc_feature 215: n=a, g, c or t
atagatttagggtgcaggacttaataatagtatagttattgtttgtttttaagaaaagctcagttctagagacatactattactttaggactgtgtagttgtatatttgtaagatgacagatgatgctgtcaasaatattgttttatttgtaataaaatatacaaaaatcacttgccagcagtagaaaaaggaccgactataccgacctttctgnattagtaaacagtt

SEQ ID NO: 14562 - DNA, 382 bp, Homo sapiens
actttggcttgtgtcagttccatccgcgggtgccggatctggacctaggtgctgacagcgagaaggcgcgaggagagtcgttttctcagctgcacagccggggcctgacggtcgccggcggtggtgacagctttgctcttgtctccgcccggatcgtccaccgctcccggcccgctccgcccagagtcctatggcggcggcactgagggccccgacccaggtattattgagtgttttcaagaatgaaaagaggcctggcatggtggctcacatctgtaatcccaactttttgggaggctgaggtgggaggatcccttgagcccaagagtttgaggctgcagcaagctatgatcgtgccactacactccagcctgtgcaacac

SEQ ID NO: 14563 - DNA, 424 bp, Homo sapiens
  misc_feature 13..14,216: n=a, g, c or t
cgttgggccgccnnggggtgtcgctgcgcccgctgccccgcgcgccctttaaactttgttttttaaacttcgggggtgtggtcgcggcgcctcccctctcggcggctggcagtccttgcctctgccccgccttccagatgctttggagtcatgagccgggagggctcgggggcagctttggtagccgaggtgatcaaaggtgagccgggagggcgngggcttcccctgggggctccggcacccgcgctgggacagggcgggcagtgctggcttggaggtgcccctagtctgggccccggccgcccttgtctcctgcgtgtgggtggcctcggsacttgtccccaggctctgggctacagcgctcatgggcggctgtgacccttgcgtgcctgcacctgagcctagtaggtgagctgcacctccc

SEQ ID NO: 14564 - DNA, 325 bp, Homo sapiens
tagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggttttttttttctcacgctgatggcttggcagagcaccttcggttaacttg

SEQ ID NO: 14565 - DNA, 464 bp, Homo sapiens
cagatttgaaatgattgtgaaagtattgggaagctgcatagtattatagcagtaacttaaaaaggactgcttgttaaggcagttattcaggttacttgaggatagaataaggtcctgatggtagtatagagcagaaatttaggaaccataaatggccactgtagtgcctgagacttaaacctcactattaaaagaggcttctttaccaagaaagatactttttaggctgggcacagtggctcatgcctgcaatcccagcactttgggaggccgaggcgggcagmycacctgagatcaggagtttgagaccagcctggccaacatggtgaaacctgtctctactaaaaatgcaaaaattagctgggcatgatggtgggtgcctgtaatcccagctactctggaggctgaggcaggagaattgcttgaatctgggaagcggaggttgcagtgagccaagatcgcgc

SEQ ID NO: 14566 - DNA, 301 bp, Homo sapiens
  misc_feature 183: n=a, g, c or t
agttttcccgggacgttcgggtggaagatggcggatttacctcagctgcggaaacgcagacgctgtytccagttgcgcatgcgcctscggccccgcgagcgcaccgccctcgggtggagctagtgctcagggcgtcctcgtgccttttcttggwggcgggaaacctgggttgaggtgtgaggngcttgcggagtcgctgcggcactcgttccgcccatcgcctttaggtcctccttgctcctgaagctttcagtatttgttattgtgaaagaagttaatycacctgaaacagaggaggggc

SEQ ID NO: 14567 - DNA, 187 bp, Homo sapiens
  misc_feature 86: n=a, g, c or t
acagatcctcactctccgtgtgaggctcgcaggggcgcastcagctggctgtataaggaggccacagttcaggaggtggacgtgancsctgaggacgggrcrgccgacgtgagggtacatcatcagcaactcagcctacggcaaattccggaagactctttccaggatgaacggacgcccacagagg

SEQ ID NO: 14568 - DNA, 75 bp, Homo sapiens
gccatttctaatctttctctggggggaacaggccacagaactgtgtwmagaggtgaaccatcttaattactagtt

SEQ ID NO: 14569 - DNA, 347 bp, Homo sapiens
caaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggagractcacttaaagtatacacacgttcaaggcggggcccatcctggagctggagcagtggatcgacaagtacaccagccagctcccaccactcacggccttcatcgctgccttcgggaggcaagatcagctcggcgctgcatttctgcsgggscgtgtgccgccggg

SEQ ID NO: 14570 - DNA, 324 bp, Homo sapiens
  misc_feature 86: n=a, g, c or t
agaaaggggagacgtgtgacgggggttctttttggtgacacagaagcgggttccagcatctaagtgaagaggctgagtccgtgavnmtaggggtcctggggccccacctgggttcrtgggagggaaaggtggtgctttggggacatagaatgggagcaatccaagractgaggcgcgctgwtctrggaccggagagtggggtttctaggtccaaggggaggctccctaaagcggggcaagcttgaaccaaaagagctggggtttcaggccgctcagtggaggcgaacctcgcccctcgctccccaagcggcgcgtascagccct

SEQ ID NO: 14571 - DNA, 84 bp, Homo sapiens
aaaaaaaaaaaaaaaaaaaaaaaaaaaaaaaaaaaaaaaaaaaaaaaaaaaaaaaaaaaaaaaaaaaaacaaaaaaaaaaaaaa

SEQ ID NO: 14572 - DNA, 483 bp, Homo sapiens
  misc_feature 436: n=a, g, c or t
gagccatttcttccccttgggcaaacgaggtagaccctcccagagaccaatgccggagaggcccggatccgagctccctttatatrgcctcccccatcasggatcscgtgggaaaacctgacacacaatggcgcggctgctccgggcaccctcaacccagcgccstgcggcaaggcctcgragcagcctggtggtcttggtgcgctccctttgccctccccgcaaccctctgcgagcactcgtcccaggagagagaccctggctagggtggaggttgcctcccgcaaagggcgctgttgctggggcctcscctccsccattctcttgtttttctgcttctgagactcgggagggaggcggcaggcgcctscgcagcsgatagagcagctattgtgascttsscttgcagagcgggaacccagccgagtgtgtacgnsggcggtggsgggggaggaggcgactgtgtgtgcaaacctcagtcgg

SEQ ID NO: 14573 - DNA, 477 bp, Homo sapiens
  misc_feature 430: n=a, g, c or t
cttttaaccaagtatctttcctgcctgsatcattttatcttcagttcatctgtcttagaatccggatagagagcatatgttaggtmttggaaagtacaagaggagagaaagcacttatgaaaggtgacattsccagaactggtgaaagttcaggaacagatttcttgaagcagaggaaacgamgtaagcccgagtggtgagtgagcagccgagccgacattcacacgcaggtcttcctggctccgaagcttgtgctcctgggcgtgctgcctggcccctcaagcagcctttcaggagtgagctccgtcagagtgattgtaccaaatggagaaaactctttccggagacgttcatcatcaatacsatcatcaagatttttcacataaagattaasacsstaaaaagaagaaaagaaaactatagaaaaagnrarccatggtggtacctaagtacatcgggtctattattttaccccat

SEQ ID NO: 14574 - DNA, 341 bp, Homo sapiens
cagttcttaagtatctttaagttcctttcctctctaacttctactggtagaatatttctaccagtagaaaaaaacaaaagaaaacccaaacaactctcaaccatgggccaagagaaactaagaaatcgatattgaaaggccaggaggggcaggagaagtggcwcaggcctgtaatctmagcactttgggaggccmgaggcgggcggatcacttgaggtcaggagttccgggccagcctggccaacatggtgaaatcccttctctgccaaaaaatacaaaaattagccgggcgtggtggcacgcacctgtggtcccagctactctggaggctgaggtggaag

SEQ ID NO: 14575 - DNA, 424 bp, Homo sapiens
ccaacagttatgcagagtgctacccagccacgatggatgacatggctgtggatagtgattaggaggtggattatagcaaaatggaccagggtaacaagaaggggcccttaggcgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgc

SEQ ID NO: 14576 - DNA, 308 bp, Homo sapiens
atcggtccagtgaggctgtcatctgggaggtgctgcgaagttggggctgcgcctgggatacatcattcactctttggggacgtgaagaagctcatcactgatgagtttgtgaagcagaagtacctggactatgccagagtccccaatagcaatccccctgaatatgagttcttctgrggsstgcgctcttactatgagaccagcaagatgmaagtcctcaagtttgsstgcaagtacaaaagaaggatcccaaggaatgggcagctcagtaccgagaggcgatggaagcagatttgaaggctgcagct

SEQ ID NO: 14577 - DNA, 84 bp, Homo sapiens
aaaaaaaaaaaaaaaaaaaaaaaaaaaaaaaaaaaaaaaaaaaaaaaaaaaaaaaaaaaaaaaaaaamaaaaaaaaaaaaaaaa

SEQ ID NO: 14578 - DNA, 408 bp, Homo sapiens
tgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgcsccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaaatgttatccagcctgaccaacatggagaaa

SEQ ID NO: 14579 - DNA, 469 bp, Homo sapiens
gaacaacgactttttgcctccaaagttggatctagtgatgatcagcaccagcaggaaatgacatttsgtgtctgcccactgcagccatactgtgacctccagccagacttccgcctaattgactccactggatttgtgctctgttgagtcagaggctcccgggggttggggatcgasgaggcgggggtcagctatgcagcccatcacgtgtgtttttcatctgggatgaaaaagcctggttctcttttgaaatgcttgattgtacttattgagctaaacaagtcttggtgactgttgttgatttgcctcaaaagttttaagtcctgggttttcagactactgtgtagcagctgtgtgtttaacatactgtagctttttctcccttgggggcacatacaaataggatgtgttgatgtggactctaaactgtaattttcctgtaactattttggaatgatgcatatttcta

SEQ ID NO: 14580 - DNA, 413 bp, Homo sapiens
  misc_feature 373,379: n=a, g, c or t
ggggctgcgcggcctcttcccagccagcttgaaagggtttgcgtmgcggccttgtgggcccttcaagcgctctgttaaagcgstctgtgggcggcstggccccaactcctctagtctaggcgcacgaagggagttgctcctaggtcttgtccgtgccgggwtcgcttttctttccwtcssgaagcctggcccttagatctactatcgcagagtctgcggccgccaggaagcccagattcgagtgtccggagagtaaccggaagtgctgtccccaggcctaggggcggcgccggcggctgccagggagaggcaagaattsagtgttcgtgaatagttctgaactagagaccttttgaaaccaaaagggaagatngtcttnagtctttcttgttacgaatgctatcttctttgag

SEQ ID NO: 14581 - DNA, 488 bp, Homo sapiens
gaacaaggaaagacggtagaagaggctgcggacctatcgttgggttatatgaagtcaagggttaaaggtttaggcsctcatcgtggttagcaaaacaggagactgggtggcaaagtggacctccacctccatgccctgggcagccgccaaggacggcaagctgcacttcggaattgatmctracgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcmcgtattaggaggattacttgagccctggagggtcacagcctgaggtgagccatgattactccactgcactccagcctgggggctacagaagcc

SEQ ID NO: 14582 - DNA, 322 bp, Homo sapiens
  misc_feature 173: n=a, g, c or t
attaaaaaaccttgtgtagataggagaactaaaatggggaataggccgggcatggtggctcaygcctataatcccagaagtttagaaggccaaggcaggagcatctcttgagcccaggagttcaagactagcctgggcaacataatgagaccctgtctctacaaaaaaatmanaaaaattaggcatggtggcatgtgcstgtagtcccaggtacttgcaaggctgaagtgggaggatcacttgagcccaggaggtagaggctgcagtgagccatgatcgtaccactgcactccagccagggtgacagagcgagaccctaast

SEQ ID NO: 14583 - DNA, 399 bp, Homo sapiens
  misc_feature 77,85,355: n=a, g, c or t
tatgctactttcctgtttgcactactacttttttattaaacgatgttaaataatctctctgtgaccaaagtgactanaaagaganccatgagtttactcaagaagtaaatggagctggccaggcatggtggctcacacctgtaatccmagcactttgggaggctgaggtgggcgratcacctgaggtcaggagttcgagaccagcctggccaatagagtgaaacctcgtctctactagaaatgcaaaagttggccaggcgtrgtggtgggcactgtagtcccagctgcttgagaggctaagacaggagaatcgcttgaacccgggaggcggaggttgcagtgagccgagatcatnccattgtactccagcctgggcgacaggagcgagactccgtctcc

SEQ ID NO: 14584 - DNA, 482 bp, Homo sapiens
aatttcattatttaccgaggagtcattcaggagcagattgttcaatttccatgtaatcgtgtggttttgagtgagttttttaatcctgagttgtaatttgattgcactgtggtctgagagactgtttgctatgatttcagttcttttgcatttgttgaggactgttttacttccaattatgtggtcagttttagaataagtgccatgtggcacagagaagaacgtatattctgttgatttggggtggagatttctgtagatgtctattagatccacttgatccagagctgagagttcaagtcctgacttttcttcctccaaccctccagtgagacaggaagactagaggaggctggagttgcagaaatatccctccccgaaaataggataaggttctgagcaactaagaggtctttcttggctctatgagaacctggtgggattcctgaagataaagtccacaaaaatgaagctccagacaa

SEQ ID NO: 14585 - DNA, 325 bp, Homo sapiens
  misc_feature 325: n=a, g, c or t
tagaattatgatctccattatccacgatttctttcatcagtgctttgtagttctccttgtagagattttatatctccttggttaaatgtattcctggatattttatttttgtgtgtggctattgtaaatggaattgagtttttgatttggttctcagtttgagtgttgttgatatatagaaatgtaactggctgggcacggtggctcattcctgtaatcscagcactttgggaggctgaggtgggtgggtcatctgaggtcaggagttccagaagcctggccagcaagtgaaaccttgtctgtactaaaaatacaaaaataaaan

SEQ ID NO: 14586 - DNA, 399 bp, Homo sapiens
agaggagaggagggcgathkgagaggatggagaggaccgcgcctgcggagggcgacggggagaaggaagcgagccgagcggatggcagccccggaggcgcaagacgagagcgggcaggaaggagggacatagggaccgcgggcggacggaagtaaagtgaaggagctagcagggcaaggcgggaacgtgactggacacagctttgggctctgttgtttcgagtgcgctattttgtccatccaaacagaagattatgaatggagagctacatcccatggggtggcagatgaagatgtgcaagaagaagacactaacaactgaattgcagattgaggagatgagattatggtgacagaatccatcttcggtgtatgtgcatgaagaaataagccaaatcta

SEQ ID NO: 14587 - DNA, 332 bp, Homo sapiens
tacttaacaaatttttttcctgggcttcagtccaggaattttttctggatctagcgctaagagagaggctttattaaagccacagttctttttctgccatttggtccagtggtataaggactctcccttgtgagtgccattttgtctggtctgaatgcttaggatgcatcttcacaattttatgtttttgtttcttgctactttaaaaatatttagattaccttatctttgtttgaactggtgtctgtgatgctttttattactcatgtcttaaaggttgtgtcttcaatgcctcaaagctttttgaaaaagaaacatgcctgttctgtttt

SEQ ID NO: 14588 - DNA, 280 bp, Homo sapiens
tgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatcaaaacatggaaaaaaaaaaaaaaaaaaaaaaaaaaa

SEQ ID NO: 14589 - DNA, 284 bp, Homo sapiens
gagattgtgccactgcactccagcctgggcgagagggcaagactctgtctcaaaaaaaaagcactttatttgggagattccaggaaacattagtagaggcagaggaaatgagaaaggagggaaaatcatgtggtattgagcggaaaactgctggatgacagggctcagtcctgttggagaactctgggtggtgctgtagaacagggccactcacagtgggtgcacagaccagcacggctctgtgacctgtttgttacaggtccatgatgaggtaaacaatacac

SEQ ID NO: 14590 - DNA, 357 bp, Homo sapiens
atttgcttttcccagcggggaagggaccggatctgaaaggagatgctctctgattcctaaaagggtgggggctggctgggcgcggtggcgcatgctataatcccagcattttgggaagccgaggcgggtggatcaagagaagaggagttcgagacaagcctggccaacatggtgaaaccctgtctctactaaaatgcaaaaaattagccgggcatggtgttgcgcgcctgtagtcccagctactcgggaggctgaggcaggagaatcgcttgaacccgcgaggtggaggttgcagtgagctgagattgcgtcactgcactccagcctggtgacagagcgatactctgtctcaaaaaa

SEQ ID NO: 14591 - DNA, 364 bp, Homo sapiens
ttgaaaagattgtcctttcctcactccactataatgccattgttataaatccaatgtccatatatgcttaggtctgtttctaaacttttttgttatactatgttcatttgtaatagaacatcattaatttaagaaagttactcatcacaaaccttggtcctcgtagctcaatcagtaacggcccagtcttttctatatggaattggtagatggggttatttttgtgagtctcttggaaatttccacatcctccagcactctgaccactccactttccattaatctaataaaaacaaaagttttagtattaacaaaatttcatttccaattccacttaaagacaaaactcctttccatctcaaaa

SEQ ID NO: 14592 - DNA, 109 bp, Homo sapiens
ttttgttcctctgtttataaaatctttttgtttttcaaaaaaaaaaaaaaaaaaaaaaaaaaaaaaaaaaaaaaaaaaaaaaaaaaaaaaaaaaaaaaaaaaaaaaaaa

SEQ ID NO: 14593 - DNA, 478 bp, Homo sapiens
acaagatggcggcascggcgctgggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtcatccggctggagaagaaaagcctctcatgctaacgttgcagaccccagagggtgagagaaagggggacttcattcagtcttgaaacctgtgtgctcagcccccaaggcatcaggaattcttcctgcccagagaatcaaggcagcttcatttttttcgtaccttggtcagtggttctcaacctttttgttatcaaggcactttttgttgtacatatgtcctgttgcccccccctgacgagcatcacaaaaatcgacgctc

SEQ ID NO: 14594 - DNA, 507 bp, Homo sapiens
ttaaaaattttatagtgacattagagacaatggtcatacaaattatcacataaacatggacttgaaaaattaggcttttcataaaacacatcacatgtcattgactgctttttagaaatacacttccaaggcagtacatctgtattgctactgaaaagtgccatttcacagaacacagacttctttttgctctttgacatcttgaaaacatctgtttttcttttttaatacaaaactttgtgctcaagacaaatcttacatgaaactctcataaaccatgaaaatgtagctggccttcgggccttaggcatgaaataagcatgaggaacatattcccctaacttctacccccagcccagcaagttatcctttaagaaatctcctaggaattctggagtttgaaaacaattgctctatgttattcctgcttccagtctctaagtaacaagggcatttaaaagcatagtctcttaaggtccactatagtggttctttatttaaggaata

SEQ ID NO: 14595 - DNA, 238 bp, Homo sapiens
ccttctcgctaacctcttcgcccggaagtggcaacaagactgcaacatcccctcacgcctagtctgtaaagaactttgtttaacccggagcggggccagccagctccgcccctccagctggacgcgggagmaggttgaggttcatacccctgggttctctccaggcctgaggcggagagccagccgcctgcvtacctctgggctttgaaccccgggtctggtgacttcgcttaaagac

SEQ ID NO: 14596 - DNA, 433 bp, Homo sapiens
aaatactttttagatatcctagatgcatctttcaacttctaacattctgtagtttaggagttctcaagcttggcattattgacatgttaggccaaataattttttttgtgggaggtctcttgtgcgttttagatgattagcaataatccctgacctgttatctactaaagactagtcgtttctcatcagktgtgacaacaaaaatgggtccagatattgccaaatgccctttagaggacagtaatcgsccccagttgagaaccatttcagtaaaactttaattactattttttcttttgggttataaaattaatgatcctgaattaaattgatggaaccttgaagtcgataaaatatatttcttgctttaaagtccccatacgtgtcctactaattttctcatgctttagtggtttcamytttctcctggtat

SEQ ID NO: 14597 - DNA, 492 bp, Homo sapiens
aaccaaggaaattctagcaactcactcttctggtgcaagaggagagattgggaaacccaggtaacagtgcatagatgaattgcctaaggttctgcttctagttggtgtcctgcgaatcagttcagcccagagaactcatcactaccaggcccagttgaaggaggataaggtgagattccttcacaaatggtggctccaactggaattcattgtcccaaattctgagaactcctgaggaaagatccaaaagtaatatggctcaagatttttgaactgcccaggctctactcaggctcttggacagcttgcccatctcaaaggtctctcctgcctactgccggccctacccacaagatgtgaacttcagagccttcttgcaactgcttcttggctatttgcaccctctaaccctctggaagaagaatgaggactattatgaaggcaaaagcataaaaggggaaaagattagcctccagagtaggaagattgggt

SEQ ID NO: 14598 - DNA, 414 bp, Homo sapiens
aagaggtgaaataattggcgtgaaagttctaggcatattggctatgatcgacgaaggggaaaccgactggaaagtcattgccattaatgtggatgatcctgatgcatccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccacc

SEQ ID NO: 14599 - DNA, 167 bp, Homo sapiens
tctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggagg

SEQ ID NO: 14600 - DNA, 483 bp, Homo sapiens
ataaattgaggttcatttttcacatagacttgcaatttttagacaccacattttttttatagtaacagcctcatttgcctgtacaataactaataatacagtatttcataggtacattgtatgtgcacaggaaatttttctttaaatcttaagagcctttaataaacgggatattttaatattttaatgttactacatttaaaaaatagtgttttcctacaaaattttctgtattcagtatacgttaactatgaaaatgtcaaacaatgaaatcattgaaatatatttaaggaaaaattaccaaccaaaagtaatgagtaccctctatgtgcatatttactggaatgttcatgtgaaatggtaacatttccaataacagcattttgaatctggggtgacacaaacatgatttttatttttgagctagggattttgatggagaagcacctagatgaagacaccatttcattcatgatattttaa

SEQ ID NO: 14601 - DNA, 449 bp, Homo sapiens
aagaagcggacctaagcgatabtttgcgaggctaaagaagccgagagagaagtaaaatttgctgcataagtagggtgagcaggcggccgtgggtgccctgttaaagaagtatggacatatgcatacttccagaagtatattaacatgcaagttatatgtaaacgaccgtttgagtaactaaccaaattaccgtaattgcaatcaatgacttttccccctcccgtatgctacaagactcccttagtaaatcaggccgtgggatggacgctgggttcctagaagggcgcgcaggaagacggcggacggggaagacgttctttctgactgcccttttcctacttatcttggaggacgatgcggagtttaagctccttaacatttcgggaatggcgcggtccaaccgcgttcagtcttttcgccgttagaggcccgactcgaggccgtggttc

SEQ ID NO: 14602 - DNA, 551 bp, Homo sapiens
ttttatttggactagagggaggaagaaaaaagcttgggactgctgctggaggaacagaagtgcattaggaggctcatatttcacaactggttgccagtgtctatattggctgatggctctggtttccagctggcggtggccttggttgaaacatttacctggtgtcttcagggatgctgtatcaacagctgtaagtagagctagttattcagtctgctctgagaaaggttaaagtgtgtgtctttggcttccccagggactaatccagtaacaggagagtcagagagaacacgtaccacttgggagggggtttcttcaccgggattttcgttgttattttagttacaaatggaagcatttaaaacctaaatctgtatttaggcagtgagaggagaaacagggacggaaatgaattatttatttcatcactggggtcctggaagcgtggagtgggcgttaatctcctttgaacaggagcctctgggtcgggcttgaggtcgtctgtgtgagatctgaccttatctgctcctggccagacatctcggctttga

SEQ ID NO: 14603 - DNA, 510 bp, Homo sapiens
tatttattatttttatataaaagatagtcaataggaaggtaggattggggagaaaacttagcaaatgtcacaaaggagactcctagtaacaaaatctgcgggagccttttcttttaaaataaagatggtgcatctgtccctttacagatttctctcctgtcccctgggactggggaaggtgaatctcctgcctgacaccctgtagagattagtgtatccagctgttctattcccatgattcctctgaaaaccagactgactgggaatagcagtaggggtttggccagtgagggcaggtggccaaatggtgtgcaggaaactcgcatgtttccctgggttggcttcctgctcccctgtccctgtcaccaatagcagcttcaatatgggagacgattaaaacaaaggagaaaaacaaaaaaccgtatccaaattataaccaaccaagtctatggaggaaattcacaaggcagcagagcagaggctgcagaggtgctctgtctaccgggagaa

SEQ ID NO: 14604 - DNA, 598 bp, Homo sapiens
aattgtttctaaatgaaatgtcaatatcagaatttgaacaaccacttaagctatggagttttctgaaatgaataaccattaactgtgtttggttttcagcccctgtctattaagtgtattcagtgttttcaggcctatcacaatcgtttttcctttttttaaaaaaaattgaaggctgggtgtggtggctcacacctgtaatccaagcactttgcaagtccgaggcaggtggatcacctgaggtcaagagtttgagaccagcctggccaacatggtgaaacctcatctctactaaaaaaataaaaattagtaggccaggcgtggtggctcacgcctgtaatcccagcactttgggaggccgaggcgggtggatcacataaggttgggagttcgagaccagcccgaccaccacggagaaaccccgtctctactaaaaatacaaaattagccaggcatgatggcaggtgctgtagtcccagctactcgggaagctgaaccaggagaatcgcttgaacctgggaggcagaggttgcagtgagccgagatctcgccattgcactccagcctgggcaacaagagcgaaactgcgtctcaaaaa

SEQ ID NO: 14605 - DNA, 440 bp, Homo sapiens
ccccgccccttgctctgttttctcccagctgccggaccagcgggcctgccgcctctacggaccagtccctgctcaggcgtgcacaccgagcggcggggcgctgtggaacgsgggasgactagcggaggaggatgcggaccaagccccagcgacccagggcaactcggagctacctcgggcagccctgcgggtctccgaggagaaccgaggagacgggagaaacatgggagagggtggccttttccctgttcacacacacatgcacgcagcsactggccgggacagttgasacccatcttccttccctgctccttccagtcattctacacccgcttggtgctgccagtgcgggcagggccttggagcccaaagcggatccccacacttgtccctacggtcggaaggaaagtagaggagagagagtcaggcgcggcagggct

SEQ ID NO: 14606 - DNA, 416 bp, Homo sapiens
ttttttccggcgctggctccgcatggtcagtgccatttcgcctttatcgtggtggagtccaccctggctgtggtgagttccgcctgcttggggatcccggagatagcggggggcggcaaaggaacgattgggtgctgtcgcccaggagcctctccgatccgcctcgtttcactctcttctccaggggctgtcggtcctccctgcgcggccagtggctagaggccgcastcagtgggtcccagtcaggagccaggtcgggaagtgtgtttgtcccgactccgcgcgttttctggagtggtttcatccgctgtgctcccttcttcaaaagcttggaaagcaacctttgtgagtttctttctttctgaaagtaaaaggatttctgccgttccagtcagggttggctccggccccgcatt

SEQ ID NO: 14607 - DNA, 419 bp, Homo sapiens
caaatcatttcacgcttattttctggggagaaaaatagaaaattacaccttgtttacaaatgaaatagtttcacttaaatgggactctagccaaggcagttaattagtcaaaagatccacagctgtcatatagtcacacattgtttattctatttgctatgtcgaccactgatgtgtatttaatattctgcatccttcacaggaaatgacaaatgccctgaattatttgcaaatagaattgctaatgaaaaagaaaaaaaatgttgatgttaattaaatggtgattaaaaatttatctcctttaaatctaaaaagtgcagctttaataatcagttgtcatataaataagtaccttgtactgaaatcccttgcggtttaagacctaaataaacactaatttgagaactctaaatacctta

SEQ ID NO: 14608 - DNA, 502 bp, Homo sapiens
cactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggcttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtaccagggagggagca

SEQ ID NO: 14609 - DNA, 361 bp, Homo sapiens
acaaatgaatattgaggtggtggccagggtcggaggtaagaggtgcggctgtgttcctaggagcaggctttttctttaattttctctcaaccgtctcacggagaggccgcacattcagtggaaagtgtcgttttggagtcagcaaattgggtttaagttctggctccatggctgtgtggccttgagcaggttgcttggsctctctgtacctcagtttgctctcctgttaaatgaaagagctctggagagccaggtcagaaagcgtgtggcacattgtaggtgctcattgaatgctagtgtctccagctccaccagagcagccccctcacatggaagatagaaaaaccaaggctctggccgg

SEQ ID NO: 14610 - DNA, 335 bp, Homo sapiens
caaggaaagtaaaggcaagattgagaattttggtagagaactggaaatcataaagaagaaacaaaagttctagaactgaaaatgcaataactaaaattaagaagtcaatatcaggggttcaagaccagcctggccaacatgatgaaaccccatctctactaaaaatacaaaaattagctgggcctggtggcacatgcctgtaatcccagctacttgggtggctgaggtgggagaatcacttgaacccaggagacagaggctgcagtgagctgagattgtgccactgcactccagtctgggtgacagagcaagacattgtcttaaaaaaaaaaaaa

SEQ ID NO: 14611 - DNA, 206 bp, Homo sapiens
caactattatttcttcaaatattttttcaccccccagtcttgtcttttttagggacttcaataacatgagtggcagatcttgttttacactcccatgggtccttcaggctctcatcttttttctttttccagtctattttctgtcttgwtaatattgattaatttttatttaccttccatggtcctcactgattgttttctttgtc

SEQ ID NO: 14612 - DNA, 50 bp, Homo sapiens
aaaaaaaaaaaaaaaaaaaaaaaaaaaaaaaaaaaaaaaaaaarraaaaa

SEQ ID NO: 14613 - DNA, 410 bp, Homo sapiens
  misc_feature 106: n=a, g, c or t
aattttaaatcggtacaagatggcggagggggwcgaggcagcgcgagggcagcaaccgcaccaggggctgtggcgccggcgacgaccagcgacccaagcgccgcgnttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggtgaatagtcttttaaattgaacccaaaa

SEQ ID NO: 14614 - DNA, 423 bp, Homo sapiens
cattmattgtttgttttggccaaataaaaatgcttgtatttctttaaaaagtaagcctgaatgtagagtaaaaggggaaatgcsaagattttggggtttttttgtttcctttttttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattat

SEQ ID NO: 14615 - DNA, 163 bp, Homo sapiens
cattttagattttctatttttgaaaactattattattttcacaggccagcaaggtggcttatgcctataatcccagcaacctgagaggcaaggcaggaggatcgtttcaggccaggagttcaagaccagcctgggcgatgtagcaagaccctgtctcaacaaa

SEQ ID NO: 14616 - DNA, 495 bp, Homo sapiens
ttggtgaaaatttcagagagtaaaataaaaatctgagaaacagaagcacttgagaagaaggtaaaaatatattattatagcaacaaagtaacagtactaatactgttattattattatactgtgctgacatgtagtattatattgtgctggcatggaggtagttttgtgttgttcttataaggaggattgtctaaaaaggactctgagagttctctctgaattgcctaaacaatgagctagttagcactggggcttaccccttctcctagcaagaagagctcctcattgtcagctgcctgtgggtctaggggccctttgctccagcagaaggtgctgcagtgagccacaggactccaaatcaccaggtgctgagcagctaatattcccagacagcccttataaacagcagcacccaaacctggagtacttggtgctcaagtagtgtatttgtcttctccccgacaacacaggcaattaacaaggccaccttccct

SEQ ID NO: 14617 - DNA, 430 bp, Homo sapiens
  misc_feature 88: n=a, g, c or t
tattsaatagaatattatgcacccattaaaatgtttatataggctgggctcacacctgtaatcccagaactttgggaagctgaagcgngaggattgcttgaggccaggggtttgataccagcctgggcaacatggcaaaaccctgtctctacaaaatttttttttttaattagccaggcgtggcagtgtgcacctgcagtccttgctacttgggaggctgaggcagaaggatggcttgaaccaaggagttcagttgcaccactgcactcctgggttattttagagaccctgtctctaaaataaataaaaaagaagttagagaccagcctgggcaacatagtaagaccctgtctctacaaaaaataaaaagattggctgggcatgatggcacacgcctgtagtcccagctacttaggtggctgacgtggga

SEQ ID NO: 14618 - DNA, 352 bp, Homo sapiens
gctgaaactggatcccttccttacatcttatacaaaaatcaattcaagatggattaaagacttaaacgttagacctaaaaccataaaaaccctagaagaaaacctaggcattaccattcaggacataggcatgggcaagaacttcatttctaaaacaccaagcaatggcaacaaaagacaaaattgacaaatggcatctaattaaatgaaagagcttctgcatagcaaaagaaactaccatcagagtgaacaggcaacctacaaaatgggagaaaatttttgcaacctactcatctgacaaagggctaatatccagaatctacaatgaactcaaacaaatttacaagaaaaa

SEQ ID NO: 14619 - DNA, 83 bp, Homo sapiens
aaatttaataaactgtaccatgctgctgcatgttttcaagtacatgttgaacagtaaggattggggagttgttttttaatggt

SEQ ID NO: 14620 - DNA, 321 bp, Homo sapiens
caactttttcatttaatccagaagggtagggactatgcagtgtaagctgcatcacttctgctttcttcctactagtgacaatcatctggtcttgccctcaagcaacaattgctagagtaacatctttgtataagcaagtaaccccagatagagttgacgtttcagctttgggctgtcaaaagggtatgtcatggaccaaatcactgttagtacgggtatgtttgcatttggtcactgatatgtaaatgactgctagcccacggctggaccacttctcaatcagcaaataaagccatgtctattttgctatctcagcataaa

SEQ ID NO: 14621 - DNA, 491 bp, Homo sapiens
tcttcatggagtggtttattttaattttgagagctctatatccaacataatttaacacctggtcagtttaaagcattgttctgagttatttatatcagccctctcccttggtactatgttttaaaaatctggtgtgtattttgcacttctagcacatctcagtttggactaggcacatttcaagtgctcagtgccacatcttcctagtgtcttactagttggtcagtacaggtatgacttatgttgaattttgcctagttacgaagatatgaatcttaataataggatctcttagtattagcactcattggattttctaagtggaaatgtaatggcagtgcaatgatttaacattgtttactacagacgtttcttgaagacttctgagttatcgtaagcatgtacaaaaggttatttcttaagcttgcatttaaaatgcgtttacttcgtatgatcctcagcaagactatgagttgggaatattacatgct

SEQ ID NO: 14622 - DNA, 492 bp, Homo sapiens
taaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaa

SEQ ID NO: 14623 - DNA, 483 bp, Homo sapiens
ctaatattttgtctatgatccatttttcacctctaggcccacttttttgaccctcacacatcacggtagattaggaatttcttaatgctgtactggttttggaggtaaggaagatgggactagcccactttgctttgtcaggctgagagggaagaagtgattccattgagccaggacttcagtggccaaaactacctcccctggcttcagaatcccttccccagaccaaccctgcgtgatatcagcatgtggtaaaacactcctgtgtctttagagactgcagtctataaatgatttttctgtcttccatgggccttgcctgcaagcactttccatctttccctaggtttcaggaatgctcaagaattacgggatcttgactgggcacggtggctcacacctgtaatcccagcattttggtaggccaaggcgagtgaatcatttgaggtcaggagtttgagaccagcttggccaacgtggtga

SEQ ID NO: 14624 - DNA, 472 bp, Homo sapiens
aaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgsscctccccagcccccacccatgccagcgcagscagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggt

SEQ ID NO: 14625 - DNA, 484 bp, Homo sapiens
  misc_feature 448: n=a, g, c or t
tctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaattattggntcttataaagtacttgtgtggaagctttgwttccac

SEQ ID NO: 14626 - DNA, 359 bp, Homo sapiens
  misc_feature 330: n=a, g, c or t
gcttgtgcgcatgtccccgcgcagggtcgggcgctggggtgtggagactgaaccttgcagacacccgggtccgcacgtctgggatggacgtggtgagtgcacgtgcgcacgcgctgcgtaggggcggctgcgctcatgcsacatcgggagtggtgcttggagaggccacctactcaccgcgcccccaagaggccgggggtttgtccctggtgttggccctaccctgcgcgatccagtcttgtcgtttcggggcttcattaccagagccccgtgaatcctttgctagatgcttaaaaacattttccccattgtacatagctgtttccacgnaataaaaagctttacatttaaaagaaaaa

SEQ ID NO: 14627 - DNA, 52 bp, Homo sapiens
gagaccatcaactatggaaaggagatctagggaacaccgtcttgaacccgcc

SEQ ID NO: 14628 - DNA, 511 bp, Homo sapiens
ttctagccgtgtgaccttggacaagcctcttcagttctctgtattctcctcagctgtaaaatgaaggactaaactattcaaatcagttccataagcattcatcaggcaccttctcggagtaagacatcatgctcagccacctataaaattctatgatcctgaatagtatcaatgggaaaatatcagagcaaagcaaaatagtctgtttgtggcaaggttgaagagagaacccaaatagccgactgcattacctcatctcaatgagcaatgtttgtaaatatccaaagtgtttaattttgagacactcttgagaaatcctttgccaataagaaattggcagatatggttctattaacacctatcagccttgaaccttccaaaaattaaacatttaaactcactttgcaccttagtcaaatggcgtgcttctggagagaaatctgggaagatcaaagttattaacactcccgatggcaacagtttaagaataggatgtgtcaaaaaaaaaaaa

SEQ ID NO: 14629 - DNA, 233 bp, Homo sapiens
ttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgacccccgccccaggtttgatgtccttccaagaataaagtctttccctggtaaaaaaaaaaaaaaaaaaaaaaaaaaaaaa

SEQ ID NO: 14630 - DNA, 129 bp, Homo sapiens
aaaagtctgagaccagccctgccacttactagcaggtcccgtcagtttgggcttctctttctcaccaatgaaatgaataggagaagttcagctctcagatcttgcaactctgagagtccttttcccagc

SEQ ID NO: 14631 - DNA, 206 bp, Homo sapiens
atttttttcatttcttccactaaagcgtttgcgagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaaaaaaaaagaaaaaagc

SEQ ID NO: 14632 - DNA, 475 bp, Homo sapiens
ctattgcatattgtcagtattccacccattgtgcgattctccaattttgttaaattagagaggaggttggtgtgtgagtcaatttttctgtcttatttatcttgacaaacaatttaagagattatctggcatttggagttggcgcagattaattatgtagattatatccacagttctcatccaaattccactataaacacaagaagaaaaaactggttggtcttaccatgtgaacatttcattttggatataaagagggaaatgaaaatgttgatgatccaaacctgcctgacccaaggaaattcctaagtgttttagttacatgtccttgaagttgtttctttacacattttgttcactgagggcctctttactggcttgggtgcaggaactcagtctcatgtttgccatcccaaagttctgccttacactgtgttggtcttatcatggccattgtttttccacatggtagcaa

SEQ ID NO: 14633 - DNA, 520 bp, Homo sapiens
aatatattttttgccctgggctttgagatactgcttcaacttgagcttttggggaactaattagtgtttcaacagtgagtatcttttcccttcaatttatctactaaattttgaatataagagttcttctttttagttctagaaagtactttgctgtaattttttgttcaagttccatttcctaggagttgcctgttctgtgtattctgcttgttgtttctatctggctgttagtcttcctgagtgcagcgttatataattttgccttcacatggctttattcacccttgggactcagatctacttccttagtgtgctttcagcagcagccattcagtgagcaataagaagacacatacacggctgggtgcgctggctcatgcctgcaatcgcagcgctttgagaggccaaggcaggtggatcacttggggtcgggagttcgggaccagcctggccaacatggtgaaacccccgtcttaatatagaaaaattagccgggtgtggtgatgtgtgcctgtgg

SEQ ID NO: 14634 - DNA, 367 bp, Homo sapiens
cagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttt

SEQ ID NO: 14635 - DNA, 308 bp, Homo sapiens
ttccacttcaggctgggcgtggtggctcatgcctgtaatcctaacactttgagaggcccaggtgggtggattgcgtgasttaggagttggagaccagcccgggcaacacggtgaaatgccgtctctattaaaatacaaaaaattagccggatgtggtggtgtgcacctgtagtcccagctacttgggaggctgaggtaggataattgctttaacctggaaggcggaggttgcaatgagccaagattgtgccactgcactccagcctgggcaacagagccagactctgtctccataaaaaaaaaaaaaa

SEQ ID NO: 14636 - DNA, 465 bp, Homo sapiens
aaagtaagtcaaatatatgggtagaccaaaggaagatgagttattttaacaaatgatgtttgtacagaattgtcttagcctccattccgtctcttgtggtcagaatgttgctttcctcctgctacatagagggcatctttcacaagggagttttgtttcttgatttcaagaaggggagrtcagaggccagatgcagtggctcaggcttgtaatcccagcactttgggaggccgaggtgggtgaatcatttgaggccgggagtttgaagccagcctggccaacatggtgaaacttgtctcaactaaaactacaaaaattagccagtgtggtggtgggtgcctgtaatccgagctactccagaggctgaggcaggagaatcgcttgaacccgggaggtggaggttgcagtgagcagagatcgcgccactggactctagcctgggggacagagcgagactcagtctca

SEQ ID NO: 14637 - DNA, 288 bp, Homo sapiens
cccacaggctgggtgtggtggcttatgcctgtaatcccagcactttcggaggccgaggtgggtggatcatgaggtcaataaattgagaccatcctggccaacatggtgaaacccatctctactaaaaccacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaa

SEQ ID NO: 14638 - DNA, 222 bp, Homo sapiens
taaaaaagaagttagagaccagcctgggcaacatagtaagaccctgtctctacaaaaaataaaaagattagctgggcatgatggcacacgcctgtagtcccagctacttaggtggctgacgtgggaggactgcttgagcctggaaggtcgaggctgcagtgagctctgattgtgatcacaccaccatattccagactggaagacagagcaaaaccttatcaa

SEQ ID NO: 14639 - DNA, 251 bp, Homo sapiens
gagagaaaggaaagaaaggaaggaagggaagggaagcgaaaaagaaagaaaaatmaaaagaaaagaaagamagagcagagaaagamagasaaagasaaaggaaggaaggaagggagggaggaaggaagggagggaaagggaagggaagggacaagaagaagaaagawawakataagawaggtaggaagggagggaggaaggaagggagggaaaaggaagggaaggggcaggcataaaaaaaaaaaaaaaaa

SEQ ID NO: 14640 - DNA, 498 bp, Homo sapiens
gttgttttgttttggatggggaaggtagttttaatttggcaagtgttgctcttcttaaaacactgctcaaattaattagctgaagatacttagtatcctcggctgcttgttagcagagaaaggactcaccttagtggtgactggtttaaaaaatataaatatatatcatttgtacacgaagaactcttcccagtggaaactggctgtgtttccgtatttctatgttctattcggagtgatcgtgaaatctaaggctgcttgatgttctgatgcttgtcaatgccgtcgtgctctgtgactccacgaaacgccaaggagcttcttccggacgcctcctcttcctctgtaacatacgtgtgaatagtcaaggtttaattttgctttaatctaataaagtcgaagtgggacttttatttttctgaaacagctttctaaaatccgcatcttccccagctgcgaggttggggggctggggtgccaaagggcgaggttccgaaa

SEQ ID NO: 14641 - DNA, 397 bp, Homo sapiens
tagtagggttttttaaacttaaatttgtggttgttttttttcctgtagattatctctgcaaatcattttgtgcattgagaagtgctggtctaagagcttttgaatatttatgatacatctgtatgttatgtaaagcacaataaaatattcctctgagactgaatattacctatttagatacctatgctcatgaagtatcaaatttttaaatagatttttataagtcttaaggaaaagaaataggaggaaaccgaaatttcctgagcacctattttgccagtataagaacttgaatttaggccgggcgcggtggctcacgtgcggtggcactttgggaggctgaggtgggcggatcatgaggtcaggagattgagaccatcctggctaatatggcgaa

SEQ ID NO: 14642 - DNA, 424 bp, Homo sapiens
tgttggtagatagtaagtgctttatatattttatttcatttaatccttataacagcctacgaaataggtactattaataactcaattttaaaaataagaaaatggaagcatagaaaagtgaactcaggcttgtagtcccagcactttgggaggccgaggtcgggggatcacgagatcgggagttcgaggccagcctgaccgacatggtgaaaccttgtctctactaaaaacacaaaaaattggctggacgtggtggcacgcgcctgtagtcccagctacttgggaggctgaagcaggagattcgcttgaacccaggaggtggaggttgcagtaagccaagattgctccactgcactccagcctgggcgacagaacgagactctgtctcaattaaaaaaaaaaaaaaatttacccgggcktggtg

SEQ ID NO: 14643 - DNA, 157 bp, Homo sapiens
cttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgct

SEQ ID NO: 14644 - DNA, 217 bp, Homo sapiens
atacaaaaatcagacgggcacagtggtggtgcccacctgtgatcccagctactcaggagtctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcct

SEQ ID NO: 14645 - DNA, 501 bp, Homo sapiens
attaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggtacgtggcacaccaaggatggggggtgaggggactggctacatgggatgagtgttcttctggaagagccccaggagcacaggccactctgtgaccaatctgatgggggacgctgagtgtcatgagctcctgtaatggggcctgatcaacactgggaggttggcagaggtttccccagggaggggacatgggcgctgaggtctggagggtgaataggtgattcactagctgaagaggaaaaggttcaggtacggtggctcacgcctgtaatcccagcactttgggaggctgaggcggctggatcactggaggtcaagagttcgagaccgaaaccagc

SEQ ID NO: 14646 - DNA, 470 bp, Homo sapiens
agggacttccaggtttctcttcttgtactaaaaacagcacagaaagcacgattttctcacgcaaaactgagaaccatgcagtggggcaccacagtcttgattccatgaagatgaatagttaccatttggcgagcactatgtscagacagtgttccaactgtggtatatttatttaacccttaaaaacaatcccggccgggcgcggtggctcatgcctgtaatcccaacactttgggaggccgaggcgggcggatcaccaggtcaggagatccagaccatcctggctaacacggtgaaatcccgtctctactaaaaatacaaaaaattagccgggcatggtggcacgcgcccgtattcccagctactcgggaggctgaggcgggagaatcacttgaacccgggaggcggaggttgccgtgagccgggatcgcgccattgcactccagcctgggcgacctaggctccgtttc

SEQ ID NO: 14647 - DNA, 293 bp, Homo sapiens
aacctagccgctgggctgtgcggacaggttcgcgtggggstcctgggcctcccgcagccgcgtgatccgccagccttgacctcccaaagtgctgggattacaggcatgagscaccgcgcccggcctatagtcagttactgagaggggttgctgttgccacatggcgactgtggtcaccgtctctcctggacctgcctagatccaaaagccagccctggaagaacacctctcattctcaagaagaagttaatgtctgccttacagtagatgtccaataaatcttctttgaacaa

SEQ ID NO: 14648 - DNA, 298 bp, Homo sapiens
aaaagtgagccagaggagagctgakgagaggagggggaggcctacgacctgggccctgggctctgaaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggasccccttctgtcagctgtggggcttgacaccacttgaacaagaaaaggagggggaaactgcaccacatcagt

SEQ ID NO: 14649 - DNA, 322 bp, Homo sapiens
tttaaactgactgtgcttcagtttcctattttgcaatggggataataagaagagtgccattctcattcctagaatagatgaatttattaagacggaaagtagcatggtggttgccggggaccaggaggaggttagtgtttaatgaggagttaaaggaatggggagttcgtgtttaatgggtacagagtttcagtttgagaagatgaaaaagtgctgaaaatggatgacagtgacggctgctcaacagtggcagtatacttaatgccaccgaactgtttgcttaaagacagttaaagtgctgagttttattgctatgaatatt

SEQ ID NO: 14650 - DNA, 486 bp, Homo sapiens
ctctactaaaaatacaaaaactagctgggggtggtggcaggggcctgtaatcccagctactcgggaggctgatgcaggagaatcgcttgagcctgggaggcagaggttgcagtgagctgagattgagccactgcactccaacctgggcaacagagtgagactctgtcttgaaaaaaattaaaatccaaatgaaaccaattcctagtttccacttacggcatctaaggtggttgtacagaaactatcttatggatttgtgagtaaatttagtagactgcttctcttgaaatataggctgggcgtggtggctcgtgcctgtaatcccagcactttgggaagccaaggtgggcagatcacttgaggccaggagtttgagaccagcctagccaacatggtgaaacctgtctctactaaaaatataaaaattagctgggcgtggttgcgcatscctgtaatcccagctactccagaggctgaggcggaaga

SEQ ID NO: 14651 - DNA, 478 bp, Homo sapiens
gttattggtgatgctaatctaaacacatggagcatttgtgatatttctgataatatttcttgtatggagtgatggaagatttaagcttattttagtttatctttttaaaaactttccttcaattgtagttttgggaataaaactttatgtttttggacccatttctagctttttaaaaaattaaacctttgatcatttatcagaatttattttagggtaaaagtaactttttaccagaaagaacatgtaaatttctaagactgtgtcttagattaaaatgaagtaagaacatagcactttggtaagaattatttttcaaagggccaggcgcggtggctcatgcctataatgctcagcactttgggaggccggggcaggaggatcgtctgaggtcaggagttcaacaccagcctggccaacatagtgaaaccctgtctctattaaaaataaaaaaattagccaggcatgatggcactca

SEQ ID NO: 14652 - DNA, 447 bp, Homo sapiens
gatgagatgaaagaggtggagtttaaagcaagtgagatatgataaacaatgatgaaagcaaaaatagggcagttgaaccagagtcagccagttggcataactgccaataaatgaggcagtgtagaataactaataatgattggaatcaaggaaaagagagcatagaggaatcagctaaattagtatgttttatccatagttacatgactaacaaatgattaaaaagaagttattctctagataattttttaaataaaagtactgttaatatataaactaagttattcattcactgtttttcttcacagtaagaatgacaaaaatctgtgttctttgtacttatcaagtgactcaaattttggccacttcactgtcactgatggcttatagaatgactctagcagtactcaagttattgaactatcaaatgggtttttaattgatatt

SEQ ID NO: 14653 - DNA, 438 bp, Homo sapiens
  misc_feature 389: n=a, g, c or t
gggtgcgtggtcgtgcggcaagtgagcgatttggtgaacagacactcccttctgtaggtaagaatatctcggggggcgaattaattgaagaagcaccgtcatcccttggtcttagcagtgtcgcctctctcttcccgggtttggagagctgggggcgggttcctggctctgcgggcctgggctacactctgagccgcgtgaggagctctccccctacgccgcagcccgcgtgctgggattcacccaagtgggtttgtctggaattcccatttgcagccttctggaagcgcagattaaataaaatcatgattcccgtaaagtgccagcacctcctatggttacatcccacgttcacvgattttaactgaaaaggcattttagcatagaantccaaattccaatccaaggatggagaaaaggtccttcctagtgggaaaa

SEQ ID NO: 14654 - DNA, 388 bp, Homo sapiens
tcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaaaaaaaaaaaraaraagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgctaatctgtatgttgacaccttgtaattaaaatacgtaccatgaaaaaaaaaaaaaaaa

SEQ ID NO: 14655 - DNA, 79 bp, Homo sapiens
  misc_feature 76: n=a, g, c or t
acccgggtgagaggttcccgcggctcagggaagatggcggcasgtggtgctggctgctgggttgcgcgcggcgagnagc

SEQ ID NO: 14656 - DNA, 482 bp, Homo sapiens
  misc_feature 19,192,196,413: n=a, g, c or t
aagcccagcagcggcgcgnccgcgagcccctggaggaagacgaggaaggggacgatgagtttgacgatgaggccccggagagctgactttcgccagcgcccaggcggaagcgagagaagaggagcggcgagtgcgggagaccgtgcgcagggataaaacgctcctgaaggagaagaggaagcgacgcrggantgtntcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagagagttaaagtacaaaaagtacagtctgtcagccagaataaaagctacttggccgtaastanaaagaccaagatctgagagattcaaggcaacaagcagcacaagccttcatacataattcattatatggg

SEQ ID NO: 14657 - DNA, 508 bp, Homo sapiens
  misc_feature 424: n=a, g, c or t
cttatatgcctggagcctattcccaggtaactgcctttttttttttaataaaaagctttattaaaaataatttttgaataataaatacatttgtaggaaattactaccttgaattttgttttaaatagtagacacccctttatcttctcctagatttacttgttaaccattttgtcacatttgctttctccctgtatccatattcttcagaattttttcctagttttaaactctagcttgtgtgattttaatactgcttctcctgttccctctttttttgaattacctgatatttcttatgtttgttgtgtatgtctcttgaaaatggcagatttctgtattttaatgctttacctaattggatagtttttaagataatagcacttatattgatttgattttcccttctttaccgatttatttnacatttttatttsctctgtttcttactgtkgcttattatcaacttgtgattcattcccttaccccgcctcccagttaatgtgga

SEQ ID NO: 14658 - DNA, 329 bp, Homo sapiens
tactcatttcttataagaagtaaagatatattggccgggtgcggtggctcgcgcctataatcccagcactttgggaggctgaggcaggcggatcacaatgtcaagagattgagaccatcctggctaacacggtgaaacctatcgctactaaaaatacaaaaaataagacgggcgtggtggcgggcacctgtagtcccagctattcaggaggctgaggtaggaggacaccgtgaacttgggaggcagagcttgcagtgagccgagatcatgtcactgcactccaacctgggctgcagagtgagactccgtcccaaaaaaaaaaaaaaaaa

SEQ ID NO: 14659 - DNA, 398 bp, Homo sapiens
gagaataggtttggtggtccgagatccgaggcaacggtggctcctcgaggtccacggtcccggagatgggatttcgccatgttgcccaggctgatcttgaactcctgggctgaagatatccaccctcctcggcctcccaatgtgctgggattacaggcctgagccaccatgcctggcccaagtgttcattgatgatgagagatgggcttttcgcatcaaatcacaaaaatatgctgagtaatgtgaggattcttgcttttctggaagctaacacatagtcagtgccaaagtagtgacagaagtggattgagaggaaagagagaggccaagacaatttgtaactagaatccgtttttcccttttcctttttttaaacaaacaaacatacaaaaaaaaaa

SEQ ID NO: 14660 - DNA, 116 bp, Homo sapiens
taatttttttgattccaagttttggtcttgtaaccactataactctctgtgarcatttttccaggtggctggaagaaggaagaaaacctgatatagccaatgctgttgtagtcgtt

SEQ ID NO: 14661 - DNA, 274 bp, Homo sapiens
  misc_feature 209: n=a, g, c or t
tattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaastgatctgctttcattrnctggaattctgtaggagatactggtgacctaagctaagttgcactcagcatactcagtgtcaagc

SEQ ID NO: 14662 - DNA, 497 bp, Homo sapiens
ttacatttctgagtttccatggcagagttgtgagtggggctgtgatataatttaacttctcctaaattgctgacaccgataaccctataaattaacagatggcggagggaaatctcctggcttcttcctggctagttttttttaatggtctgatttttgtaataggggttttgagtcccagccaggtatccctccacgggcagcggtgagagcttgtcccatttcatcgtctccgatgctggctgcgtggatttcacttcaatgaggatggagtgtcaagaaaactgttcacgtccctgctgagcgcgggcacctttgcagaagctgacgggtgggggccccagggtgcggcgcttggcggggctggtgagcagcttccagcggcacctgttggcgggattgcagtctgatgagcgtgcccagctgggtgcagggttccctgcaggttccttggttccctgcaggcccaggctgatgggccaggctctctgtttcca

SEQ ID NO: 14663 - DNA, 484 bp, Homo sapiens
tattattgagatagggtctggctctgcagcccaggctggagtgtagtggcgcgatctcggctcactgcagcctctgcctcccagtctcgagcggtcctcctgcctcggccccccgggtggctggaactacaggcatgtgctaccatgcccagctaattcctttgtatttttggtagagatgggatttcactatgttgtccaggctggtctcgaactcctgagctcaagtgatctgcctgcctcggcctcccaaagtgctgggattacaggcgtgascaccgtgcccagcccaaggtggtattattatcaatcccactgaacatatgaggaaactgaggctgctgagggtaggtgatttgcctgcagttatacaacttgtaccttgcgtgggagtcacttccttcttctcactctgcctgtytgtccaccatctaggggaccatcttcctgtggatcttctggcctagcttcaatgctgcactca

SEQ ID NO: 14664 - DNA, 461 bp, Homo sapiens
aaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggacaatttattcatcagcttc

SEQ ID NO: 14665 - DNA, 481 bp, Homo sapiens
acattgttttgttttttgagtacttccttactttctggcactagaagaagttccagactcatcttgtatatttcctgccccagccctagaatcagccatttttccaaggatccctggttctattttttggtgaatcatgttagaaaccaagatctggttactcagtgtgctcattgctgttggaatatcatgacttctaggccttttcagtgtatagacctggaaaatatatgtatgtatacacatatataactattatctgtatctatattgaggtaaacatgagttcatactgatgactttgactatcagtactatatagttcattctggctttactctgctatctattacctccctctccaaaagtgagaaatctggctcacgccatctgacatctattaacttatttgttcagtcccatcgtccatgtacagcacttttagaattgttaacctgtatctccatgagaaatgccttta

SEQ ID NO: 14666 - DNA, 126 bp, Homo sapiens
rgccgggagcggtggctcacgcccttaatcccagctctcagggaggctaagaggcgggaggatagcttgagcccaggagttcgagacctgcctgggcaatatagcgagaccccgttctccagaaaa

SEQ ID NO: 14667 - DNA, 442 bp, Homo sapiens
gttagtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtggttgaataaagaaacagaaaaaatagaacatactgaaaataatctaagttccaaccatagaagaagctgcagagaaatgaagaagtgatgatgatttagattttgatattgatttagaa

SEQ ID NO: 14668 - DNA, 90 bp, Homo sapiens
acatttgagtcagtggactgagtaaggaagatccccctcagtgtgagcaccatccaattggctgaggatagaacaaaaaaaaaaaaaaaa

SEQ ID NO: 14669 - DNA, 425 bp, Homo sapiens
ctttttccttttagtagctaaaatgctgaaaggcaatcctaaaggaagaaacaaaaatgtggtatactcactagctaacatcagatgttgaactactaagctctaactgaagcagcagcatacgttgacggctgcatctgaatcgtccaaatgtctttggttgstttgatcagtttgtacagtccatgggacagacacattagctggcttaccaactaacaggcagcaggaccatatgttctgaactaaaaaccaactatgtaatctggcagtggaggagtttgtgtctcaatctgagtttttgtcctatgacaaatggaatgcagtatgaaactatactattacattgcaaatttgataaatgacatggaatgagaaattcccctggaaaacttggatttgagatttttcataaaaatatgttc

SEQ ID NO: 14670 - DNA, 448 bp, Homo sapiens
ggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaagggtctgtctttaaaccacctaatagaggaatttaaaagtgaaggttgcagttgctagattttgccttggctaccttcagattcccacaatacttgtacataatgaactgtgcatgcttttacattctctaagggcttaacttcttaggcactgtaagactataagahcgca

SEQ ID NO: 14671 - DNA, 172 bp, Homo sapiens
gcaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaa

SEQ ID NO: 14672 - DNA, 308 bp, Homo sapiens
atttttttcctctggtttttagtaaatgttttttttgagattgcttagcaccagaatgatttgcaaatttgaaaataggaactccactaggaatgccggatagaagagtgcttcacatttgtagagggagacaagaactaaatatcacgacgtctttctgagccttttggtttgctaacgtgccccaaattcttattccaaacggtataggataattatgtgtaaatgaataccagctctacttagttttatttcatatttgtgtatctgaatatattaaaatatcttttttttttttggagggggag

SEQ ID NO: 14673 - DNA, 387 bp, Homo sapiens
  misc_feature 232..234: n=a, g, c or t
gcggggtgtcgtttcctttcgctgatgcaagagcctagtgcggtggtgggagaggtatcggcaggggcagcgctggcgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatvnnnvacagaggaaacccagccttcagaaacaaaagaagtggagccagagccaactgaggacaaggatttggaagctgatgaagaggacactaggaaaaaagatgcttctgatgatctagatgacttgaacttctttaatcaaaaaaaaaaaaaaaa

SEQ ID NO: 14674 - DNA, 464 bp, Homo sapiens
ttggaaggaccagaaaactggtaagtgtgacccagatcaagtgtgaggagatgaggctggggatagtcaggggctggatcacccagggccttgtgggcccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggtttgcagtgagctcagattgcgtcactgcactccaacctgggtga

SEQ ID NO: 14675 - DNA, 491 bp, Homo sapiens
cttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagctttta

SEQ ID NO: 14676 - DNA, 275 bp, Homo sapiens
aaattacatgagtaacaaagtgtctctaacttatatatattttgaactctgaaccctgaaaatagagacaacccttccaagtacctagggacattcataaaaattgacaaaattcttttctaaattacaaactccataagaaaattttaaaaaacagaaactatactgacaatattctctataatacaacaagacaaaaatgaacaagcaaataaaaaactaaaaactccaacatcttgtaaattacaacagctttttttcttagcccagtcttg

SEQ ID NO: 14677 - DNA, 111 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14678 - DNA, 472 bp, Homo sapiens
ctttgctgtataatgaacaatcctaaacatcaatggcttaaaacaaaatcacttattagcacataatttggtaggttcatattttgggctggccgcagtaggttttgcagatttcacctggtcttgtcattttgctgcagtcggctggcattttgaccagggctggaggactatccatgtgtgacaggaagctggttggctggggtgcctagtttcttcttggttctcttccatgtgggcttgggcttggtcaaatggtcttgggtttctctatgcaggaagagaggacagccccaattaacaagtagttttaacgttttggcttttgtcatgttcactgatgtccttttggccaaaggaagtcacatggccaagtccagagtcgtcatagaacgggataacataagggagtagatacagggagacatgatttattggtcccaatgattcataccccttaccatgtgcaaga

SEQ ID NO: 14679 - DNA, 168 bp, Homo sapiens
tacataaaaaagacatttcagattaacactaatgttacacctcaaggaactggaaaaacaagaacaaacaaaacccaaagctagcagaaaagagatcagaactgaatgaaattgagaccaaacatgcacgcgtgtgcgcgcgcacacacacacacacacacacacacg

SEQ ID NO: 14680 - DNA, 61 bp, Homo sapiens
aaaaaaaaaaaaaaaaaaaaaaaaaaaaaaaaaaaaaaaaaaaaaaaaaaaaaaaaaaaaa

SEQ ID NO: 14681 - DNA, 61 bp, Homo sapiens; identical to SEQ ID NO: 14680

SEQ ID NO: 14682 - DNA, 59 bp, Homo sapiens
ataggtgttcttcaagatgactaatgtcaaaaattgagacatctgttgcggttcttttt

SEQ ID NO: 14683 - DNA, 419 bp, Homo sapiens
tcgcagtggcaaagacttggagtcggcccaggtgtccatcaatgatagactggattaagaaagggtggcgcatatacaccatggagtactttgcagccataaaaaaggatgagttaatgtccattgcagggacatggatgaagctggaggccatcgttctcggcaaactatcacaggatcagagaaccatctgcatgttctcactcataggtgggaggtgaacaatgagagcacatggacacgggaagggaaacatcacacaccagaacgtgtcgcgggggtaggggggtgggggaggaataacattaggagaaatacctaatgcaggtgatgggttgatgggttcagcaaaccaccagggcacgtgtacatctatgtaacaaaactgcacgtttctgcacatgtaacccagaactgaa

SEQ ID NO: 14684 - DNA, 448 bp, Homo sapiens
ccatagtgaaaagtttcttatattcactgaccaaagttgattcgtcattataattactgtttagcgcttttgtttgtttgtttttgagacggggtctcgctctgtcacccagcctggagtgcagtggcccgacctcggctcgctgcaacctccacgttctgggttcaggtgattcttgtgcctcggcctcccacatagctgcgattacaggcatgcacctccccgcccagctaattttgtatttttgatagagaccagtttttgccatgttggccaggctattttggtttgttttttgagatggagtctgttgcccaggttggagtacagtggtaccatctcggcttgctgcaacctccgcctcccaggttcaagcgactctcctgcctcagcctccggagtagcttggattacaggcacctaccaccacacccagctgattttgtat

SEQ ID NO: 14685 - DNA, 320 bp, Homo sapiens
  misc_feature 35: n=a, g, c or t
acactttcgcacacacaaacacgctaggacgctcntwcttcgctactgcatccccgaaccagcagagcgaaskactgcggggttctgttaacctcagcatcgtggggcgavrgagccattgtgcatcaaggagaggccggtgcctgcgctgccgtctctggcacctaacccagcagaccgctcaccccatcggctggaatgcttgctgattcctctgcacacttctaaggctgagaacctgaggacccagctggaaaatgccgtctgaacgctgccctcaggtatcccctgtagggatatgtcctcacatgccgtagtga

SEQ ID NO: 14686 - DNA, 399 bp, Homo sapiens
ctctaataccttttctgtttgtagtttttgttactctttcacattgtggtcatttctgttgttttctttttatttttaaatttgtctgtatccgttttacttctcacatctctttcttttgataagggtagtgccttggattcagcagaagctccagctgggagatccaggaaccattaataaacctcagagagatgctaagaatagagaacaagaacagaagcaaggggtgtgctaggcgtcaagggtgaaattacttgtgacttcgttttgtactcttagtaggtccttagttcactgcctctgactttttttatattgttggcttagattgcattcgaagacatattttgactgattatagcagcatataacatgctgaattaatcacttgctttt

SEQ ID NO: 14687 - DNA, 314 bp, Homo sapiens
ataatggcctccagttccatccaagttgtggcaaaatatattattcttttttttatggttgagtagtattccatggtatgtatataccacatgttatttatccaataattggttagtgggcccttaggttgattccatatctttgcaattgtgaattgtgctgtgataaacatacacatacaggtgtctttttgatatagtgatttcttttcctttgggtagatactcagaggaaaagaagtcattgtctgaaaaagacacttgcacatgcatgtttatagcagcacaattcacaattgcaaaaatatagaact

SEQ ID NO: 14688 - DNA, 97 bp, Homo sapiens
ataatggcctccagttccatccaagttgtggcaaaatatattattcttttttttatggttgagtagtattccatggtatgtatataccacatgttat

SEQ ID NO: 14689 - DNA, 92 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14690 - DNA, 340 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaacccatctctactaaaaatacaaaaaaaaaattagctgagcatggtggcgggcgcctgtagtcccagctacttgggaggctgaggcaggagaatgacgtgaacctgggaggcggasttgcagtgagccgagatctctccactgcactccagcctgggcgacagagcgagactccatctcaa

SEQ ID NO: 14691 - DNA, 157 bp, Homo sapiens
tcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttcgatcc

SEQ ID NO: 14692 - DNA, 444 bp, Homo sapiens
atgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatscattgtcactgattcaccaagtggatgttgcatt

SEQ ID NO: 14693 - DNA, 77 bp, Homo sapiens
  misc_feature 62: n=a, g, c or t
aaaccctcagggacctggtatagacgcagaatctgtttcacacaacaactgctatttgaagnaaaaaaaaaaaaaga

SEQ ID NO: 14694 - DNA, 75 bp, Homo sapiens
ataggtgttcttcaagatgactaatgtcaaaaattgagacatctgttgcggttctttttttttttttttttcccc

SEQ ID NO: 14695 - DNA, 406 bp, Homo sapiens
  misc_feature 198: n=a, g, c or t
tacaggcatgagcaccgtgcctggccagaaggtttttttaatatttaattgaacagggagatcatcgcctctcctccaggaacgcaactagaggaaaggacttgccttgcagcaagagagacctcagcgagccgggaagaggctcctccccacagaactgggcaccacccagmactrcccaccacaccaccgcgccanctcctcacctgcagcttgtggactttgtcattgagctccgcscgggcccgctcccsatcgctgcacttggactgcagctcctgcacctgcgsctccagcttcttcttsttatgttccacctcctgcttggcctggcccaggacccgcagctccccggccaggtctgsgttctctttctccagcgtctgcttattcttgtctaggttcg

SEQ ID NO: 14696 - DNA, 79 bp, Homo sapiens
caaagctctgtagcacagagaatgtggtgtcacagatacatcgccgagagaggtttctttctttctttttttttttttt

SEQ ID NO: 14697 - DNA, 368 bp, Homo sapiens
  misc_feature 319,324,329,333: n=a, g, c or t
ttattgtaatgatatttaaacattaattccagatcattgtcatcttcattgtatatgtcttaccaatttttgaaagttaaagcatatatatacacacacatatattatacacaacacatacatacacacacrcacacacacacasacamatatagtytcttacatttgctatacttattwtgagttgagtacataacaaggcaaggcagagagtgagtgtgtwtatgttttmagatttatttgatccmaccacttgaaaaaaatgtgaatttgttaccaaaacacmaagcgtktggtctaggtcctgmtgcttgccacncaganagccngtcnctgagacaatgagttttgtcagmagaaaggmttta

SEQ ID NO: 14698 - DNA, 73 bp, Homo sapiens
gaaaagaaataaaatgcctatgttgttgttctagaaaaaaaaaaaaaaaaaaaaaaaaaaaaaaaaaaaaaaa

SEQ ID NO: 14699 - DNA, 365 bp, Homo sapiens
aatttattttagaaaataaggcaaaccggctgggcgcggtggttcatgcttgtaatcccagcactttgagaggccgaggcgggcggatcgcttgagctcaggagttcgagaccagcctgggcaacacagcgaaacctcgtctctactaaaaatacaaaaattagccaagtggcgcgcgcctgttgtcccagctgctcgggaagctgaggcgggagaatcgcttgtattcaggaggcggaaattgcggtgagccgagatcgcgtcactgcactccagcctgggtgacacagtgagatcctgtctcaaaaaagaaaaaaaaaaaaaaaaaaaaaaaaaaaaaaaaaaaaaaaaaaaaaaaaaaaaaa

SEQ ID NO: 14700 - DNA, 288 bp, Homo sapiens
tctggccgggtgcggtggctcacgcctgtaatcccagsactttggggggctgaggcgggtggatcacgaggtcaggagattgagaccatcctggctaacacggtgaaacctgtctctactagaaatacaaaaaattagccaggtgtggtggcgggcacctgtagtcccatctactcgggaggctgaggcaggagaatggcgtgaatccgggaggaggagcttgcagtgagccaagatagcgccactgcactccagcctgggcaaaaaagcgaaactccgtctcaaaaa

SEQ ID NO: 14701 - DNA, 124 bp, Homo sapiens
ctgattctaggctggtcactactccgagcctgtgacgtttgcggcagscaggccgtcgacgatgcccagtgaaactctctgggaaattgcaaaagctgaagtggaaaaaaaaaaaaaaaaaagc

SEQ ID NO: 14702 - DNA, 357 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggasttgcagtgagccgagatctctccactgmactccagcctgggcgacagagcgagactccatctcaaaaaaaaaaaaaaaaag

SEQ ID NO: 14703 - DNA, 60 bp, Homo sapiens
agagcattacggtgaggaccagtggsggccggtaccctggtccctgcaccggagcggggt

SEQ ID NO: 14704 - DNA, 195 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgcagtgagccaggatcgcgccactgcactccagcctgggcgacagagcgagactccgtctcaaaaaaaaaaaaaaaaa

SEQ ID NO: 14705 - DNA, 74 bp, Homo sapiens
aaaccctcagggacctggtatagacgcagaatctgtttcacacaacaactgctatttgaaggaaaaaaaaaaaa

SEQ ID NO: 14706 - DNA, 293 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctscagaggctgaggcaggaaaattgcttgaacccaggaagcggaagttgcagtgagctgagatctcgccactgtgctccagcctgggcgacagggagactccctctcaaaaaa

SEQ ID NO: 14707 - DNA, 470 bp, Homo sapiens
catactattcaagaccaaggtagcagaaaagttacttgtatctgcttatcataagacgaaactctgcaacttggcaacggtggccagttttcgtaatgaaacagtctttagtaatttaatcttcatgcttcataacaaaccaaaaccccatgagatttccacattgcataattttgccttactaacagaatcatatccttaaggatgaccatcattcccccaactaaaacaaatacaaactaatgtatgatatttttttaagtgccagatcaatatggtctaaagcttcaataaggattgtgtgtaggtgaataaagacagctaagtgaatgtgtgtaaagtgtagcaaaagcagacagatatttatgtacagtattcatagaatggaaagttaaatatttttgcagtgtgtatttaaaagagaaactcaccataatagtgccgtctaaaaatctttgtaaagttattta

SEQ ID NO: 14708 - DNA, 345 bp, Homo sapiens
tatctttcgactttcaggaaattttatttggactgtcataactttaagttttgttttggttatttattgttgcttaaccaattatcccaaaacttaatggcctaaaactacacatctgtctatctgtcacgactgtatggattacctggggctagctggacagtttttctgctggtctcatttggcagctctcactgtgtggttaaacagtgtcagggactggtcatctggatgctcagctgcagtggaatgtctgagacggcttctttacccacaggtctgctgccttggtaattcttgatgtggsctttctstctgcatagcatctcatcctctcggatctct

SEQ ID NO: 14709 - DNA, 509 bp, Homo sapiens
ctgggcccgcggggaggaggcggggctgcgggggagagcgactgcgccaggtccgcgacaaatgaattagacacaattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggccccttctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagaggtgagctggagctgaggggtgggcgcgcagctaacaggaacgtcacctctggagagtctgag

SEQ ID NO: 14710 - DNA, 449 bp, Homo sapiens
tttttgtgtgtgtgtgtgcagaaagttgtttcagttggcctggcttctataatgttttactctctaaataacttctttatctttttcatgtataaacattacccagatgacatgacctttaccagctgttgatgtgaaataatatattatcactggttgatgtgaaataatatattatcactggtatcataagtatttcacagttaagggtagtgacatacactgtcgtagctcctttggaagagaccccaattgaacttctattggagtacaagaaattgttatttaaacctaccccattgtctgtggttggggaaaattcataacagtaagctaagtggtcattaatagggctgagttaaaatggtgtatcggatatatggtccaggaaaggaagtataggaagaaaagttgacctgatggtggccttgaagttcatgctgaggcta

SEQ ID NO: 14711 - DNA, 370 bp, Homo sapiens
ttgcatgtaggtgaaaatgacttatgacttattttatgttttcatttggggcttcttaataccgtctcttgattccctttcatcatctttttctaaaaccagccaaccacttgtcttatatgtagatatccagaactcccaattcctataagtgagtaagctacagcagggcaggatccacacaggttcctgcccctctagaagctgacgttcttgtaacctagtttggttccaagaaccacagggaggtgagaaaattattcactggataccagtgagctctaatcctaacacagatactcataactttgttgccttaaaaaaattatttaactgagtgggtgcagtggctcacgcctgtaatctcagc

SEQ ID NO: 14712 - DNA, 59 bp, Homo sapiens
ttctggaaaaagtaataataaatatagctacttaaaaaaaaaaaaaaaaaaaaaaaaaa

SEQ ID NO: 14713 - DNA, 216 bp, Homo sapiens
agttctagaccagcctggctaacatggcgaaacaccgtctctactaaaaatacgaaaattaggcgtggtggcaaatgcctgtaatcccagctccttgggaggctgaggcacgagaattgcttgaacccgggagccggagttgccgtgagccgagatcgcgccgtcgcattccaatatgcgcgacagagcgagactccatcgcaaaaaaaaaaaaaa

SEQ ID NO: 14714 - DNA, 217 bp, Homo sapiens
ttttttgtttgtctgttttgagacagggccttactgtgtcgcttaggctggatggggtgcagtggtgcagtcacagctcacacagctctgtctcctggacttaagcagtcctcctgccttagcctcccaagtagctgggactacaggtgcatgccaccacacccagtgagtttttctttttaaaaaaaaattttatttgtttattttttgagacgga

SEQ ID NO: 14715 - DNA, 50 bp, Homo sapiens
aaaaaaaaaaaaaaaaaaaaaaaaaaaaaaaaaaaaaaaaaaaaaaaaaa

SEQ ID NO: 14716 - DNA, 95 bp, Homo sapiens
aataagataaatttttaaaaaagagaagtgccatactgttttccaaagagtctgtaccattttccacttaccagcattatatgagagttccagtt

SEQ ID NO: 14717 - DNA, 80 bp, Homo sapiens
acatttgagtcagtggactgagtaaggaagatccccctcagtgtgagcaccatccaattggctgaggatagaacaaaaaa

SEQ ID NO: 14718 - DNA, 406 bp, Homo sapiens
  misc_feature 393: n=a, g, c or t
aataaataaataaattaggggaaaaaaaacccaaagtctcaatgtttatctgttaataacagtattcggatacttatgtggatacttcttttaaaaaaaaaaaaargwttatctgtatgaaaagtttcttttcctaaaaacgatttctcctagaaccatcaatctatatgattcaaaaagccaccaaaggtgttaattttgttaattatctagaaagttgtgatggttttgagggtgtatacatatgtcacagcttattaaattgtacattttaaatatatgcacttactatatatcaataaaacttttaaaaaagccaaccagwttgtaaggtatattttcaggataaratmcttattatctttgggaggtcgaggcaggcagwtcacctgnggtcaggagttcg

SEQ ID NO: 14719 - DNA, 274 bp, Homo sapiens
aaagaagaattggcccttgaccagcctgattggttgcaggaggggaccaatcagaggtacctcccatttttcatctgcagcccaatgcaaagtaatgacatggatctggagagattctcttaggagagaatctggctaagtgtctagcaggatgattgattaacaagatgttttgttttcatcatctcagagataagtacaactattctgtcatctaatctgctaactcctacattatcaatacggtagtaataaattatgaataaacataaaa

SEQ ID NO: 14720 - DNA, 492 bp, Homo sapiens
tgttctctccttgctgttttgcatttatgttcatttaactggtgggatttcttcccaagatcttcataaggctgatcccttctttgtattctagtctaggtcaaatgttacattcttagagaggaaatcctccattgccctaggaaaaagtagcctccaacacactctatctggattttttgtctacttgtttattatttttccgtcttcctagcagaatatgaagctgcaagggggtagggaccttgttaatatcattcacaggcatctagaataataatctcttattttcatttcaatgtatatttagtgactgaatggagtcttttaagagccaaatagtacttgtctcaccagtttgttttgaagattaaaagagaaactgtatgtaaagcagcagagtccagagcttagcacacgaaagctgttgagcatctatacttagtatttcttagtatttttgtaccattttcacaaamattttcctataca

SEQ ID NO: 14721 - DNA, 433 bp, Homo sapiens
  misc_feature 391: n=a, g, c or t
gacaaggcttcagtaattagcaaacttactctcagcctgacccatagtttccggagttaccctggaattttccgagcgccctacttacctgtagagcttgaagtgaaaacgtactcgggcgtcctttgtcagtcatcctccactttccactctctggcattccttcactggattatttgtagagattaccgggagcccggcgttgggcaccagagaccagcctgggcaactgagggagaccccatttctacgaaaaaaaaaaaaaaaawttaggcaggcgtggtttcmagtgcstkwaayccsagctactccatgagagattggacaaaacstgggaccagagactgattttcttctaaaatgctttctccaaaatatttttaaaagaaangggggcatttggaaaggaaattgttttgagccccccagttca

SEQ ID NO: 14722 - DNA, 135 bp, Homo sapiens
catttcagtagtgttaagtacattcggctgggtgcggtggttcacgcctgtaatcccagcactttgggaggccgaggtgggcagatcacaaggtcaggagatctagaccctcctaggccaacacagtgacacccc

SEQ ID NO: 14723 - DNA, 420 bp, Homo sapiens
agtgacggaggcgaggtccagaatggagcggactggccatgtttgttttttttttaattttatttttttaatgacggtgtcttgctctgtcaccgaggctggaccgcagtggcgcaatcgtagcccactgcagccttgaactcctgggctcaagctatcctcttgcctcagcctcctgcttagctggagctacaggcatacaccaccgcacccaactattttaatttatgtagagacggggtcttgstttgttgcccaggctggtctgaactcttgggctcagagaatcctcctgccttggcttcccaaagtgctgggattataggtgtragtcacctcactaggccaggaccgggcatctagatatagggtgtggtgggctgtttgtaaaggacgtgaatggggacggacgtgggtggg

SEQ ID NO: 14724 - DNA, 94 bp, Homo sapiens
ctgattactaatgatgtagcgcatctttccatatgcttattggccatttctgtatcttctttggataaaagtctattctgatcctctacccttt

SEQ ID NO: 14725 - DNA, 483 bp, Homo sapiens
agggggacctgctgctggaagagcagcggcccgagccggggccatggcgamstgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgccctccgaggcattggccgctggaccaacccccagtaccggcagttcatcaccatcttggaagcaacacatcggaaccagtcttcagaaaaacaagaggcagcttg

SEQ ID NO: 14726 - DNA, 465 bp, Homo sapiens
tttccagaagacctcttacaaaacatcccttcaaaaatgttctgtaatttttgctaattagaccagctgacagtgagcttaggtgtttgaaagcttggtgctgccatctatccgctgatgatgcagatgagaatgccaaatgaggtagtaactgggaaacactttttttgtgtgtgtatgctgaagaaataccaagtagtattaattttagtttctttagttaagggaagagcatgaaaaattcgatatttatataactagtatattatattcctcattgtctcccacaccatactgttagggatggaaatttcccattggcctgtaccatttggctgcagatgtcaagaaagttcaaaaaagtcttactaatagttattgagcatctaccatatgtctagagggtggggataaaatgttaaaaagataatgaagtggctgttctcggggagctcaatatataca

SEQ ID NO: 14727 - DNA, 448 bp, Homo sapiens
cgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtg

SEQ ID NO: 14728 - DNA, 217 bp, Homo sapiens; identical to SEQ ID NO: 14714

SEQ ID NO: 14729 - DNA, 73 bp, Homo sapiens
aaaaaaaaaaaaaaaaaaaaaaaaaaaaaaaaaaaaaaaaaaaaaaaaaaaaaaaaaaaaaaaaaaaamaaaa

SEQ ID NO: 14730 - DNA, 407 bp, Homo sapiens
attataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaacaaaaaaaaaaaaaaaaa

SEQ ID NO: 14731 - DNA, 184 bp, Homo sapiens
ttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaaaaaaaaaaaaaaaaaaaaa

SEQ ID NO: 14732 - DNA, 433 bp, Homo sapiens
aaaaataattagttagaaatgacactatgcaatattaaataattatagtcaatttaggcatgaattatatgcaataaagtagaataaaatgcagatataactattgtgtacttctagtgttaacttctaattctccctgattaagttatgtcaaaatgctgagccaggcatagctgaaggaaatagctttgttatgttcccagttagatcatcttctttcattttctggctcttcattgtacacaaatatgatcttcttttccattcaaacctacttcccacttattacaccatagaattgtgatttagtagctctgagatgtggtcccaggagggaaggaaaaagtagtttctgaatgttctgatttctctatttctcattccattggttggttttggccaggagtcagcaaatactgcttatgggcaaaat

SEQ ID NO: 14733 - DNA, 304 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaaaaa

SEQ ID NO: 14734 - DNA, 437 bp, Homo sapiens
tcgcagtggcaaagacttggagtcggcccaggtgtccatcaatgatagactggattaagaaagggtggcgcatatacaccatggagtactttgcagccataaaaaaggatgagttaatgtccattgcagggacatggatgaagctggaggccatcgttctcggcaaactatcacaggatcagagaaccatctgcatgttctcactcataggtgggaggtgaacaatgagagcacatggacacgggaagggaaacatcacacaccagaacgtgtcgcgggggtaggggggtgggggaggaataacattaggagaaatacctaatgcaggtgatgggttgatgggttcagcaaaccaccagggcacgtgtacatctatgtaacaaaactgcacgttctgcacatgtaacccagaactgaaagtataattaaacaaacaa

SEQ ID NO: 14735 - DNA, 461 bp, Homo sapiens
tacaatatggagagaagtggtgtattttgaaaacatttggggccgggcgcggtagctcacgcctgtaatcccagcactttaggagactgaggggggcgaatcacgaggtcaggagtttgagaccagcctgaccaacatggtgaaaccctgtctctactaaaaaaaatacaaaaattaaccaggcgtggcacctgtagtcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgcagtgagcagagatcgtgccactgcactccagtctaaatgacagagtgagaccctatctcaaaaaa

SEQ ID NO: 14736 - DNA, 474 bp, Homo sapiens
tctttttatttctggactctcagtcctctcactggtcatcaactgctttgggcgggagggtgtcaaaggcctgtaagttgggtgcctcctgtcctcaggaaacttcctaatcaatgcacttatcccactggctcccagctgacaaggaacagcacttccattcctgagaaatccttagaaacccaaggacagacagggctggggcccaacttaatcataaggttcttacaggaagaaggcaggagggtcagagttggggaggacacgtgaggacagaaacaggctggagcgacgggctttgaagacgaggaagaggccacaagccaaggaatatgggcagcccctagaagctgagaaagaaaaggaaatggcttctcctctagagcctccagaaggaacacggccaagccagcaccttgattttagccttgtgagacccactttgcacttctggcctccagaaatggaagatca

SEQ ID NO: 14737 - DNA, 148 bp, Homo sapiens
ggccgggagcggtggctcacgcccttaatcccagctctcagggaggctaagaggcgggaggatagcttgagcccaggagttcgagacctgcctgggcaatatagcgagaccccgttctccagaaaaaggaaaaaaaaaaaaaaaaaag

SEQ ID NO: 14738 - DNA, 411 bp, Homo sapiens
tacataaaaaagacatttcagattaacactaatgttacacctcaaggaactggaaaaacaagaacaaacaaaacccaaagctagcagaaaagagatcagaactgaatgaaattgagaccaaacatgcacgcgtgtgcgcgcgcacacacacacacacacacacacacgvtkcaatgaaatgaaaagttgattcttggcaragacaaacaaaattggtaggcamacaaragragagagaggattcaaataagcacaatcagaaactataaagatctgattttatctttaaaatcaggtaaatttaaacttaggggtgcagtggctcaagcatgtaatcccagcactttgggaggctgaggcaggcggatcgcttgaacccaggagtttgagaccagcctgggcaacatagca

SEQ ID NO: 14739 - DNA, 517 bp, Homo sapiens
ttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtggctcgagcctgtagtcccagcactttgggaggccaggcaggaggattgcttgaggccgggagtttgagaccagcctgggcaacatggtaagacctcatctctacaaaaaataaaaaattatccaggtgtgggccgacagtcccagctactagggaggctagggcagggtgatttgaattgagcccagtagtttgaggcttgccagtgagttatgattgcgccactacac

SEQ ID NO: 14740 - DNA, 308 bp, Homo sapiens
taagaagatgtttggctgggcgtggtggctcacgcctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtgccaaaaaaa

SEQ ID NO: 14741 - DNA, 85 bp, Homo sapiens
ttctggaaaaagtaataataaatatagctacttaaaaaaaaaaaaaaaaaaaaaaaaaaaaaaaaaaaaaaaaaaaaaaaaaaaa

SEQ ID NO: 14742 - DNA, 60 bp, Homo sapiens; identical to SEQ ID NO: 12480

SEQ ID NO: 14743 - DNA, 65 bp, Homo sapiens
aaaaaaaaaaaaaaaaaaaaaaaaaaaaaaaaaaaaaaaaaaaaaaaaaaaaaaaaaaaaaaaaa

SEQ ID NO: 14744 - DNA, 404 bp, Homo sapiens
cctgtagggcttcgctcccagtccagtactccctagcatcaccaccaatcactgcacatagggcacacagcccctgtgtttctggtgagctcttcatctaccttttttttttttgagasagtctctctgttgcccaggctcaagtgcagtggcgcgatctcagctcactgcaacctccacctcmagggttcaagggattcttgtgcctcagcctcccgagtggctgggattacagtcgtgagcsagcatgtctagcctttttgggwatttttttgcggagatggggttttgctatgccacccaggctggtctcaaattcctggactcaagcaatccacctgccttggcstcccaaagtgctgggattacaggcgcgagtggctgtctctctctctctctctctc

SEQ ID NO: 14745 - DNA, 498 bp, Homo sapiens
attatctgggcgtggtggcacatgcctgtaatctcaactattcgggatactggggcaggagaatcacctgaacctgagaggtggaggttgcagtgagccgagattgcgccactgcactccagcctgggcaacaagagcaagacttcatctcaaaaaaaaagagaaaatgctcacattttctacttgtagagttcattggctgtattttctgctttccacttggttgtttgctgtgtatatagctaacacttgagaaatattttctgctttctgttgaattggaaccacagatatttgtgctagataggacattgaagatcatttaatccagtgatgccctgttggagtgtgaaggtgttttagaatgtcaaaatggttgtaattttacatttttgtatgtgctcattaacgaaatacatagtagccaaaagatgttataaactctacagtgcttttaaatgatactggttttcttagacacagtaatctacatgcatg

SEQ ID NO: 14746 - DNA, 463 bp, Homo sapiens
  misc_feature 405: n=a, g, c or t
attctgggaaatgtagtctccttggcctgcgctctgtaggagtggcagaacagtaagagaaatgacaaagcaagaggaacctaatactcttcctcattggccttcctgtctccatctttattccttccagctcattctctacatracactgtgaatgcmaaactgtctggaggstgccatgagcggccaatttgtgatctctgctttacctgaattatktccgtgaattgtgacatcaacctcgccagataagaaagaagactgaagttcagagaggtgaagggactggctcaggggctacccctatggttgcgggastaagattccagcccagcagcgtgatccagagcccatctgagctacccagatcttcctgctgttaaacccgtcctggggcagctcttngcctgatgggctacctgaggaacccacaggaaatcaagggaggtgcctgcaaagttgc

SEQ ID NO: 14747 - DNA, 413 bp, Homo sapiens
  misc_feature 40: n=a, g, c or t
acactttcactctattgtaaccacacagggsaggcgcawnagcatgtcagtgtcctgccccgggcactctccctcccgggcacgctccctctggcctggtggatcaccaagagggsggttctcattttgttattagtggaagagccttgagcttaaaagctcttcattttctttgccggaaagtatatggtttgtgtttttgcagttttatttttttaaggatggacactaaatctctggtgtccatgttccgagccccgtggctgggatggtggctcgatgtgtctcctctttatcccgccctctgcctgttttggtgccctcccttcttttcccccaggcagtgggtatcgggttctttcccaaagtgcttacttggaaagagtgtggctgctggactcttttcgaaatgc

SEQ ID NO: 14748 - DNA, 195 bp, Homo sapiens
gacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgtttttttttttttt

SEQ ID NO: 14749 - DNA, 89 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14750 - DNA, 70 bp, Homo sapiens
aaaaaaaaaaaaaaaaaaaaaaaaaaaaaaaaaaaaaaaaaaaaaaaaaaaaaaaaaraaamaaaraama

SEQ ID NO: 14751 - DNA, 83 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14752 - DNA, 284 bp, Homo sapiens
cacaaaaagatgccaggcactgtgggaggctgaggtaggcagatcacctgaggtcaggagtttgagaccagcctggccaacatggtgaaaccggtctctgctaaaaatacaaaaattagccgggggtggtggcgcatacctgtaatcccagctactcaggaggttgcggtagggaaattgcttgaacccgggagacagaggttgcagtgagctgtgactgcaacactgcattccagcctgggcaacagagtgagactcctcctcaaaaaaaaaaaaaaaaaggs

SEQ ID NO: 14753 - DNA, 67 bp, Homo sapiens; identical to SEQ ID NO: 11909

SEQ ID NO: 14754 - DNA, 61 bp, Homo sapiens
aaaaaaaaaaaaaaaaaaaaaaaaaaaaaaaaaaaaaaaaaaaaaaaaaaarrrraaaaaa

SEQ ID NO: 14755 - DNA, 195 bp, Homo sapiens; identical to SEQ ID NO: 14704

SEQ ID NO: 14756 - DNA, 63 bp, Homo sapiens; identical to SEQ ID NO: 13842

SEQ ID NO: 14757 - DNA, 90 bp, Homo sapiens
  misc_feature 18: n=a, g, c or t
gttccagcagtccgcrancwgcmgtmggctccrcagrgrgggcgggccgggcaccccggggcgcggaggagcgctcctcgcttctctccw

SEQ ID NO: 14758 - DNA, 209 bp, Homo sapiens
  misc_feature 16..18: n=a, g, c or t
aattttgcaacgacgnnngcggaggaggaggttcccggaagccacgcgcastggagcagcggcgaccgcagctggargcccggagcgcctgcagggctggcagadgcgadggaggttgcrggtaggaagggcggactgcrcgcdccccctgcgtcccgcgcacctcggggccggtccattctcccgamggctgcgggcttcagcatctw

SEQ ID NO: 14759 - DNA, 527 bp, Homo sapiens
cagttattttatggtttaaaagtttcaattagacataaaaagaccttgaaaagaaaataccacacaagatagggtcattcataggtgaaagaacagtgctgatcaataattttgataaatgagaaactaattgataaatctgttagcatttgtttgaaagctgtagctaaatgttgcagagtrgccgggtgtgatggctcatgcctgtaatcccagcactttgggaggccaagaggggcagatcaggaggtcaggagatcgagacaatcctggctaacacggtgaaaccccgtctctactaaaaatacaaaaaaatttggccgggcatggtggcgggcgcctgtagtcccacctactcgggaggctgaggctaggagaatggcgtgaacccaggagaggaggttgcagtgagccgagatcgcaccactgcgctccagcctggggtgacagagtgagactctatctcacaaaaaaaaaaaaaaaaaaaagtaactttcctggtgctgttgttaactcgttcctttttt

SEQ ID NO: 14760 - DNA, 62 bp, Homo sapiens
gccgcctarractagagarggtgggggacggacaagccccgatgccgggggagacggaagaa

SEQ ID NO: 14761 - DNA, 189 bp, Homo sapiens
agatggatggacagatatcagagtagatatgtatacacactgccatatgtacatatacatatgtgtgtgtaatgttatttattttaaaaaaaataaacactctgcttactacttgaaaaaaaaaaaaaaaaaaaaaaaaaaaaaaaaaaaaaaaaaaaaaaaaaaaaaaaaaaaaaaaaaaaaaaaaar

SEQ ID NO: 14762 - DNA, 365 bp, Homo sapiens
ctctctctggctgcvggcggctgggcgggccggagctcggcaacgtgtctggcccatgctgcttgccgccgctccccacgcgctccccggcgcggccccgactggggctagggccgcagacgcgcggggccccttcgggcgcggggcttgggtgcctacacctctgcrgcgggagtcgcggtggagcctgaatggagarccggcctgggggcggcgttgctgtgactgacacctccggggtctgtcccgagagggggtgattccgccggctcccggttctctcccgagctcggagttggtaggggaggaggctttctccaactaccgccgctacttccgaggtacgagactccagttgtttggcc

SEQ ID NO: 14763 - DNA, 317 bp, Homo sapiens
agaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggarcmccgcccaccccaggccgttcctccccagctgtgatgcadcmccctccaggcatgccactgccccctgcg

SEQ ID NO: 14764 - DNA, 63 bp, Homo sapiens
  misc_feature 32,34: n=a, g, c or t
ctctccctgctttcctctgccgcatggwcctnrnccgttggcgtcggaagcctgaagcatggr

SEQ ID NO: 14765 - DNA, 495 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaaaaaaaccagaaaacaaaactgggcgcagtggctcacgcatgtaatcccagcactttgggagtctgaggcaggtggatcccctgaggtcgggagttcaagaccagcgtgaccaacatggagaaaccccgtctctactaaaaatacaaaattaaccaagcatggtggcgcatgctataatcgcagctacttgggag

SEQ ID NO: 14766 - DNA, 508 bp, Homo sapiens
aatgagaaggaaggaagggagtgcgtaggtccagtgaggacgagggtgaaatttatatctctgcccaggtctcggtgcctgcaccgccatagacaccaccaggtacagcaactggggcgggagctacgaggaggtccccggaggtatgagcaaggagactgccccatccctgccccggtgtctggggtttgatgggggaggggagggaagagccaagacgggccagagtcgtgggtgcaaaaaaaacaacacagagccagttggaccaggggccaattccaactctgccacttagaagctgtgtgaccataggcaagttacttaacctctctgaaactcagtttcctgagaggaacccaggcctctagggctcagtcctgggggacccagcatgccgtccttgttctgccagggcactggggacgctgggtgcactggagcccgagacccctcttcctggccatggctgtcctggtcgccagtactgtgggctgtgattctgagtatc

SEQ ID NO: 14767 - DNA, 379 bp, Homo sapiens
caaataatttgtactgagggaaacagttatactacaaatcatgttgcagatctgatgccgagattgctctattttaaaaggaaacctgcaaatgtctacatatatgaagcttttaaaaagcacaagttatcaggcaacatcattaaacatacattaaatgtctgttagcatataggattttgtgcgtatgtgagtgtgctataacatgtaacttgcggatgttcagcgtgcatgtggaatccatccataatggtacatagcgaaataatataatcttagttcagtaactattatgtgtatgaagatgttgcacattaagtctcagtagtgactctggttgttaatatttgtattgtaagtgtaatattccttttaaatt

SEQ ID NO: 14768 - DNA, 393 bp, Homo sapiens
  misc_feature 181: n=a, g, c or t
aatccctctcacgcgcggtgccgggtgtccgccccctctrggtccgagaagcttccgcccaaccctttccaggtgccgctcccctgcgcattccagagcagtactctccaaggtgggaaacctaggagtttggagtctcctccgggatggagaagctgccgctagcttagttcgctttgrnraccggaggggctagaaaggaaactagaggcrgrggtrgrgggtggacactgggcaggactgagcatcagcaaggcgtgattctsaaaggragggggcktcggccccctaccccggakcgtccgaagcgctggtcttcatacctgtgtcggctctttcgaaggabagakgaggagtcggggtcttcactttcttctcagccgcattaaaagc

SEQ ID NO: 14769 - DNA, 474 bp, Homo sapiens
  misc_feature 334: n=a, g, c or t
attcagcttccgggctaattagcagtcgcggtgtgccgctacgtgcgggctctcaaggagctcagcctcccggacggagccggcggctgcrgggcgaggacggcggcggaccggggcagccccgcgccctggccagctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacagncaccgtccccaaaagatttccaaagatgatgttaaacccagccacggttctgatctccaggaaagcaattgctgtggtacaaaaggacaagggttaaaagagaacagtgggagctctctttcccaactaactcacgcatt

SEQ ID NO: 14770 - DNA, 263 bp, Homo sapiens
atcacgaggtcaggagatcgagactatcctggccaacatggcgaaatcccatctctgctaaaaatttgaaaattagctaggtgtggtggtgcgtgcctgtaatcccagctacttgggaggccgaggcacgagaatcacttgagctcaggaggtggaggttgcattgagctgagatcgtgccactgcactccagcctggcaacagagcgagactctgtctcaaaaaaaaaaaaaaaagaaaagaaaacaaaaaaaaaaaaaaaa

SEQ ID NO: 14771 - DNA, 528 bp, Homo sapiens
  misc_feature 155,165: n=a, g, c or t
aaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagawagangagaattganaagccgagaagatttagcagaagtttaavccggactccaagtccacctcccttcagaggcagaaacacagcaatggatgcacaggaagctttagctagaaggttggaaagggcaaagacttggagctggaggtgagaaaagcatgctgacccttacgcctttgctttcctccttctcgtcctcaacttctaaacccttgttggctcttccatttgttacccccattcccatatgtgcttctttccatctaccacttgactctggtcctccctatgccagatcaactgcctgtgacccttgactgctccgcttggacaagtggtctctaaacttacttcctgctttatcttatgctcgttttta

SEQ ID NO: 14772 - DNA, 510 bp, Homo sapiens
  misc_feature 463: n=a, g, c or t
ctttattgataaagttagggagaagattgatgcaataggacaatttccaatttaatttagatcctctaatctttctacatggacaagctgttttcttttctaggttactgataacccctacaatttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgnwactattctttggcattggtgtccatggcctataccgccatcttaca

SEQ ID NO: 14773 - DNA, 514 bp, Homo sapiens
atttttcagctgaaatcagcctcatcaaagcagcaactgtgtaccaaggggttgacaaatagaggaaatttgtgaagctgggcttcttggcaagtgttttgtccttggaaattctgttcctctcagccttctgggggctcgctctgtcacccaggtcggagtgtaatggtgtgatcacaactcgctgcagcctcaaccttctgggctcaagtgatccttatgcctcagcctcctgagcagctgggactacaggcatgtgccaccatgcccaggctggagcgcaatggcacaatctcggctcactgaaacctccacctcctgggttcaagcgattctcctgcctcggcctcccaagtagctgagactacaggcacatgccatcatgcccagctaatttttgtatttttagtagagacagggtttcgccacattggccaggctggtcttgaacttctgacctcaggtgatctgcctgcctcggcctctcaaagtgcggggattacaggcatgagca

SEQ ID NO: 14774 - DNA, 298 bp, Homo sapiens
taagaagatgtttggctgggcgtggtggctcacgctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtg

SEQ ID NO: 14775 - DNA, 281 bp, Homo sapiens
cacaaaaagatgccaggcactgtgggaggctgaggtaggcagatcacctgaggtcaggagtttgagaccagcctggccaacatggtgaaaccggtctctgctaaaaatacaaaaattagccgggggtggtggcgcatacctgtaatcccagctactcaggaggttgcggtagggaaattgcttgaacccgggagacagaggttgcagtgagctgtgactgcaacactgcattccagcctgggcaacagagtgagactcctcctcaaaaaaaaaaaaaaaaa

SEQ ID NO: 14776 - DNA, 457 bp, Homo sapiens
gaaagcggcggaagggacgctggaatgtggagcggttgtggggcggcastgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacgacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgttt

SEQ ID NO: 14777 - DNA, 162 bp, Homo sapiens
catttcagtagtgttaagtacattcggctgggtgcggtggttcacgcctgtaatcccagcactttgggaggccgaggtgggcagatcacaaggtcaggagatctagaccctcctggccaacacagtgacaccccgtctctactacaaaaaaaaaaaaaaaaa

SEQ ID NO: 14778 - DNA, 445 bp, Homo sapiens
aaaaggagcmgcgctgggaacactgcggtcggggcgaggaagctgccggggaagtgagatgacggtcgcgggggtgcccaggagccctgaaaaacttgtgcsctgggsaggcaaaatctgcaggttgcagaaagtctcaactgatcctggcataccccgaggtgccgacttttagagctaaagatgcaagaaagattgggatcctgcgatgcaccgaacctgtctctcgaagtgtgtgcgccctgcttcctgtgttaaacaatttgctacaaggtcacacaattttaactagaagactgagatgtgaacctgggtggtctgatgtgaacaccactgtctggtaatcccaacgctctgctgctttgcgacagagaatgttttagggarcacacagactatgtacttaaccaaatctggaatttgccgtaagatattaattagagaa

SEQ ID NO: 14779 - DNA, 268 bp, Homo sapiens
  misc_feature 108,120: n=a, g, c or t
tsgcggaccgcaaaggccgcccgtcccgtcaaacaagtttcttcttaggctaagaaacgcagtatatacgagtatctctatatatagtactaatggatttggtgtgcntcccccttagcntccccctccctctgctcctcctccttcagcctggtctccccctcttctctgccctccacccccgtctctgcactgagatacataagaaacaagggtagtttactgtctgttttgttttctgggttttmagtgcagagacgggggtaga

SEQ ID NO: 14780 - DNA, 481 bp, Homo sapiens
tacaaaattagctgggcatgatggtgcactcctgtaatcccagctacttggtaggctgaagcatgagaattgcttaaacctgggaggcagaggttgcagtaagccaagatcatgccactgcactccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctggga

SEQ ID NO: 14781 - DNA, 269 bp, Homo sapiens
agctgagaaggggcggtcctgcggaatgcgtcgaagagggctccgcgctccaagagagaagcctgaggacaaagttctgggagatcggcattgactatgtaagtaacaacaacggcctaaagaagcaacaagaaaggaaccgagtgcctggagaacttcatggagcagagccacttgcctactttggatcatctgtctctaagagagggaaataaacatttcttttgtgtgaaaaaaaaaaaaaaaaaaaaaaaaaaaaaaaaaaaaaa

SEQ ID NO: 14782 - DNA, 162 bp, Homo sapiens; identical to SEQ ID NO: 14777

SEQ ID NO: 14783 - DNA, 83 bp, Homo sapiens
cttccctgttatctttgtgacccactgatagcagctggtggtcctggtgcggtgagattttgactcttttttttttttttttt

SEQ ID NO: 14784 - DNA, 417 bp, Homo sapiens
ttaaaaatgtcctgtgcaggtgttggtgagggtaaattgaaaacattttttattttttgttgtttttttttattgagacggagtctcactctcgcccaggctggagtgcagtggcacgatctcggcccactgcaagttccgcctcccgggttcacgccattctcctgcctcagcctcccgagtagctgggactacaggcggccaccacggcgcccggctaattttttgtatttttggtagagacggagtttcaccgtgttagccaggatggtctcgatctcctgtcctcgtgatccgcccgcctcggcctcccaaagtgctgggattacaggcgttaaaggcaattcacatgtcttccttggatttgtcagggatggcaggtgtatacattgggttagtagatgaggatattataca

SEQ ID NO: 14785 - DNA, 240 bp, Homo sapiens
catacagatttaatcctgcgactccccagattaaaaacctttgatgctcctttttgttttttgatacagagtctcactctgtcacccaggtgggagagcagtggcgcaatctcggctcactgcaacctccgcctcctaggttcaagcaattctcctgcctcagcctcctaagtagmtgggactacaggcawgcaccaccatgcccagctaatttttatatttttagtatggagtttcacc

SEQ ID NO: 14786 - DNA, 83 bp, Homo sapiens; identical to SEQ ID NO: 14783

SEQ ID NO: 14787 - DNA, 75 bp, Homo sapiens; identical to SEQ ID NO: 14694

SEQ ID NO: 14788 - DNA, 442 bp, Homo sapiens
ctcaatatgcaaaaattaattatattccccaagtttcatagaaacatttattgcctacaaaataagatatgaacataaataaatatataaacataaatacaagtttaagaattaaaaaaagaaaatagccaggtgtgttggcatgtgccttaagtcctagtatttgagaggatgwggtaggaggatcgcttgaacccaggagctggaggctacagatgtactccagcctgagtgacaaagtgagaccctgtctcaaaacgaaagggaaaaagagtacatagagattactttttctggacccaactatcaccagaatatattaagactttctgaggccgggtgtggtggctcatgcctgtagtcccagcactttgggaggctgaggagggtggatcaccagaggttgggagttcgagaccagcctgaccaacatgccgaaatc

SEQ ID NO: 14789 - DNA, 347 bp, Homo sapiens
aacaactcagatgtctcctaccttccctcttaggaaggcattaaaggggaagagaggatggctttggcccgcaataaactgggttcaaatcccagctctaccacataaatataaaagttatctgatgttcagcatggtatctctctgaccctcagtctcttcatctcctgaggacaaagttctgggagatcggcattgactatgtaagtaacaacaacggcctaaagaagcaacaagaaaggaaccgagtgcctggagaacttcatggagcagagccacttgcctactttggatcatctgtctctaagagagggaaataaacatttcttttgtgtgaaaaaaaaaaa

SEQ ID NO: 14790 - DNA, 264 bp, Homo sapiens
  misc_feature 237: n=a, g, c or t
atcacgaggtcaggagatcgagactatcctggccaacatggcgaaatcccatctctgctaaaaatttgaaaattagctaggtgtggtggtgcgtgcctgtaatcccagctacttgggaggccgaggcacgagaatcacttgagctcaggaggtggaggttgcattgagctgagatcgtgccactgcactccagcctggcaacagagcgagactctgtctcaaaaaaaaaaaaaaarnaaaggaaamcaaaaaaaaaaaaaaaaa

SEQ ID NO: 14791 - DNA, 301 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaa

SEQ ID NO: 14792 - DNA, 72 bp, Homo sapiens
  misc_feature 25: n=a, g, c or t
agtaacccctccccccaggttccanaggaagaagcctccacatctgtctgccggcccaagagttccgtaacc

SEQ ID NO: 14793 - DNA, 461 bp, Homo sapiens
  misc_feature 130: n=a, g, c or t
taatttcttagcgatgttaacggtgagtgcatacttttattttgctgactttatgttttacatttttttgttgtggtaaaatatacatgacataaaatttatcattgtaaccattgttagttaagtgkdnagttagtggcatcaagtatattcgcattgttgtgcaactgtcaccactattcatttctagaaatttttcatcatcccaaacagaaatgctgtgcccatttaagtagtaacttcctattcttttctcccccagtctctggtaaccactattctactttcggtctctatgaatttgactattctaggtacctcatataagtaaaatcatggagtatctacttgtgactggcttatttcacttaacagaacgttgaaggttcatccatattgtagcaagtgcctgaattttattcctttttaaaaaattgtggttaaacttgcataacataaag

SEQ ID NO: 14794 - DNA, 162 bp, Homo sapiens
ttttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttt

SEQ ID NO: 14795 - DNA, 356 bp, Homo sapiens
  misc_feature 279: n=a, g, c or t
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggacttncagtgagccgagatctctccactgcactccagcctgggcgacagagcgagactccatctcaaaaaaaaaaaaaaaaa

SEQ ID NO: 14796 - DNA, 278 bp, Homo sapiens
agaggggcagcttccctgagagcagctaagccccaggcacaccgggcatccggacacacaggtcggggaaggataggtstgagccggggctcccagcagagacgcctgggtggggcaggaggccgctccaggtgtgagccacagaggaggggagagggacccccacgggagtgaagtggcagagcagctgcagaagtgcagggagcggaaaggtaccagggcagctgctttccgctgsctccggtccgggcagctgcagaaacagcagggggaggagc

SEQ ID NO: 14797 - DNA, 328 bp, Homo sapiens
cattcgggaggctgaggcaggagaatcgcttcaacccaggggttggaggttgcagtgagctgagattgcgccactgcactccagcctggtgacaaagcaagactctgtcttaaaaaaaaaaaaaattaggccaggcacggtggctcatgcctgtaatcccagcactttgggaggccaaggtgggcagatcacgaggtcaggagwtcaagaccatcctggctaasacggtgaaaccccatctctactaaaaataaaaaaggaattagctgggcgtggtggtgggcacttgtagtcccagstactagggaggstraggcaggaraatggt

SEQ ID NO: 14798 - DNA, 259 bp, Homo sapiens
  misc_feature 197: n=a, g, c or t
agctgagaaggggcggtcctgcggaatgcgtcgaagagggctccgcgctccaagagagaagcctgaggacaaagttctgggagatcggcattgactatgtaagtaacaacaacggcctaaagaagcaacaagaaaggaaccgagtgcctggagaacttcatggagcagagccacttgcctactttkgatcatctgtntctaagagagggaaataaacatttcttttgtgtgaaaaacaaaaaaaaaaaaaaaaaaaaaa

SEQ ID NO: 14799 - DNA, 61 bp, Homo sapiens; identical to SEQ ID NO: 14680

SEQ ID NO: 14800 - DNA, 55 bp, Homo sapiens; identical to SEQ ID NO: 14535

SEQ ID NO: 14801 - DNA, 474 bp, Homo sapiens
acatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctggggaaa

SEQ ID NO: 14802 - DNA, 427 bp, Homo sapiens
caaggttaacaaggttgatggggaatggtccttgctctcaagaagctcgtaggcggccaggcactgtggcttatgcctgtaatcccagcattttgggaagctgaggcaggtggatcacctgaggtcaagagttcaagaccagcctggccaacatggtgaaacccgtctctactgcaaatacaaaaaattagtagccgggcgtggtggctcacgctgtaatcccaacactttggtaggccgaggcgagtggatcacctgaggtcgggagttcgggaccagcctgaccaacacggagaaaccctgtctctactaaaagtacaaaattagccagggatggtggcatgtgcctgtaatcccagctatttgggaggctaaggcacaagaatcgctttgaacctgggagacagaggttgcagtgagctgagat

SEQ ID NO: 14803 - DNA, 54 bp, Homo sapiens
attacaatttaactttggrgtttgggtaagacaaacatttaatgtataggattt

SEQ ID NO: 14804 - DNA, 102 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14805 - DNA, 81 bp, Homo sapiens
tcatgagccttttcaactttccagttgatatcttttgtttgcttttttcttttcttatttatttatttatttatttattta

SEQ ID NO: 14806 - DNA, 110 bp, Homo sapiens
ataggtgtttcagataggaaactgggttgtagaccttgtcccagtaatatctccagcagctccaacacattttgtcaacttcgtattcgttttttaagtttttttccttg

SEQ ID NO: 14807 - DNA, 430 bp, Homo sapiens
aagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacaggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgactcgagcaagtgactactcctcactggattgtaggactaaatgtgatagtcattatttacagttcaccacacgctcttca

SEQ ID NO: 14808 - DNA, 430 bp, Homo sapiens
  misc_feature 84: n=a, g, c or t
acctggtccatttccttctctaattaccatggcagttattttacacctctactgctgtccttaatcccataccccaccctcatnaggtgaccctgtttcsttttttagagaaattgaagctcttagacattggtttccacagtaataattttaaaacttcttacaactacctacaaagcagatgttctatcctatctacagagcagaaaattgaaattctcaagtagcagacccggtattaaagtgcagatctgactttaaagtccatgttcattttacacagcaggctgcctcttaagatagtatttattgagcacacactttgtgtaggttctgattttggtagatgtcatgctttatattaatactttacaacaactataagtaagaggtattaacctcacttaacagatgaggagcaagaatccag

SEQ ID NO: 14809 - DNA, 292 bp, Homo sapiens
gttattcaggctgggcgtggtggctcatgcctgtaatcccagcactttgagaggctgaggcaggcggatcatttgaggtcaggagtttgagaccagcctggcsaacatgattaaaccctgtctccactaaaaatagaaatattagctgggcatggtggcatgtgcsgtgatcccagmtcctccagaggctgaggcaggaaaattgcttgaacccaggaagcggaagttgcagtgagctgagatctcgccactgtgctccagcctgggcgacagggagactccctctcaaaaa

SEQ ID NO: 14810 - DNA, 477 bp, Homo sapiens
aaagaagaccactaagtgactaatggtcagagaagctggatgaggggctgattcatgtcctgggcatgacagagcgggaggcacaaggtttcatcacactattcacaatggcgagcaagttaaaacggatttcccatttaatttaattttcagacttcagttgaccatgagtaaccgaaaccacagaaagtgaagctggggatatttcagaaattcttttctaatcagaaattctaatcaaacataagtttccaactatgtgttctcttggtcctcagaagtgtttgaatagaaaagtaacaactaacttcccatctttctggtggaagagttaattctgcctggagggttctgcctgggagacatgacagcatgtgtgtgactcctgtgtctgtttctgtggggtcatccctttcgtttcattttgccagggcctggctcaggattttttatggcagtgctgtgaagacaagcctg

SEQ ID NO: 14811 - DNA, 441 bp, Homo sapiens
attttttttttggattgcgtagggtcttgcgcmgcgcgaaaagtagcgtgggccaggacagcgggagagattgggtttcatcatgttggccaggctggtcttgaactcctgacgctgtgatccacctgcctgggtctcccaaagtgctaggattacaggtgtgagctaccgtgcccagccggcaactggtgttctcatgggagaagaagactttttggaagaccctgtcattgcgtttgtgagactggctcctgctgtcctcctctcaaagctatctgaggtttctgttgctatgacataaataattagttccaattattctctcagtaggttcaaaaccaaaaatttttatctactgaatgaacaagaatactgctttatgtaataaaactcatttaaatttttaatattcagtcattataccaaatactttgagtatta

SEQ ID NO: 14812 - DNA, 77 bp, Homo sapiens
aaaccctcagggacctggtatagacgcagaatctgtttcacacaacaactgctatttgaaggaaaaaaaaaaaaaga

SEQ ID NO: 14813 - DNA, 69 bp, Homo sapiens
  misc_feature 52..53: n=a, g, c or t
gaactcttctctgccagccgggctgccccgaggccacctgacagctcatggnnccccgaccccgacgac

SEQ ID NO: 14814 - DNA, 456 bp, Homo sapiens
caggcaggaaatatggtgacttggtctaggatgatgtagttgagacagaagtctatagacagacaaggacgagtcattttgtccacatccttcttctctgttatccattccaaatgtaaagccactttacatttgtacttttagaactcttaaagatctcttttgtggtaatgacaacgcattattccttagttaaacatttacactctttttgctaactcatttttctctcatccttgataatatagacttataccaattctcctaattgatttgccacattggtccatagtaaaattgtgcaagtattttgaaagagaatatgttcctattcagatttctgaggtcttactaaagacttccaatattatgctcattcaatcatctttaaaagtatacgacttggccagaattatttgctcagccatattactcaattccatttctcagttccat

SEQ ID NO: 14815 - DNA, 72 bp, Homo sapiens; identical to SEQ ID NO: 10145

SEQ ID NO: 14816 - DNA, 340 bp, Homo sapiens
gaaaaaaaattggctgggcgtggtggtgggcactataacctcagctacttgggaggctgaggcaggaggatcgcttgaacccgggaggcagagattgcagtgagccgaaatcatgccattgcactccagcctggacaacaagagcaagactccatcttaaaaacaaacaaaaaaacaacaaaaaaaattagctggccatggtggtgcacacctgtagtcccagctactcgggaggctgaggcacaagaatcatttgaacactggaggcagaggttggagtgagctgagagggtgccactgcactccagcctgggtgacaaagtgaaactccatctcaaaa

SEQ ID NO: 14817 - DNA, 566 bp, Homo sapiens
tactaacacacgacatgcggcttttctgydtcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctaaaaaaaaaaaaaaaaagg

SEQ ID NO: 14818 - DNA, 195 bp, Homo sapiens; identical to SEQ ID NO: 14704

SEQ ID NO: 14819 - DNA, 66 bp, Homo sapiens; identical to SEQ ID NO: 12404

SEQ ID NO: 14820 - DNA, 54 bp, Homo sapiens
tttcagtttgacagcccgtttcctagacaagtgcacctggggtttcaggaactt

SEQ ID NO: 14821 - DNA, 436 bp, Homo sapiens
ataataataaaataaaaaaagaaaagcaaattcttacattttaatgcaaattacacattgtaatatgattgacagtgttatatatttatatagattataggcttaagttctaaggtctactaatgacagtggatttaataaatttaacaatatttagagattttctatattgaaatacattaggcagttattgtttgtacactaataccaaaggtgccattctgcaaggtataattctcttgatagccagttgggttgattttataacgcattctctccctgaacatagaaactgaagtcagagatcaaaaaggaaaataaatttttaaccttggtattagtgactggcaataaaaaaactgcaaagtttgaaccactagcaataattactcctttaatctgaatccattacggtggtcatcactgttaaattgtt

SEQ ID NO: 14822 - DNA, 343 bp, Homo sapiens
attacaatttaactttggggtttgggtaagacaaacatttaatgtataggattttggcmaggtgtggtggctcacgcstgtaatcccagcactttgggaggcsaaggtgggcggatcacgaggtcaggagatcgaaaccatcctggctaacatggtgaaacccatctctactaaaaatacaaaaaaaaaattagctgagcatggtggcgggcgcctgtagtccsagctacttgggaggctgaggcaggagaatgacgtgaacctgggaggcggasttgcaagtgagccgagatctctccactgcactccagcctgggcgacagagcgagactccatctcaaaa

SEQ ID NO: 14823 - DNA, 317 bp, Homo sapiens
taagaagatgtttggctgggcgtggtggctcacgctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtgccaaaaaaaaaaaaaaaaa

SEQ ID NO: 14824 - DNA, 78 bp, Homo sapiens
aaaaaaaaaaaaaaaaaaaaaaaaaaaaaaaaaaaaaaaaaaaaaaaaaaaaaaaaaaaaaaaaaaaaaaaaaaaaaa

SEQ ID NO: 14825 - DNA, 62 bp, Homo sapiens
aaaaaaaaaaaaaaaaaaaaaaaaaaaaaaaaaaaaaaaaaaaaaaaaaaaaraarraaaaa

SEQ ID NO: 14826 - DNA, 386 bp, Homo sapiens
taattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgkaaaataaaacggtcatgatttttttcaattacagaatagttacaaattttaccatgttcatctattccacaga

SEQ ID NO: 14827 - DNA, 58 bp, Homo sapiens
aaaaaaaaaaaaaaaaaaaaaaaaaaaaaaaaaaaaaaaaaaaaaaaaaaaaaaaaaa

SEQ ID NO: 14828 - DNA, 54 bp, Homo sapiens
taagcataggattttatattttggggtgaaagaattatctggcacattaggtat

SEQ ID NO: 14829 - DNA, 478 bp, Homo sapiens
attttgttattatgttcctaagtctccttttttgttgttggtttttttctttcatacttacaagattttggttgaggaagttgaattgttgataggtgggtcacctcatgagttaattatttgagattgtttaaatacatttttatatctgtctctgaaataacaaaagtgaagctttgtggtaagaaactattcagtttttttatttgatatgcactttcatgtgtcttggtgcatagtgctgatgggaaaagaatgaaatatatgatgaaatactgtgcttgaagagcagcaagcattgaacccagtcatagctcgtgaacttgtgaatggacctgtttctttttaagtatgtgaaaatttctgggaaatattctgatgaattttacataggtcatctcttactattgaacttaaaatatttccctttttctcccaaggagaacattttcagttttacttcttttgtcctgtgctg

SEQ ID NO: 14830 - DNA, 103 bp, Homo sapiens
ggccgggagcggtggctcacgcccttaatcccagctctcagggaggctaagaggcgggaggatagcttgagcccaggagttcgagacctgcctgggcaatata

SEQ ID NO: 14831 - DNA, 76 bp, Homo sapiens
aaaaaaaaaaaaaaaaaaaaaaaaaaaaaaaaaaaaaaaaaaaaaaaaaaaaaaaaaaaaaaaaaaaaaaaaaaaa

SEQ ID NO: 14832 - DNA, 464 bp, Homo sapiens
caaggttaacaaggttgatggggaatggtccttgctctcaagaagctcgtaggcggccaggcactgtggcttatgcctgtaatcccagcattttgggaagctgaggcaggtggatcacctgaggtcaagagttcaagacmagcctggccaacatggtgaaacccgtctctactgcaaatacaaaaaattagtagccgggcgtggtggctcacgcctgtaatcccaacactttggtaggccgaggcgagtggatcacctgaggtcgggagttcgggaccagcctgaccaacacggagaaaccctgtctctactaaaagtacaaaattagccagggatggtggcatgtgcctgtaatcccagctatttgggaggctaaggcacaagaatcgctttgaacctgggagacagaggttgcagtgagctgagatcgcaccattgcactcccgcctgggcaacaagagcga

SEQ ID NO: 14833 - DNA, 405 bp, Homo sapiens
tatgtcacgatttgataggaatgtcaaatgtgataatgctgtgctttcataaattcacctaaatctcaaatatactgcttttttctgtttttaatatgttaaacaaaaagttccaataagcctgggcaacatacagagacctcatctctactaaaaaaataaaaaaaatggccgggcacagtggctcacacctgtaatcccagcagtttgggaggctgaggtgggtggatcacctgagttcaggagtttgagaccagcctggccaacatggtgaaacctgtctctactaaaaatacaaaaattagccaggtgtggtggcaggcacctgtagtcccagctactcgggaggctgaggcagggagaattgcttgaacccgggaggcagaggtggcagtgagctgagat

SEQ ID NO: 14834 - DNA, 61 bp, Homo sapiens; identical to SEQ ID NO: 14680

SEQ ID NO: 14835 - DNA, 86 bp, Homo sapiens
ggttgcagtgagctgagctcacaccttggattctagcctgggtgacagagcgaaactccatctcaaaaaaaaaaaaaaaaaaaaaa

SEQ ID NO: 14836 - DNA, 494 bp, Homo sapiens
gtttttttctttaaggaaattgattcatgaataattggaaaggtattgctagttaagacacacagaaacacaaacttagcggastgcacttcagagagtcccactgtaatctgttaatagaatctgctttaaatgagtcactccttagactggcaatgacacccagcttagtctgtaaaatcaggaatctttgtgttggctgaaggaacttagtaatcttagttgaattcctcttccccatgtctttcaaaaccagagcactgggtcgaacctaacccacaaaataattcgtccaaattaaattgacttttttacataacatcagcaccaccccttacacttttaaagttaaagaccctgttgatcaggttacctggaaatttcaagtgcatctgaccagggattatcaagctccttgtgacatctgtttctgatgctgtgaatgtgatgtcaccacaaatagagattctgaattttgctggtactaatgctga

SEQ ID NO: 14837 - DNA, 458 bp, Homo sapiens
tacaatatggagagaagtggtgtattttgaaaacatttggggccgggcgcggtagctcacgcctgtaatcccagcactttaggagactgaggggggcgaatcacgaggtcaggagtttgagaccagcctgaccaacatggtgaaacctgtctctactaaaaaaaatacaaaaattaaccaggcgtggcacctgtagtcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgcagtgagcagagatcgtgccactgcactccagtctaaatgacagagtgagaccctatctcaaaa

SEQ ID NO: 14838 - DNA, 69 bp, Homo sapiens
aaaaaaaaaaaaaaaaaaaaaaaaaaaaaaaaaaaaaaraaaaaaaaaaaaaaaaaaaaaaaaaaaaaa

SEQ ID NO: 14839 - DNA, 344 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaacccatctctactaaaaatacaaaaaaaaaattagctgagcatggtggcgggcgcctgtagtcccagctacttgggaggctgaggcaggagaatgacgtgaacctgggaggcggasttgcagtgagccgagatctctccactgcactccagcctgggcgacagagcgagactccatctcaaaaaa

SEQ ID NO: 14840 - DNA, 217 bp, Homo sapiens; identical to SEQ ID NO: 14714

SEQ ID NO: 14841 - DNA, 328 bp, Homo sapiens
tagattaaggcactagttcttaggatggcttttggtgcagtgactcacgcttgtaatcccggcactttgggaggccgaggcaggcagatcacttgaggtcaggagttcgagaccagccctggccaacatggttaaaccccatctctactggaaatacaaaaaattggctgggcgtggtggctcacacctgtagtcccagctgctccagaggctgaggcaggagaatcgcttgaacgcgggaggcggaggttgcagggagccaagatcatgccactgcactccagcctgggtgacagagcaagactccatctaaaaaaaaaaaaaaaaa

SEQ ID NO: 14842 - DNA, 72 bp, Homo sapiens; identical to SEQ ID NO: 10145

SEQ ID NO: 14843 - DNA, 474 bp, Homo sapiens
attattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcata

SEQ ID NO: 14844 - DNA, 270 bp, Homo sapiens
tttgattctctaaggagcacgaaagggggaatgcccctcccaggagtttatgggagaagggactggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtraagggcggt

SEQ ID NO: 14845 - DNA, 253 bp, Homo sapiens
cacaaaaagatgccaggcactgtgggaggctgaggtaggcagatcacctgaggtcaggagtttgagaccagcctggccaacatggtgaaaccggtctctgctaaaaatacaaaaattagccgggggtggtggcgcatacctgtaatcccagctactcaggaggttgcggtagggaaattgcttgaacccgggagacagaggttgcagtgagctgtgactgcaacactgcattccagcctgggcaacagagtga

SEQ ID NO: 14846 - DNA, 66 bp, Homo sapiens
asagctcagccggtcgcacggacggacagttggaaagccggaccccagagcctgaggtgggcagtg

SEQ ID NO: 14847 - DNA, 109 bp, Homo sapiens
  misc_feature 106: n=a, g, c or t
ttttggccgggctggtttcaaactcctgacctcagttgatccacccgcctcagcctcccaaagtgctaggattacaggcatgaaccaccgtgcccggccaggaatnaag

SEQ ID NO: 14848 - DNA, 387 bp, Homo sapiens
  misc_feature 340: n=a, g, c or t
acttcctgttgccttaggggaacgtggctttccctgcagagccggtgtctccgcctgcgtccctgctgcagcaaccggagctggagtcggatcccgaacgsaccctcgccatggactcggccctcagcgatccgcataacggcagtgccgaggcaggcggccccaccaacagcactacgsrgccgccttccacgcccgagggcatcgcgctggcctacggcagcctcctgctcatggcgctgctgcccatcttcttcggcgccctgcgtccgtacgctgcgcccgcggcaagaatgcttcagacatgcctgaaacaatsaccagccgggatgccgcccgnttccccatcatcgccagctgsacactcttggggctstasstcttttt

SEQ ID NO: 14849 - DNA, 87 bp, Homo sapiens
tgcttagccctaaacctcaacagttaaatcaacaaaaaaaaaaaaaaaaaaaaaaaaaaaaaaaaaaaaaaaaaaaaaaaaaaaaaa

SEQ ID NO: 14850 - DNA, 480 bp, Homo sapiens
cttgttttttaattacttcctttcactgccaacctcgaattactgtacagtatatgtctttctgcttgtgatcagctttgacaacagtgacagccccacaactagtagccacctgtacatttgtaaactgacctgactccattttgtttttaaatgtgtgggttatgttgcagctgttgcagtcccccagatacctattattttacacaatttgacctataggaggacactgagtaatttacaaacacaactgcattcataaatgggaatagaacgtgaaagccagctctttcagaatatcctctattaatactgaatttagatatctttattccatttattatggtacaaataactgatgttttaaccagagtaatgacctcagtggatttgcttaaccctcacatttttttttaatgtttcacatgttacattattagctgaatacattagaaaatgacagatggtagagacttccat

SEQ ID NO: 14851 - DNA, 196 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgcagtgagccaggatcgcgccactgcactccagcctgggcgacagagcgagactccgtctcaaaaaaaaaaaaaaaaaa

SEQ ID NO: 14852 - DNA, 423 bp, Homo sapiens
tttaaatagagcttaaaaattgacatttaaaaaattcagaccccagaaaattagtatgataaacactgttgaagaagaagggaaggggtttgaagttggttatgctaagcctgaatcctagtgctgccactttacaatgcaaaagagcctctttccacatctgtgaaaatgaaactaattggatatgtactttactttttattttttcaagacagagtctcactctgtttcccaggttgagtgtagtggtgggatcatagctccctgcaaactcgaactaccaggctcaagcagtcctcagctactcgggaggctgaggcaggagaatggcgtgaacccgggaggcggasttgcagtgagctgagatcgcgccactgcactccagcctggacgacagaggaagactccgtctcaaaaaaaaaa

SEQ ID NO: 14853 - DNA, 65 bp, Homo sapiens; identical to SEQ ID NO: 14743

SEQ ID NO: 14854 - DNA, 480 bp, Homo sapiens
aagattactcaaaaaccacataacacagcaaatgcaagadgcttgagacactgcatgagcagccgggctggagacagacaggagggatgatgactgccaggcaatctgctctgaagagagaaggccatatttacacatctgatgaaaaaggacctcggagctgtgctgctttctatgtttcttccagcaatgacccaagtctacgtctgacagcctcagtccagtaaggagctgtttttctccagagtgaaaagatgattttcatcttgactctgggaaacctcaaaggtagatctcctcaccattacaagaacaattatatttataattcaagctgagttgtgactccactttgccctacatggggtttaaagatggtaaaactgaactccattctcatttgaaagtacctgtgagtaaacattttttcccacagcacagcactggccattgctaactgactccctgccagcttctata

SEQ ID NO: 14855 - DNA, 138 bp, Homo sapiens
gacaaaggatccagtgtatgtgtcataatgccagttttcttggaagtagagctgcttatcatccagactttccaacagttctgacagctttagaaatagataatgcggctgtgcagacattcaattcgttattattat

SEQ ID NO: 14856 - DNA, 309 bp, Homo sapiens
tattttctatagaggtgaggtcttgctatgttgcccaagctagtcttgtactcctggcctcaagtgatcctcccatcttggcctcccaaagtgctcagaatacaggcatgagacaccatgcccagccttgatggtattttaaaaataatttgaatagatatttctaacctaactttaaaagttatgatttatttgaggaaaaaaaatatatgtatatatatattttttagatggagtctcactctgtcacccaggctggaatgcagtagcatgatctcagctcactgcaacctctgtcccttgggttca

SEQ ID NO: 14857 - DNA, 323 bp, Homo sapiens
ccactttaagtttttcttttagttcaacaaatatttattgaatatttgaagtatatccattaaggggttaggaattaagtatacaaaggtgaatatagtatgcgcttcagtaaatacaacagaggaaatacttgtaacaatagaaaaggtaaataaggggcagaagttgctatttagatttagtaagtgatccaactcggtagttttgaatctgggtgattatcaaaattactgggacaacatttaaaaaaatggagtcccagattccacctcagatcaactcaatcagagttatcacttgtagtacctttgattcttgtttg

SEQ ID NO: 14858 - DNA, 64 bp, Homo sapiens
aaaaaaaaaaaaaaaaaaaaaaaaaaaaaaaaaaaaaaaaaaaaaaaaaaaaaaaaaaaaaaaa

SEQ ID NO: 14859 - DNA, 85 bp, Homo sapiens
ctgattactaatgatgtagcgcatctttccatatgcttattggccatttctgtatcttctttggataaaagtctattctgatcct

SEQ ID NO: 14860 - DNA, 71 bp, Homo sapiens
ataggtgttcttcaagatgactaatgtcaaaaattgagacatctgttgcggttcatttttttttttttttt

SEQ ID NO: 14861 - DNA, 470 bp, Homo sapiens
agttctgtaaatccctgctgggagcagagactgcgaaaagctgagtccgccgatcgtgcccgggacaaggctgccttccactcgccgcatctacctggtaggcggcatgcgcacgggcttagaggcttgagagcctctggaagagaaagggtcccaggaaggaaacctgcccccggcctaagtgtcggcgcccagatcaccacgaaccccgcacctaggcgccgccaccaagttccaaagaagtccgaggcgacctgggagtcggtcggatcccagccgagaaaagaaacaagcaggatagcaattcttaggggagccaccctgggagttttaggcagcgtttgcctttccctggttttcttcaccadgcsccatcctccccccgcataccacccccagtcaaaagagtggtagawaatgcacagttcgaagtcggtgagagcaaaaatgggtctagtaaatcaacccgt

SEQ ID NO: 14862 - DNA, 103 bp, Homo sapiens
ctgattctaggctggtcactactccgagcctgtgacgtttgcggcagscaggccgtcgacgatgcccagtgaaactctctgggaaattgcaaaagctagaagt

SEQ ID NO: 14863 - DNA, 166 bp, Homo sapiens
tacataaaaaagacatttcagattaacactaatgttacacctcaaggaactggaaaaacaagaacaaacaaaacccaaagctagcagaaaagagatcagaactgaatgaaattgagaccaaacatgcacgcgtgtgcgcgcgcacacacacacacacacacacaca

SEQ ID NO: 14864 - DNA, 470 bp, Homo sapiens
caaggttaacaaggttgatggggaatggtccttgctctcaagaagctcgtaggcggccaggcactgtggcttatgcctgtaatcccagcattttgggaagctgaggcaggtggatcacctgaggtcaagagttcaagaccagcctggccaacatggtgaaacccgtctctactgcaaatacaaaaaattagtagccgggcgtggtggctcacgcctgtaatcccaacactttggtaggccgaggcgagtggatcacctgaggtcgggagttcgggaccagcctgaccaacacggagaaaccctgtctctactaaaagtacaaaattagccagggatggtggcatgtgcctgtaatcccagctatttgggaggctaaggcacaagaatcgctttgaacctgggagacagaggttgcagtgagctgagatcgcaccattgcactcccgcctgggcaacaagagcgaaactcc

SEQ ID NO: 14865 - DNA, 495 bp, Homo sapiens
  misc_feature 367,435,472: n=a, g, c or t
aaacaaaaacaaaaaaaaaaawtcacaccattgctcacagawttggcatctsatttttgggacctcccatctttctgttttgaaaagtgtasagtagtgsagtgttcctgatgtaactttatggcttacaatgttgacatgtctcaggttcatgtgttgcgattggtgttttccgtctcaggwagattgcaaagtgtaggccccacacattggaaaaaataataataaaacaaagcaaaaacaggaaattatggattttatttgtatattggtttatgtatttttyctwaagtatacagtgcactgtttgaaatgtattgttgagtattactttgtacaggttgatcactttttttagagtgaaganagaacaaccttgttttttgtgttttttaaaggaatataaaataatgagggatgtataattgatgccanatargcttgtyctttagtcacaccgasgtcttttttnccctttaggccagttctgttttt

SEQ ID NO: 14866 - DNA, 217 bp, Homo sapiens
agttctagaccagcctggctaacatggcgaaacaccgtctctactaaaaatacgaaaattaggcgtggtggcaaatgcctgtaatcccagctccttgggaggctgaggcacgagaattgcttgaacccgggagccggaggttgccgtgagccgagatcgcgccgtcgcattccaatatgcgcgacagagcgagactccatcgcaaaaaaaaaaaaaa

SEQ ID NO: 14867 - DNA, 444 bp, Homo sapiens
catacagatttaatcctgcgactccccagattaaaaacctttgatgctcctttttgttttttgatacagagtctcactctgtcacccaggtgggagagcagtggcgcaatctcggctcactgcaacctccgcctcctaggttcaagcaattctcctgcctcagcctcctaagtagctgggactacaggcatgcaccaccatgcccagctaatttttatatttttagtatggagtttcaccatgttggccaggctggctttgaattcctgacctcaagtgatctgactgccttggcctcccaaaatgctgggattacggacacgagccaccatgcccagctgatgctcctttttgtagaaggaagtatttgcaccatacaacattctcaccccctctggctgtagcttcccctttcctttccactctgtggtccagcggtgccag

SEQ ID NO: 14868 - DNA, 473 bp, Homo sapiens
ccacattttcgggtattcgttatagtaccactcaattcctctggtaccagttttctatcttagtttgttttgggctactatgacaaaacaccccagactgggtaatttacaataaacaagaatttattttctcacaattctggaggctgggcactctaaaatcaaggggccggcatccatcaaagtccttcttgttgtgttataatatggcagaaggcatcaccaggtagaagggcacagagagtgcaagagaggaagtgaaaaaaaggccagtctcacccttttataacaaacccacttgcatgataatgaagccccacacactccagtcatagcagcattagtccattggtgagcctggagtcctcatgacctaatcatgtctcattaggcttcacttcccaacactattgctttgggggatgtttcctacacacaattttgggggatacattcaaactacagcaaaatct

SEQ ID NO: 14869 - DNA, 69 bp, Homo sapiens; identical to SEQ ID NO: 14105

SEQ ID NO: 14870 - DNA, 276 bp, Homo sapiens
atatgaagagacagatgtgcatgcaaagaaaatgccatgtgacaacgaaggcagagaatggggtgacactgcaaaaggaacatcaaagattgccagcaaaccaccagaagctgggtgaaccatggaacagattcttcctcacagcccctcagaagatatcaatcctgctgatatccttttyctcgamcttctagccttcagaattgctaaagaacctgtactgttatgtagtccgtgcagctattgctccaactgtagccctttttcatgggtgat

SEQ ID NO: 14871 - DNA, 93 bp, Homo sapiens
tdgaactcctgagctcaagtggtctgcctgcctctgtctcccaaaatgctggtattacaggcgtgasaccgtgccaggccgtttttttttttt

SEQ ID NO: 14872 - DNA, 330 bp, Homo sapiens
  misc_feature 325: n=a, g, c or t
aacgtagggctgttcaggtgcattctgccctggctgcgctggggagcttctccctggagaagagcacctggggctgcggccaaggggcatcagcctgggcccgcggagggctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctccctcggatgcttttccatcccaagtgcctgcggangccga

SEQ ID NO: 14873 - DNA, 417 bp, Homo sapiens
tacaatatggagagaagtggtgtattttgaaaacatttggggccgggcgcggtastcacgcctgtaatcccagcactttaggagactgaggggggcgaatcacgaggtcaggagtttgagaccagcctgaccaacatggtgaaacctgtctctactaaaaaaaatacaaaaattaaccaggcgtggcacctgtagtcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgcagtgagcagagatcgtgccactg

SEQ ID NO: 14874 - DNA, 197 bp, Homo sapiens
ctttgggagggcgaggcaggtggatcacgaggtcgggagttcgagaccggcctggccagcatggtgaatgccctgtctctactaaaaacacaaaaaaattagccgggcgtggtggtgggcacctgtgaatctataattacttcaaaataaaaagttgaaaacaaaaaaaaaaaaaaaaaaaaaaaaaaaaaaaaaaa

SEQ ID NO: 14875 - DNA, 112 bp, Homo sapiens
aacttctccagtatcccctcgctgccccgaggaaacccgagcmgcgcgccgsggccacccccagaacctcaaagactctatcgggggccccttccccgtcacttctcaccgt

SEQ ID NO: 14876 - DNA, 154 bp, Homo sapiens
atttacacagggcggtggcgacggcggtggtggtgatggtgacggtgctgtgctacaggtcaagcgattctccwrccatcggcctcccaaggaactggaaccacaggcgcgcgccactgcsccaaggattttcacttttaactgtacagtgaag

SEQ ID NO: 14877 - DNA, 435 bp, Homo sapiens
cacaggcatatcttttaaaatacattttgctcctcaggagtgtattacctagttaagaataactggccgggcgcggtgactcacacctgtaatcccagcactttgggaggccgaggcgggcggatcacgaggtcaggagatcgagaccatcctggccaagttattatttttgaaacagggtcttgctctgtcacccaggctggagtgcagtcatgtgatcatggctcactgcagcctcaacctccgggctcaggcactcagcctctcaagtagctgggactacaggtgtgcaccccaatggctcgctaatttttgtatttcttgtagagacagggttttgccatgttgcccaggctggtcttgaactcctgggctcaagcgatctgcctgccttggcctcccaaagtgtttagctaagattagctactgcgcctg

SEQ ID NO: 14878 - DNA, 463 bp, Homo sapiens
caaggttaacaaggttgatggggaatggtccttgctctcaagaagctcgtaggcggccaggcactgtggcttatgcctgtaatcccagcattttgggaagctgaggcaggtggatcacctgaggtcaagagttcaagaccagcctggccaacatggtgaaaccccgtctctactgcaaatacaaaaaattagtagccgggcgtggtggctcacgcctgtaatcccaacactttggtaggccgaggcgagtggatcacctgaggtcgggagttcgggaccagcctgaccaacacggagaaaccctgtctctactaaaagtacaaaattagccagggatggtggcatgtgcctgtaatcccagctatttgggaggctaaggcacaagaatcgctttgaacctgggagacagaggttgcagtgagctgagatcgcaccattgcactcccgcctgggcaacaagagc

SEQ ID NO: 14879 - DNA, 323 bp, Homo sapiens
  misc_feature 234: n=a, g, c or t
atattagctgtattgtattgtgttttatttatttacttttttgttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttgttagagacagggtttcttcatnttggtcaggccggtcttgaactcccgacctcaggtggtccatccactttggcctcccaaaatgttgggattacaggcattagcaccacg

SEQ ID NO: 14880 - DNA, 302 bp, Homo sapiens
gtatatcctaacaatagtaaaattcaggtgatgctttcttatttttttgtttctggtgatctaaaggatatggacactaatgcattatggatagctcaggtgattttactctcaagcatttttttaagtcaaaattctacacatcagtaatagttatactgccatttgaggtcataacctgacccactgacaaagaagcccagtgatataatattattttcatatgcttcttttacacctctccctgctaattaccatcatgttaccatattcttgccaaaaaaaaaaaaaaaaaaaacccc

SEQ ID NO: 14881 - DNA, 221 bp, Homo sapiens
atcacgaggtcaggagatcgagactatcctggccaacatggcgaaatcccatctctgctaaaaatttgaaaattagctaggtgtggtggtgcgtgcctgtaatcccagctacttgggaggccgaggcacgagaatcacttgagctcaggaggtggaggttgcattgagctgagatcgtgccactgcactccagcctggcaacagagcgagactctgtctca

SEQ ID NO: 14882 - DNA, 269 bp, Homo sapiens
  misc_feature 260: n=a, g, c or t
aaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatcccsggtacttaagtcacactgccaagcsstcggssctgactattgtsttgattgctgttcstttctggttcaaaataaaatcatttttgtggcaccangaaaaaaaa

SEQ ID NO: 14883 - DNA, 432 bp, Homo sapiens
gcagattttttattggccatgatcggtgtcagaattggtaccatgggtgctgcattggcatcttgcagagtgaggcagagctcattgatgagtatgtctgtccacagtgccagtcaacagaggatgccattgcagtgctcacaccactaacagagaaggatgatgaggagttgaagagggtgctctgttccttacagatgagagcccctctgtgtgcagcatttgaaaatgaaatcagctggcataattttggaagcatttctaggatttcaagtttccagtgttaggatttcaagtttccaatcttagagtgattatttactgagtctcagctagtctagtgaagggcttgacaaacttcagtccttcacataccagtgtcatgagctttaccatatccccacaccacctcagcttatctaacactcagat

SEQ ID NO: 14884 - DNA, 60 bp, Homo sapiens; identical to SEQ ID NO: 12480

SEQ ID NO: 14885 - DNA, 462 bp, Homo sapiens
aattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctt

SEQ ID NO: 14886 - DNA, 114 bp, Homo sapiens
tctaaaaccctcttaactggaggtttcctgttttcttcttgttttaactggtggtttccagtaggcaaaataaaatgacaggcatgctagttttttttttttttttttttttaa

SEQ ID NO: 14887 - DNA, 481 bp, Homo sapiens
tttacaaaatgtatttaaaatagctgtcatctcatttgtaaattttgtcgtgtattgtgatatagtgaaccttattgtccttatgaaatggtagctttgtgaaatacattcaccaaaaatcaaaatttgaacatctttatgattccttaccagctgaagccagatagacaggtattaattgagctgatgccccacttgagtttatagactgtttgataactgcctgtcctccaaattgtgtatgtatatgttacgatggtttaattcttgagtcagggccagcacgcatttatattttctaccaattaccttgatagaaatatcttagaaattgctgacctggaacggttgtgagaagactcctggcttctttcttgcctcacttaacaaatattttaaggtcaaagcaatatctgtgcacggctttccttttgctcctccagacaagtgaggctgttggtatagtcctcttcaccctctg

SEQ ID NO: 14888 - DNA, 389 bp, Homo sapiens
  misc_feature 34: n=a, g, c or t
acggggccggctggcgcggctggagctggagcgngcacagctggagatgcagagccagcagctgcgcgagtccaaccagcagctggacctgagcgcctgccggctgaccacgcagttgtaggtgtggctggagggccggtgggggtatgggcgtgtggtggggcagaaagcctagacccaggtggtcctgagctgggtcccaccctccgagccatggtgcccccctgccagctattgacacagctgcgaagtgcccaggaagaggagaaccggcagctgctggctgaagttcaggccctgagccgggagaacagggagctcctggagcgcacgctggagagtcgggaccacctgcaccgcgaacagcgtgagtacctggaccagcttaa

SEQ ID NO: 14889 - DNA, 194 bp, Homo sapiens
aattttccccccttttcagccaaatacagcttttaaaagatcacgtagatcagggttgtccaatcctttggcttccctgaaccacattggaagaggaataattgtcttgggccacagacaaaatacactaacagtagctgataagctttcgaaaaaaaaaaaaaaaaaaaaaaaaaaaaaaaaaaaaaaaaaaa

SEQ ID NO: 14890 - DNA, 240 bp, Homo sapiens
atgagggatcccctttcttaaacctgcaaaaaagtagaacattttggttgggcgtggtggctcacacctgtaatcccagcactttgggaagccgaggcaggcggatcacctggggtcaggagtttgagaccagcctggccaacatggtgaaacccgtctctactaaaaatacaaaaatagccaggcatgttggtgcacacctgtattcccagctacttaggaggctgaagcaggagaatc

SEQ ID NO: 14891 - DNA, 301 bp, Homo sapiens
gaaatacaggtttgctgggtgtggtggctcacgcctgtaatcccagcactttgggaggcctaggtgggcgggtcaccagcccggccgacatagtgaaaccccgtctctactaaaaatacaaaaatcagccagatgtggtggctcatgcctgtagtcccagctacttgggaggctgaggcgggaggatcgcgtgagcctgggaggcagaggttgcagtgagctgagaccacaccactgtactccagcctgggcaacagagtcagactcagtttcaaaaaataaataaacaaacaaaaataaa

SEQ ID NO: 14892 - DNA, 75 bp, Homo sapiens
aaaaaaaaaaaaaaaaaaaaaaaaaaaaaaaaaaaaaaaaaaaaaaaaaaaaaaaaaaaaaaaaaaaaaaaaaaa

SEQ ID NO: 14893 - DNA, 357 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggasttgcagtgagccgagatctctccactgcactccagcctgggcgacagagcgagactccatctcaaaaaaaaaaaaaaaaag

SEQ ID NO: 14894 - DNA, 386 bp, Homo sapiens
cacaggcatatcttttaaratacattttgctcctcaggagtgtattacctagttaagaataactggccgggcgcggtgactcacacctgtaatcccagcactttgggaggccgaggcgggcggatcacgaggtcaggagatcgagaccatcctggccaagttattatttttgaaacagggtcttgctctgtcacccaggctggagtgcagtcatgtgatcatggctcactgcagcctcaacctccgggctcaggcactcagcctctcaagtagctgggactacaggtgtgcaccccaatggctcgctaatttttgtatttcttgtagagacagggttttgccatgttgcccaggctggtcttgaactcctgggctcaagcgatctg

SEQ ID NO: 14895 - DNA, 481 bp, Homo sapiens
  misc_feature 98,229: n=a, g, c or t
cgcggccaatgatgaactcacctggaagaagacaggtccctgctggctggggagcacgtgcctgtcccctcttcggaccctcccaagccctgtccacntagcactccgcctgytctctgcctggcccatgggctccctcgtgggatggtgatgcctgtagggggcctgacgtctgccgctcagagaggcaaggtggggagttaggaaagagctgggccagttctgtgknybccctcggccccctgccccccgccactgctgcccacttcccaggcagcccaggatgtgtactgtcaccggccttaccgcagatccacagcacggagcaaacagcatttggaagtcgtgttcgcagtacttccggccttcaaactgcaaaggggtcgcagagagaggacaagcaaaccacctatcatccccatgagcagccaggccttgttgggtcaggacctgacagcaggggatgaggcacctkagggca

SEQ ID NO: 14896 - DNA, 181 bp, Homo sapiens
catgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctcctgctacagcctcccagtagctaggacaataggtgtg

SEQ ID NO: 14897 - DNA, 485 bp, Homo sapiens
agagcccgacacttgaggagactgttgctcaatttaagaaagcacagctattggaaagccaggaaacagacccagagaggcggatgcatgtgggagcaaagagctttgggcagcctttaaggtaggcattggcgtctgaaatcatgttattgccttttgtttatttgttagatggattttgtattggttttatgctttgttcggtttagagaattttcctttgatggagctgccaatatcaatagatttggttttgaaatcctcgggccgggttcataggataggctggagcccacggtgttagtgtagatgcctcaaagtcagaagagatggatacaaaactggtgatgattttcaaaggagattcacttgcaaatctcactgcaatggagacttgctgggagtcctggtgcctgctgaggcaggcagctcttaggaacctcaggaagtttctgacttaaagagacaggaaaggaaaattgaat

SEQ ID NO: 14898 - DNA, 330 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaacccatctctactaaaaatacaaaaaaaaaattagctgagcatggtggcgggcgcctgtagtcccagctacttgggaggctgaggcaggagaatgacgtgaacctgggaggcggasttgcagtgagccgagatctctccactgcactccagcctgggcgacagagcgagac

SEQ ID NO: 14899 - DNA, 485 bp, Homo sapiens
aatactccttttcctaaaaaactcaagggtttaaaaattgctattttatattttaaatgatattgagcagctacctacaatttctatgtacattttgttccccccccaccaccacccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgta

SEQ ID NO: 14900 - DNA, 285 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctc

SEQ ID NO: 14901 - DNA, 78 bp, Homo sapiens
tcatgagccttttcaactttccagttgatatcttttgtttgcttttttcttttcttatttatttatttatttatktat

SEQ ID NO: 14902 - DNA, 162 bp, Homo sapiens; identical to SEQ ID NO: 14794

SEQ ID NO: 14903 - DNA, 435 bp, Homo sapiens
cagttgtccatactttgctttctcctttctttcccagcccttattagaattttaatttcatatttggccatacatttgtttctttaatagttttctctcccattagtctatgagcccattagggatcacggctattttgtctgctgtatgtaatatccacttcctagcaagcaggacacactcaaggaagagttattgaataataatttaaaaatatttttkattaaatgaaaaatataaatatccaattctaagaatgtgcaattctgtcaggagtgttaagtactgaaaaaacgacagcagattagttaattggttgatttcacaaacatctgtagattgttgacagtgcactatgatgtgctgttctaggtgctgagtacatgtggacgggttgttgcctggctttgcagaggtctcaccttggggagatag

SEQ ID NO: 14904 - DNA, 279 bp, Homo sapiens
ttatatggaaagctcgactctccctttggtaagtccgaagcatgttgtttgttcgaccgtgactgtcttcctcagtctgtgcctgtgattccagtcaccctgtagttactgacagaaattgactggactgtcattgtgtgaagtctaggaggaaatgtccattttaattgtatgatttggtcataagtaaggactatatttatgtcaccattattagatatatgtacttttgtaatgactgtgaaatacacttttccctcactaaaaaaaaaaaaaaaa

SEQ ID NO: 14905 - DNA, 71 bp, Homo sapiens
aaaaaaaaaaaaaaaaaaaaaaaaaaaaaaaaaaaaaaaaaaaaaaaaaaaaaaaaaaaaaaaaaaaaaaa

SEQ ID NO: 14906 - DNA, 297 bp, Homo sapiens
gtacgcgctgaaacgccagggtcgcaccctttatggtttcggcggttgagctgtccccacagcttctctacagactccaaaaggcccttttcagggccccaaactgtcacagaaagagctgttaacacttcctagataacggaccaagtctagctctgccaccgaggctggagtgcagtggcacgatctcgcctcctcctcccgggttcaagcgattcacctgcctcagcttccggagtagctgggattacaggcctgcccaccacgcctggctaatttttgtatttttttkttttt

SEQ ID NO: 14907 - DNA, 370 bp, Homo sapiens
atattagctgtattgtattgtgttttatttatttacttttttgttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttgttagagacagggtttcttcatgttggtcaggccggtcttgaactcccgacctcaggtggtccatccactttggcctcccaaaatgttgggattacaggcattagccaccacgcctggcctatttatttacttattaatggtgtttttttttggttttt

SEQ ID NO: 14908 - DNA, 413 bp, Homo sapiens
taatctggccggccacagtggttcatgcctgtggttaacagctactcgggaggctgatgcagagggactccttggggcccaggagttggagactgtagtgcacagtgatcacacctgtgaatagccactgtacttaagccggggcagcatagcaagaccctgtctctacaaaaaattaaagaattaggtgggtttggtgacatgcacttgcggtcctagctgctcacgaggastaaggtgggagtattactgtaacctcaaactccttgagcctaggagttcgaggttgcagtgagctatgattgtgccactgcactccagcctgggtgataaagcgggaccagaccctgtttttttttttttaaaaaaagtcatatttgttatttgtctaatcttgtgtggagaaggacagc

SEQ ID NO: 14909 - DNA, 386 bp, Homo sapiens
  misc_feature 368: n=a, g, c or t
gaaatacaggtttgctgggtgtggtggctcacgcctgtaatcccagcactttgggaggcctaggtgggcgggtcaccagcccggccgacatagtgaaaccccgtctctactaaaaatacaaaaatcagccagatgtggtggctcatgcctgtagtcccagctacttgggaggctgaggcgggaggatcgcgtgagcctgggaggcagaggttgcagtgagctgagaccacaccactgtactccagcctgggcaacagagtcagactcagtttcaaaaaataaataaacaaacaaaaataaaaaatacaggtttgcagggaggccctgtgggtggggaagcatggdcaaagccattctctcctaatgtngcatgtdaggtagawtgc

SEQ ID NO: 14910 - DNA, 119 bp, Homo sapiens
ctgattactaatgatgtagcgcatctttccatatgcttattggccatttctgtatcttctttggataaaagtctattctgatcctctacccttttctttttttttttttttttgggtga

SEQ ID NO: 14911 - DNA, 302 bp, Homo sapiens
gaaatacaggtttgctgggtgtggtggctcacgcctgtaatcccagcactttgggaggcctaggtgggcgggtcamcagcccggccgacatagtgaaaccccgtctctactaaaaatacaaaaatcagccagatgtggtggctcatgcctgtagtcccagctacttgggaggctgaggcgggaggatcgcgtgagcctgggaggcagaggttgcagtgagctgagaccacaccactgtactccagcctgggcaacagagtcagactcagtttcaaaaaataaataaacaaacaaaaataaaa

SEQ ID NO: 14912 - DNA, 152 bp, Homo sapiens
catgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctcctgctaca

SEQ ID NO: 14913 - DNA, 52 bp, Homo sapiens
asatcggatcgsagggstcccaaaatggcgagtgaygctgcggggactcgct

SEQ ID NO: 14914 - DNA, 50 bp, Homo sapiens
agatcgcgccgctgcgtccagcctgggcgagagagtgagactctgtctca

SEQ ID NO: 14915 - DNA, 76 bp, Homo sapiens; identical to SEQ ID NO: 14831

SEQ ID NO: 14916 - DNA, 78 bp, Homo sapiens
ataggtgttcttcaagatgactaatgtcaaaaattgagacatctgttgcggttctttttttttttttttttscccmcg

SEQ ID NO: 14917 - DNA, 482 bp, Homo sapiens
ctattgtctcaattttaactttccgttctttatttagtttactaaggtagaagtttaggctactgattctggaatttcttcttttctaacacacattggatgctataaatttccttttatgcactacattagctaaataacacaaagttttctaatttttattttcatttagttcaaaatattttctaatttctcttgagacttcttttttgaaccatggtttatttaaaggtgtactgtttaatttcctactatagtcagctttctgtttttgatttctagtttaattcctttgtgatctaagaacgtaatttgtatgatttctattctttttaatttgtgaaggtgtgtttgatggtcctgaatgtggtctgtcttggtgaacattccatgagtgtttgagaagaatgtgcattccgctgttattggatgaaatactctataaatgttaattagatcaagttaattaatagtgctgtgca

SEQ ID NO: 14918 - DNA, 293 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactcctctcaaaaaaa

SEQ ID NO: 14919 - DNA, 496 bp, Homo sapiens
gaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctcc

SEQ ID NO: 14920 - DNA, 59 bp, Homo sapiens
cgggatgaaatgacttgagcgggacagcttgcttccaggcttccggcagcagggsgtgg

SEQ ID NO: 14921 - DNA, 474 bp, Homo sapiens
aaacaacaagttaactgctgttcccagttatatctggtctttcccacccccaaacatacacaaaagatttttgtcattcttggcactggacaacagaagtgataagacatgccagcagaactctaaaggcagaatgtccttccacctgttttatgctgtaagacaaacttccaagtgcgaggcagtgtggagggctgttgccttgaatggcagctgaatgcaccagcgggatccttggcagcaatgccaggcactgaagtcgggcattcaggagagctaaatggagaaaagaaacttgagcaaactgcttcctggaacactgagaacctgaatgggaaattaagaagaaccagattctttctattcttccaccagccaaggtgatgagcacaaaaggatccatcttatacagtgcttgccagcttccataatactactcaccacgatgttgaaatcacctgttccagaaccagt

SEQ ID NO: 14922 - DNA, 195 bp, Homo sapiens; identical to SEQ ID NO: 14704

SEQ ID NO: 14923 - DNA, 113 bp, Homo sapiens
cataaaattccctttaaaaatgtacaattagtggctgggtgtggtggctcatgcctgtagtcccggcgctttgggaggctgaggtaggagaatggcgtgaacctgggaggcgg

SEQ ID NO: 14924 - DNA, 328 bp, Homo sapiens; identical to SEQ ID NO: 14841

SEQ ID NO: 14925 - DNA, 91 bp, Homo sapiens
gcagtcctacttctcctatctctcccagtaaaaaaaaaaaaaaaaaaaaaaaaaaaaaaaaaaaaaaaaaaaaaaaaaaaaaaaaaaaaaa

SEQ ID NO: 14926 - DNA, 84 bp, Homo sapiens
ggttgcagtgagctgagctcaaccttggattctagcctgggtgacagagcgaaactccatctcaaaaaaaaaaaaaaaaaaaaa

SEQ ID NO: 14927 - DNA, 112 bp, Homo sapiens
ctgattactaatgatgtagcgcatctttccatatgcttattggccatttctgtatcttctttggataaaagtctattctgatcctctacccttttctttttttttttttttt

SEQ ID NO: 14928 - DNA, 122 bp, Homo sapiens
tdgaactcctgagctcaagtggtctgcctgcctctgtctcccaaaatgctggtattacaggcgtgasaccgtgccaggccgtttttttttttttggttttttggttstgttggttttaacat

SEQ ID NO: 14929 - DNA, 216 bp, Homo sapiens; identical to SEQ ID NO: 14713

SEQ ID NO: 14930 - DNA, 477 bp, Homo sapiens
atatttggcagattaaacttgacattatcgtaatctttgttttggcaatccatcctttggcttccgtgctcgagccgtttttacccagctgggtacggtgccacgttcaggcacgtgcacccggcaaggttcagggcacatacctacctggggcatgacatctgtcaggtggcaccgagcaggatgcgggatggaccctagataccacagcctgccccctcccctcctttagccaagtcaggatcttaggcctcagcaggcagggacccttccaggccacagtaggctgaagcagcaccaggatcctggcctggcctggcctgtaggtgtcccctggtggttataattctgtaactctaggggagaaggggaatagcactagcattggatgtcgccaaggcccacattttcctgagagaagccacaaaagatgtgcaaatgcccttcagcacaggacctggtgacatgacataaact

SEQ ID NO: 14931 - DNA, 91 bp, Homo sapiens
acatttgagtcagtggactgagtaaggaagatccccctcagtgtgagcaccatccaattggctgaggatagaacaaaaaaaaaaaaaaaaa

SEQ ID NO: 14932 - DNA, 234 bp, Homo sapiens
catgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctcctgctacagcctcccagtagctaggacaataggtgtgagccatcatgcttggggtaaaaaaaaaaaacaaaaccatatatatatatatat

SEQ ID NO: 14933 - DNA, 434 bp, Homo sapiens
atgagcatttggacgttccatttgaagtacctaatgggcacatttggctatttttcaaagagagcatgtagttcaagaaatggcttattttgttttttattcttctttttgtggtctatttaggaaaacaaaatgaaggtggcctttgtctttcagttatggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagag

SEQ ID NO: 14934 - DNA, 313 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaaaaaacccggaaa

SEQ ID NO: 14935 - DNA, 449 bp, Homo sapiens
ttcaaatttccccagttttcccaatattatcctttatacaaatctttttttacaatctaaaatcacatatttcatgtagttgtcatgtctcttcagtctcttttaatctggaacagtttttggccttgctttgtctttcatgacagtgacatttttgaagaatacaggcccattgttttgtccccattgtttccctgtgattcaattaaagttatacatttttggcagagacactacataagcaatttatgttcatcacatcaggacacacctacagtcagtttgtattatttgggaggatgtttttgaccttgatcacttgattaaagtggtttccactagatttgtcctcattttttctccttgtatttaataaataatatgtaggaatatactttgggactgtgtaaatatccgcttctccaataaattttctaccaacttccagc

SEQ ID NO: 14936 - DNA, 62 bp, Homo sapiens; identical to SEQ ID NO: 11091

SEQ ID NO: 14937 - DNA, 144 bp, Homo sapiens
catgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctc

SEQ ID NO: 14938 - DNA, 354 bp, Homo sapiens
cctttccaagcctgcctggacggctgttctgtgacttgacagtggctcccccagccccaaagccagcccccttcatctgtgamttaatctgttgtagtggtgagctgatacattcaggtgtgaccgttggtkaaaacktgtgccccttctgtggtatgcccttgccctgttctataaatatctataaatactacatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcat

SEQ ID NO: 14939 - DNA, 67 bp, Homo sapiens
gttgcagatagtcttgccgcatcttggcaagttgcagagatggtggagctagaaaaaaaaaaaaaaa

SEQ ID NO: 14940 - DNA, 157 bp, Homo sapiens
tytcccttccccagtggacgtctagstggggacagggtatcttggctcccagctggaccagagtgccctgcttgcctctgctctccctttgtggggactcaggcagccagaggccatctsggcaagtctctgagtaggccagagtcctcctgggcag

SEQ ID NO: 14941 - DNA, 431 bp, Homo sapiens
cattcacttatttatttattgagttatttatttttgagacagagtctctatcacacagactggagtgcagtggtgcaatcacagctcatggcaacctaaacctcccaggctcaaaccatctttccacctcagtctcctgagcagctaggaccacaggtgtgtctggctaattaaaaaaaatttttttttaaatttttgtagttatagggccttcctatgttgccaatgctggtctcgaactcctgggctcaagcgatcctcctgctttgtcctcccaaagtactggaattataagtgtgagccaccacagcagtctttttattcattttttattcatttatttattcatktgttggcttactgtcatcagtagtctcatatataattatttttatttcaaattactatctcattcttttcaataaatgcat

SEQ ID NO: 14942 - DNA, 255 bp, Homo sapiens
tagttcttaggaacagactcgatgcaagtbtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgsggsttttcagaagaaatttaatsagtgtga

SEQ ID NO: 14943 - DNA, 328 bp, Homo sapiens
gaaatacaggtttgctgggtgtggtggctcacgcctgtaatcccagcactttgggaggcctaggtgggcgggtcaccagccggccgacatagtgaaaccccgtctctactaaaaatacaaaaatcagccagatgtggtggctcatgcctgtagtcccagctacttgggaggctgaggcgggaggatcgcgtgagcctgggaggcagaggttgcagtgagctgagaccacaccactgtactccagcctgggcaacagagtcagactcagtttcaaaaaataaataaacaaacaaaaataaaaaatacaggtttgcagggaggcsctgtg

SEQ ID NO: 14944 - DNA, 91 bp, Homo sapiens; identical to SEQ ID NO: 14931

SEQ ID NO: 14945 - DNA, 62 bp, Homo sapiens
  misc_feature 13..14: n=a, g, c or t
cttcccagcatgnntytcctatctaaacccrgacttagtttaatttccttatctttcacttc

SEQ ID NO: 14946 - DNA, 95 bp, Homo sapiens
ttttggccgggctggtttcaaactcctgacctcagttgatccacccgcctcagcctcccaaagtgctaggattacaggcatgaaccaccgtgccc

SEQ ID NO: 14947 - DNA, 94 bp, Homo sapiens
  misc_feature 67: n=a, g, c or t
ttgaactcctgagctcaagtggtctgcctgcctctgtctcccaaaatgctggtattacaggcgtganaccgtgccaggccgttttttttttttt

SEQ ID NO: 14948 - DNA, 61 bp, Homo sapiens; identical to SEQ ID NO: 14680

SEQ ID NO: 14949 - DNA, 85 bp, Homo sapiens; identical to SEQ ID NO: 13395

SEQ ID NO: 14950 - DNA, 195 bp, Homo sapiens; identical to SEQ ID NO: 14704

SEQ ID NO: 14951 - DNA, 224 bp, Homo sapiens
atcacgaggtcaggagatcgagactatcctggccaacatggcgaaatcccatctctgctaaaaatttgaaaattagctaggtgtggtggtgcgtgcctgtaatcccagctacttgggaggccgaggcacgagaatcacttgagctcaggaggtggaggttgcattgagctgagatcgtgccactgcactccagcctggcaacagagcgagactctgtctcaaaa

SEQ ID NO: 14952 - DNA, 486 bp, Homo sapiens
  misc_feature 119: n=a, g, c or t
atcagcgctctgtgtctagctaaaggattgtcaatgcaccaatcagcactctgtaaaaacgcaccaatcagtgctctgtgtctagctaaaggattgtaaacacaccaaccagcactckntgaaagggaccaatcagctctctgtaaaatggaccaatcagcaggatgtgggcggggccaaataagggaatataagctggccaactgagccagcagcggcaaccctgttgggtccccttcaatgccgtggacggtttgttcttttgctcttcacaataaatcttactgctgctcactctttgggtcctcactacctttatgaggtgtaacactcaccacaagggtctatagcttcattcctgaagtcagcaagaccacgaacccatcagaaggaagaaactctggacacgtatgaacatctgaaggaacaaactccagacataccatctttaagaactgtaacaccatgagggtctgcggcttcatt

SEQ ID NO: 14953 - DNA, 94 bp, Homo sapiens
ttgaactcctgagctcaagtggtctgcctgcctctgtctcccaaaatgctggtattacaggcgtgasaccgtgccaggccgttttttttttttt

SEQ ID NO: 14954 - DNA, 249 bp, Homo sapiens
ttttttgtttgtctgttttgagacagggccttactgtgtcgcttaggctggatggggtgcagtggtgcagtcacagctcacacagctctgtctcctggacttaagcagtcctcctgccttagcctcccaagtagctgggactacaggtgcatgccaccacacccagtgagtttttctttttaaaaaaaaattttatttgtttattttttgagacggagtctcgctctgtctcaaaaaaaaaaaaaaaaa

SEQ ID NO: 14955 - DNA, 491 bp, Homo sapiens
aagaattaagaagtgaaagatctctacaattaaaactaaaacattgaagaaagaaatcaaagagaacacagaaaaacagaaagatattcaatgtttacagattggaagactcaattattgttaaaacatccatgctacccaaagcaatctgcagattcaatgcaatccctatcaaagtaacaataacattcttcatagaaatagaaaaataatcctaaaatttatatagaatcacaaagtcccagaatagccaaagaggatagcccacaaaagacctacaggctgggcgtggtggctcgtgcctgtaatcccagcacttttggaggctgaggtaggcagatcacttgaggtcaggagttcaagaccagcctggccgacatagtgaaaccccgtctctactaaaaatacaaaaattagctgggcatgggggcacacacctgtaatcccagttactcgggaggctgaggcacaagaatagcttgaacctggga

SEQ ID NO: 14956 - DNA, 501 bp, Homo sapiens
tccactgtttcttttacaggttaactaccctgtaaaattacttaaaaaaaaagtgttaaggcaatgtcatcaacataggctggcattttatgtgcatcctaaaatggaggattcctttccatgtaaacaaggtaaaagaataattattctgtaaaagtcagtttaatctgtttgtatatttgcctcatctatagaaggagctaaagcatacagatgacttaacacttcaaaatacattgatacagtttaattaattttgaagccaaaactagccaaactgtgtgcattaactaccatatttatgatgtagcactgggtatgttctctgcataaatctctgtggttttagtcttgtcccaactttcagccaactgcattcactacttggttggtgcctgtggccttagggctactacatagtcttcagtgcccattcttgatgaaaagtagagaataacctgtataataaacaaacattgtttaactcaaaaaaaaaaaaaa

SEQ ID NO: 14957 - DNA, 216 bp, Homo sapiens
taaccttgatcacttggttaaggcgttgtctaccagagttacccaccgtaagctgctaatttccctttccatactctgttccaggggtgtccaatcttttggctgccctgggacacattggaagaagaattgtcttgggcaacacataaaatacatcattaacactatgacagctgttgagctaaaaaaaaaaaaaaaaaaaaaaaaaaaaaaaaa

SEQ ID NO: 14958 - DNA, 83 bp, Homo sapiens; identical to SEQ ID NO: 14783

SEQ ID NO: 14959 - DNA, 83 bp, Homo sapiens; identical to SEQ ID NO: 14751

SEQ ID NO: 14960 - DNA, 88 bp, Homo sapiens
cttccctgttatctttgtgacccactgatagcagctggtggtcctggtgcggtgagattttgactcttttttttttttttttttgaga

SEQ ID NO: 14961 - DNA, 427 bp, Homo sapiens
  misc_feature 29..30: n=a, g, c or t
aaggacttaagcgccccggagccgggagnnacttgggacccgctggcctcgctcggtgcgcgcctccctccccgcatgcagcccgccgagcgctcgcgagtccccaggatcgacccgtacggattcgagcggcctgaggacttcgacgacgccgcctacgagaagttttwctccagctacctggtcacgctcacccgcagcgattcaaatggtcccggctgctgcagggcgggggcgtccccaggagccggacagtgaagcgctatggtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacaggacctgaaccgg

SEQ ID NO: 14962 - DNA, 89 bp, Homo sapiens
agttggttagcgaagggattcggtgcagatggatggaccgtctgggctgcggagtccacgggcctgaaacgcggtcgctcctgasscgt

SEQ ID NO: 14963 - DNA, 73 bp, Homo sapiens
aaaaaaaaaaaaaaaaaaaaaaaaaaaaaaaaaaaaaaaaaaaaaaaaaaaaaaaaaaaaaaaaaaaaaaaaa

SEQ ID NO: 14964 - DNA, 187 bp, Homo sapiens
ctttttacagctagacctgtgtgctgcaaggagctaaggccttcagtgtccccttccttacccaggtttctcacagaatggattcccagcggaacttgcagaggaactgcggctttaccaatccacccttcttcaggatggtctaaaagatctcctggatgagaaaaaattcatcgattgcacccta

SEQ ID NO: 14965 - DNA, 458 bp, Homo sapiens
ttttctttcttattttacttctcctgatatttcyttctttctttctttcttttttgagacagagtctcgctctgtcgcccaggctggagtgcagtggcactatctcggctcactgcaagctctgcctcccgggttcacgccattctcctgcctcagcctcccgagtagctgggactacaggcgcccgccaccacacccggctaattttttgtattttttagtagagatggggtttcaccgtgttaggcaggatggtctccatctcctgacctcgtgatccgcgcgcctcagcctcccaaagtgctgggattacaggcgtgagcaccgtgcccggcccttttcctgatagttctttaacaacgttaacttatgtaatcagagatcaagctctgattaaagtgaaaatgcatttttaaagggctttttaggattcctttacgatgcaaactccatattaa

SEQ ID NO: 14966 - DNA, 63 bp, Homo sapiens
tcttgtttttagtctcgcttttcggttgccgttgtcttttttccttgactcggaaatgtccgg

SEQ ID NO: 14967 - DNA, 118 bp, Homo sapiens
gcaaaaattagccgggcatggtgacgtgcacctgtagtcccagctactagataggctgaggcaggagaattgcttgaatccgggaggcggaggttgcagtgagccgagatcgtgccac

SEQ ID NO: 14968 - DNA, 58 bp, Homo sapiens
aaccctagtgacaggagccgaagcagcagcgcaggttgtccccgtttcscctsctcct

SEQ ID NO: 14969 - DNA, 328 bp, Homo sapiens
acccaggatgaaaggagtggggtagtggtggatgtggggttgagagggatgtggacaggagagagaaaccttagcatttgaggccttagagagtttgacagcctgagcttcaaatggtcatccccccagctagctaaggttgcgagattgaatcactagtcgacccacccctttcctcctgtacataatgtcactggcttgttgggatttttaatttattctttcactcagcaccaagggcccccgacactccactcctgctgcccctgagctgagcagagtcatttattggagagttttgtatttattaaaacatttctttttcagt

SEQ ID NO: 14970 - DNA, 105 bp, Homo sapiens
attggcgtgctgtagggcgcggtgcactgsgssgtttatcgtcaataggtggaccccttcccggagataaaaccgccggcgccggcgcsgccagtccctctggct

SEQ ID NO: 14971 - DNA, 235 bp, Homo sapiens
atcacgaggtcaggagatcgagactatcctggccaacatggcgaaatcccatctctgctaaaaatttgaaaattagctaggtgtggtggtgcgtgcctgtaatcccagctacttgggaggccgaggcacgagaatcacttgagctcaggaggtggaggttgcattgagctgagatcgtgccactgcactccagcctggcaacagagcgagactctgtctcaaaaaaaaaaaaaaa

SEQ ID NO: 14972 - DNA, 469 bp, Homo sapiens
  misc_feature 263: n=a, g, c or t
aagcatatttgatcactttgattctctgttcttttctctccgcggtgtgtgtgtgcctgcacacctgcaaaacgagggaacaactaaggtggctgaagacctttctggcagggcatttgcaaggacccaaatccattcaacaagggtgcagcctgccacaggstcctcatccggactgaggaagacgaggacagggaggaggaaaacgaggaagaggaggacaaaaaggggggacgagaaggttcttcgtccaaaggaggaangagaagaagtagaaagtgcgaagagctgagttccccacctttttttctattgatgcttcttttttaacaaactacagttttaccgtgtgtttgccatttgagctgtgtggtgggcagggggctggtttgggtttatagggagcttttgttgcacccatgcaggggcaatcagatcagcatcttcatgcaaaaaaaaaaaaaaaaaa

SEQ ID NO: 14973 - DNA, 180 bp, Homo sapiens
taaggaagaccagcctgcctctggtcggttcctggcgctctgstttcgtgaccttgtcagtagaaggctatttaattttcacaactgcttgaattttgacatacaagatgaagcaagatgcctcaagaaatgctgcctacactgtggattgtgaagattatgtgcatgtgggtagaattt

SEQ ID NO: 14974 - DNA, 89 bp, Homo sapiens; identical to SEQ ID NO: 14749

SEQ ID NO: 14975 - DNA, 146 bp, Homo sapiens
ctttctttgcaggtttctgtagccggaagatctccgttccgctcccagcgctccagtgtaaattccccttccccctgggaaatgcactaccttgttttggggggtttaggggtgtttttgtttttcagttgttttgtttttttgtt

SEQ ID NO: 14976 - DNA, 178 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgcagtgagccaggatcgcgccactgcactccagcctgggcgacagagcgagactccgtctc

SEQ ID NO: 14977 - DNA, 403 bp, Homo sapiens
ttttctgaagctgttgttctaattttttccatgcggatgttaaataagaaagagactgatctattttgtggtcctgtcaaaacactatgtccttattagatactgggtgtggtgactcgcgcctgtaatccctgcactttgggaggctgaggccactagatcacttgaggtcgggaattcgagaccagcctggccaacatggtgaaatcctgtctctgccgaaaatgcaaagactggctgggtgtgctggtggacgtctgtggtcccggctactcgggaggctggggcggtagaatcgcttgagcccgggaggtaacggttgcggtgagctgagatcgcgccactgcactccagcctgggcgacagagtgagactccatctcaaaaaaaaaaaaaaaaaawtt

SEQ ID NO: 14978 - DNA, 185 bp, Homo sapiens
aattagaatctgtgtgtatactaatgagctgctttttttctgttgacactatcattatttgtcttattacccaagaggcaattacctgaatttggatgtctgaattataacttatgcaggaatagttctgtaaatacatttaaataaactgtaaagatatttaataaatatagtatttatacaaa

SEQ ID NO: 14979 - DNA, 214 bp, Homo sapiens
caagaaaccaaagtttgcaacttaaatctcagttttcaaacagtaaaagtttgtatagatggcactacagaaaataaaaatggttattcctaccagctccagaaatgtgttacacaatatacactagaagacttttttttttaataatagtattttgtccttaggwagtattgttcctttcaaccaaagactccagaattattgaaaaacaaaa

SEQ ID NO: 14980 - DNA, 413 bp, Homo sapiens
cattcgggaggctgaggcaggagaatcgcttcaacccaggggttggaggttgcagtgagctgagattgcgccactgcactccagcctggtgacaaagcaagactctgtcttaaaaaaaaaaaaaataggccaggcacggtggctcatgcctgtaatcccagcastttgggaggccaaggtgggcagatcacgaggtcaggagatcaagaccatcctggctaacacggtgaaaccccatststactaaaaataaaaaaggaattagctgggcgtggtggtgggmacttgtagtcccagctactagggaggstgaggcaggagaatggtgtgaacccgggaggcggasttgcaghgagcagagatcrcgccaytgmactccagcctgggcgacagagcgagactccatcccaaaa

SEQ ID NO: 14981 - DNA, 448 bp, Homo sapiens
catttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcargcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaggagacgtcctctacataa

SEQ ID NO: 14982 - DNA, 380 bp, Homo sapiens
ctagaaaaacaattacaatggctggctgcagtggctcacgcctgtaatcccagtactttgggaaactgaggcgggaggatagcttgagcccaggcattcaagaccagcctgggcaacatggcaagacctgtctctacaaaagtaaaaaatttagctgggtgtggtggcgcacactgtagtcctagcccactccggagctgaggtgggaagatcacttcagcccaggaggttgaagctgtgtgagccataattgagccatggcactccagtccgggtgacagagggagaccctgtctctacaattcaaatagaccaaagtgctgggactacaggcgtgasaccgcgcccggccgaaaaatcgaacttttaaaacacaaaaa

SEQ ID NO: 14983 - DNA, 217 bp, Homo sapiens
catgagattatgtaatcaaaaggtgctgccatttttaatttttaattttttagagacagagtcttgctttgtcacccaggctggtgtgcaatggtacgatcatagcttgttgcaattttcagccctgggttcaaagtgatcctcctgctacagcctcccagtagctaggacaataggtgtgagccatcatgcttggggtaaaaaaaaaaaacaaaac

SEQ ID NO: 14984 - DNA, 305 bp, Homo sapiens
taagaagatgtttggctgggcgtggtggctcacgcctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtgccaaaa

SEQ ID NO: 14985 - DNA, 507 bp, Homo sapiens
cataaaaatttgtgaggcaagagttcatatttccagtttaaagctgaagaaacaaaggcccagagggattaggtatctttcttacggttgcacagcagtgaatggctcagctggaattcagacccagcctttaactccctacttagagcgatttctatacatggagcttctagcctcactaagtagtttgctggccatttcttttaccatatgtgtactttctgctcatcattatttcatttgagtctttcttttctggtgcagtcaacatgaatttctagttagcaacttagatcatagaattgattttaagaaaagattcgtggccaggcacggtggctcacgcctgtaatcccagcactttgggaggccgaggcaggtggatcacttgaggccatgagtttgagaccagcctggccaacatggtgaaaacctatctctacaatacaacaattagccaggcgtagtgttgcatgcctgtaatcccagctactcgggaggcatgag

SEQ ID NO: 14986 - DNA, 470 bp, Homo sapiens
  misc_feature 368,370: n=a, g, c or t
twgtaattaaccttgaacataggtacgtatgtatagaaaaaaagcagtatatataggtcagtattagctgtgggttcaggcatcatccggggtcttggaacacatctcgggcaatgagaggggactacggtacagtgtgaggggatcagctcctcatcttcagcttcctctacttctcatggggatgctccctgtctctgaacattggtctggccacataattctggcagcagctgcccagagagttacctagccagacgtggacagacatggtacttcctggaagctgaggcagcatgaaggggtcaatctttctctgcaaccctcgattttgtgacatgaagctcattagcaactggaaggcgcanbnaccacaagaaataaagacccctagttggtaacgagagaagagaatgatgcaaacccatagacagatgccaaactgtggaaagaagttttaacatctctgg

SEQ ID NO: 14987 - DNA, 484 bp, Homo sapiens
tttttgtgtccaggcaccagagctgccttgaggctgagatgtgggcctaggactggcctggattctctagcaatgctggaatcagaggccagctagcaattctggttacctctatgctaggtgctcacctcccttgacacttccccaggtcctgacccctccttctcacagggtcccactgtgggcaccacactggaccaggaaagcattctggagccatcgtttgtaatcatcctgcttctcagccggttccactgatgtaaaacaagtttacctgtcaatattgctaacaattagtgagacgggggcaagctgacctcagggaagtaattttgtgtaaacactgcccactctgcttctactattattgattactctaaacttcccacagacataggtgggagtccagggtggctgtctacagtgggaggagggccagccagtgcatagtttaattctgcttgaggttttgcctttccatagg

SEQ ID NO: 14988 - DNA, 363 bp, Homo sapiens
atattagctgtattgtattgtgttttatttatttacttttttgttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttgttagagacagggtttcttcatgttggtcaggccggtcttgaactcccgacctcaggtggtccatccactttggcctcccaaaatgttgggattacaggcattagccaccacgcctggcctatttatttacttattaatggtgttttttttt

SEQ ID NO: 14989 - DNA, 53 bp, Homo sapiens; identical to SEQ ID NO: 12332

SEQ ID NO: 14990 - DNA, 120 bp, Homo sapiens
tttcatatgatctgcagccttttgggtatcaaatgggtcaaaaccatgggacctgccacctcccatcagcaattctggaaatgcactatttctactggtattcttgcttttttttttttt

SEQ ID NO: 14991 - DNA, 433 bp, Homo sapiens
tcaaaatcttaatcgtttttctattttagaaatgcattcggccgtggctcacgcctgtaatcccaacactttgggaggcagaggctggtggatcacctgaggtcaggagttcgagatcaggccaacatggtgaaaccgatctttagtaaaaagtaaaaaaattatctgagcatgatggtgggcgcctgtgatctcagctattcgggaggctgaggcaggagaatcacttgaacctgagaggcggaggttgcagtgggccgagatcgcgccatttcactctagcttggacgacatgagcaacactccgtctcaaaaaaaaaaaccaargtattcggstgggcssagtggstcacacctgtaaycctrgcacattgggaggccaaggcgggtaaattgcctgagctcgggattttgagagcagcctggctaacat

SEQ ID NO: 14992 - DNA, 125 bp, Homo sapiens
catttcagtagtgttaagtacattcggctgggtgcggtggttcacgcctgtaatcccagcactttgggaggccgaggtgggcagatcacaaggtcaggagatctagaccctcctggccaacacag

SEQ ID NO: 14993 - DNA, 113 bp, Homo sapiens
catttcagtagtgttaagtacattcggctgggtgcggtggttcacgcctgtaatcccagcactttgggaggccgaggtgggcagatcacaaggtcaggagatctagaccctcc

SEQ ID NO: 14994 - DNA, 54 bp, Homo sapiens
aaaaaaaaaaaaaaaaaaaaaaaaaaaaaaaaaaaaaaaaaaaaaaaaaaaaaa

SEQ ID NO: 14995 - DNA, 487 bp, Homo sapiens
ttgtwattwamcttgaammwwaggtamskwatgwwwagaaaaaaagcagtatatataggtcagtattagctgtgggttcaggcatcatccggggtcttggaacacatctcgggcaatgagaggggactacggtacagtgtgaggggatcagctcctcatcttcagcttcctctacttctcatggggatgctccctgtctctgaacattggtctggccacataattctggcagcagctgcccagagagttacctagccagacgtggacagacatggtacttcctggaagctgaggcagcatgaaggggtcaatctttctctgcaaccctcgattttgtgacatgaagctcattagcaactggaaggcgcagggaccacaagaaataaagacccctagttggtaacgagagaagagaatgatgcaaacccatagacagatgccaaactgtggaaagaagttttaacatctctggctgcagctgtatctc

SEQ ID NO: 14996 - DNA, 92 bp, Homo sapiens
atcctagcactttgggaggccaaggcaggaggattgcctgagsgccaggagttggatacaagcctgagacattaagcgttaaggatgctttt

SEQ ID NO: 14997 - DNA, 447 bp, Homo sapiens
  misc_feature 420: n=a, g, c or t
tattttctatagaggtgaggtcttgctatgttgcccaagctagtcttgtactcctggcctcaagtgatcctcccatcttggcctcccaaagtgctcagaatacaggcatgagacaccatgcccagccttgatggtattttaaaaataatttgaatagatatttctaacctaactttaaaagttatgatttatttgaggaaaaaaaatatatgtatatatatatttttwagatggagtctcactctgtcacccaggctggaatgcagtagcatgatctcagctcactgcaacctctgtccmttgggttcaagtgattctcctgcctcagcctcccaagtagctgggattacaggtgcctgccaccatacctggctaatttttgtatttttagtagagacagggcttcaccatcttggccangctggtcttgaactcctgracattgtg

SEQ ID NO: 14998 - DNA, 387 bp, Homo sapiens
  misc_feature 167,169,173,226,233: n=a, g, c or t
attttatctctaatcgtcaacacagctgttcttccactgaatttgtgctattgcatacatgtagccatctttcttttcactgcagmagtgtttatsagtagttcaaaatgatttatttgctcctggggagtaaaaccttttttattaaaaaaagaaaaagaaaamananaganagaaagtgtgcccccctcctatgctgcgatastataaaatgattgggtcacanaggtcangtctgcacgtccctgtggtagaccctgctttcacattggagcsttcacactcagcacaaaatgattggaggccttgataaaatggagagcaaagtcttgggagaagtgaaatgggrgttggatcatagagacaggcgstggrgastcgggtact

SEQ ID NO: 14999 - DNA, 166 bp, Homo sapiens
  misc_feature 130,138: n=a, g, c or t
catttcagtagtgttaagtacattcggctgggtgcggtggttcacgcctgtaatcccagcactttgggaggccgaggtgggcagatcacaaggtcaggagatctagaccctcctggtccaacacagtgancaccccgntctctatctacaaaaaaaaaaaaaaaaa

SEQ ID NO: 15000 - DNA, 156 bp, Homo sapiens
gcaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctca

SEQ ID NO: 15001 - DNA, 155 bp, Homo sapiens
gsaaaaattagccgggcatggtgacgtgcacctgtagtcccagctactagataggctgaggcaggagaattgcttgaatccgggagcggaggttgcagtgagccgagatcgtgccactgaactccaacctgcsaatagagcgagactccgtctca

SEQ ID NO: 15002 - DNA, 114 bp, Homo sapiens
cataaaattccctttaaaaatgtacaattagtggctgggtgtggtggctcatgcctgtagtcccggcgctttgggaggctgaggtaggagaatggcgtgaacctgggaggcgga

SEQ ID NO: 15003 - DNA, 169 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgcagtgagccaggatcgcgccactgcactccagcctgggcgacagagcgaga

SEQ ID NO: 15004 - DNA, 67 bp, Homo sapiens
ggccgggagcggtggctcacgcccttaatcccagctctcagggaggctaagaggcgggaggatagct

SEQ ID NO: 15005 - DNA, 245 bp, Homo sapiens
catgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattcttcaaaaaaaaaaaaaaaa

SEQ ID NO: 15006 - DNA, 217 bp, Homo sapiens; identical to SEQ ID NO: 14714

SEQ ID NO: 15007 - DNA, 67 bp, Homo sapiens; identical to SEQ ID NO: 14939

SEQ ID NO: 15008 - DNA, 419 bp, Homo sapiens
cattatagtcattgtagttctatttttataagactgggctctactttgcaattttaagctaaactgatgcacagttaagcattattagttgaaatatgctgtgatctcaattcctatttaaattgtaaggtcttctaatagatggtgttgttggagttcagatacacatgaatttcattttgctagaaatttgctccttttaatgttggggacttaaaagacacccaaggaaaagaagtcatccaaagatataataatgagaaccggaaaagtattttgttaaatttgtatgtgtcattaagataggacctttatgattttgatgttaaacaaatgtaagataaacagcttacaaaaactgtggccatcttggattgtgctgtgagacttccaagcagagacaaaaagactttcacctg

SEQ ID NO: 15009 - DNA, 192 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaaatacaaaaaaaaaa

SEQ ID NO: 15010 - DNA, 446 bp, Homo sapiens
tacaatatggagagaagtggtgtattttgaaaacatttggggccgggcgcggtagctcacgcctgtaatcccagcactttaggagactgaggggggcgaatcacgaggtcaggagtttgagaccagcctgaccaacatggtgaaaccctgtctctactaaaaaaaatacaaaaattaaccaggcgtggcacctgtagtcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgcagtgagcagagatcgtgccactgcactccagtctaaatgacagagtgaga

SEQ ID NO: 15011 - DNA, 365 bp, Homo sapiens
catggctcactgcagcctggatttcccaggctaagtgatcctctaccccagctactcgggaggctgaggcaggagaatcgcttgaacccaggtggcggaggttgcagtgagccaagaacatgccactgcattccagcctggcaacacagtgagacttcatctcaaaaaaacaaaaacaaaaaaactataacaatatgaaatagtgtgacattgtgtcgataagtaatggtatagatggacttctggaaatgattaatgtggaatggagtaggaaatgacttgtgatggaaggaggtcctctcctctgctctagagaagtgagtaggaggcagaagcaggaaggcattcctttgccctgaccacca

SEQ ID NO: 15012 - DNA, 442 bp, Homo sapiens
  misc_feature 57: n=a, g, c or t
caaggttaacaaggttgatggggaatggtccttgctctcaagaagctcgtaggcggnccaggcactgtggcttatgctgtaatcccagcattttgggaagctgaggcaggtggatcacctgaggtcaagagttcaagaccagcctggccaacatggtgaaacccgtctctactgcaaatacaaaaaattagtagccgggcgtggtggctcacgctgtaatcccaacactttggtaggccgaggcgagtggatcacctgaggtcgggagttcgggaccagcctgaccaacacggagaaaccctgtctctactaaaagtacaaaattagccagggatggtggcatgtgcctgtaatcccagctatttgggaggctaaggcacaagaatcgctttgaacctgggagacagaggttgcagtgagctgagatcgcaccattgcactc

SEQ ID NO: 15013 - DNA, 580 bp, Homo sapiens
aaaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgaccttgaaggatgtccttggtgaggattttgaaaatttgatcttcacaagagttgc

SEQ ID NO: 15014 - DNA, 481 bp, Homo sapiens
aagaattaagaagtgaaagatctctacaattaaaactaaaacattgaagaaagaaatcaaagagaacacagaaaaacagaaagatattcaatgtttacagattggaagactcaattattgttaaaacatccatgctacccaaagcaatctgcagattcaatgcaatccctatcaaagtaacaataacattcttcatagaaatagaaaaataatcctaaaatttatatagaatcacaaagtcccagaatagccaaagaggatagcccacaaaagacctacaggctgggcgtggtggctcgtgcctgtaatcccagcacttttggaggctgaggtaggcagatcacttgaggtcaggagttcaagaccagcctggccgacatagtgaaaccccgtctctactaaaaatacaaaaattagctgggcatgggggcacacacctgtaatcccagttactcgggaggctgaggcacaagaatagctt

SEQ ID NO: 15015 - DNA, 408 bp, Homo sapiens
ataactatgtgasattasttagggcataattctaaaatttctgtcctaggagacactagataactctcaaaaacttctgattttcttgcatccctttttggcagagtggtcacagtataatgcgggaggccctcctcccccgaatcagcaacaatttttgctccaccgttttstttcgggaaccagatgcgttttcagaagacagtactccagtgataagcggcgactttgagggattccctctctggsggsctctgcagcagcacagccggcctsattcggggcactgcgagtatggatctccaaggaagaggggtccccagcatcgasagacttcgagttctcctgatgttgttcsatacaatggctcaaatcatggcagaacaagaagtggaaaatctctcaggc

SEQ ID NO: 15016 - DNA, 434 bp, Homo sapiens
tcgcagtggcaaagacttggagtcggcccaggtgtccatcaatgatagactggattaagaaagggtggcgcatatacaccatggagtactttgcagccataaaaaaggatgagttaatgtccattgcagggacatggatgaagctggaggccatcgttctcggcaaactatcacaggatcagagaaccatctgcatgttctcactcataggtgggaggtgaacaatgagagcacatggacacgggaagggaaacatcacacaccagaacgtgtcgcgggdgtaggggggtgggggaggaataacattaggagaaatacctaatgcaggtgatgggttgatgggttcagcaaaccaccagggcacgtgtacatctatgtaacaaaactgcacgttctgcacatgtaacccagaactgaaaagtataattaaacaa

SEQ ID NO: 15017 - DNA, 162 bp, Homo sapiens; identical to SEQ ID NO: 14777

SEQ ID NO: 15018 - DNA, 338 bp, Homo sapiens
aaatcagcggtgggggcggagagccgaggagaaggagaaggaggaggactaggaggaggaggacggcgacgaccagaaggggcccaagagagggggcgagcgaccgagcgccgcgacgcgaagtdaggtgcgtgcgggctgcagcgcagaccccggcccggcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 15019 - DNA, 167 bp, Homo sapiens
ctgttttaattaggttctccctatctctactccctccatattgtttgaaagatggaagtaatttgctaaaggcttttttttttttttwaacagtcttgctttgttgggccaggctgaagtgcagtggcacgatctcgactcactgcaacctccgtctcckgggttca

SEQ ID NO: 15020 - DNA, 500 bp, Homo sapiens
atacaatacctaggaatccaacttacaagggatatgaaggacgttttcaaggagaactacaaaccactgtgcagtgaaatgaaagaggacacaaacaaattgaagaacgttccatgctcttggatacgaagaaccaatattgtgaaaatggccatatggccaaggtaatttctagattcaattccatccccatcatgctaccaatgactttcttcacagaataggataaaactactttaaagttcatatggaaccaaaaaagagcccgcattgccaagataatcctaagccaaaagaacaaagctggaggcatcaagctacctgacttcaaactatactacaaggctacagtaaccaaaacagcgtggtactggtaccaaaacagagatatagaccaatggaacagaatagagccctcagaaataataccacacatctacaaccatctggtctttgacaaacctgacaaaadcaagaaatggggaaaggattccctattt

SEQ ID NO: 15021 - DNA, 195 bp, Homo sapiens
catgagattatgtaatcaaaaggtgctgccatttttaatttttaattttttagagacagagtcttgctttgtcacccaggctggtgtgcaatggtacgatcatagcttgttgcaatkttcagccctgggttcaaagtgatcctcctgctacagcctcccagtagctaggacaataggtgtgagccatcatgcttg

SEQ ID NO: 15022 - DNA, 419 bp, Homo sapiens
  misc_feature 171: n=a, g, c or t
tacataaaaaagacatttcagattaacactaatgttacacctcaaggaactggaaaaacaagaacaaacaaaacccaaagctagcagaaaagagatcagaactgaatgaaattgagaccaaacatgcacgcgtgtgcgcgcgcacacacacacacacacacacacacgatnaatgaaatgaaaagttgattcttggcaaagacaaacaaaattggtaggcaaacaaaagaagagagaggattcaaataagaacaatcagaaactataaagatctgattttatctttaaaatcaggtaaatttaaacttaggggtgcagtggctcaagcatgtaatcccagcactttgggaggctgaggcaggcggatcgcttgaacccaggagtttgagaccagcctgggcaacatagcaaaacaccat

SEQ ID NO: 15023 - DNA, 444 bp, Homo sapiens
ctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgdcggtgctcgtcgggagtgatcacctaccctacaggtggaagattggatg

SEQ ID NO: 15024 - DNA, 81 bp, Homo sapiens
gccggccgcagawattgcagccgctcagcttctaccccctcctgcctttmcttcctctttccttacttccttcccttccct

SEQ ID NO: 15025 - DNA, 66 bp, Homo sapiens
aagaatttgcggtgcaggggccgcggccaccgccttctgtccgcagtgctgcgagccgtaaccacc

SEQ ID NO: 15026 - DNA, 422 bp, Homo sapiens
cgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgggatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggtgctgtagagaaaattcagtgacgtacatggctctggttct

SEQ ID NO: 15027 - DNA, 93 bp, Homo sapiens
ggccgggagcggtggctcacgcccttaatcccagctctcagggaggctaagaggcgggaggatagcttgagcccaggagttcgagacctgcct

SEQ ID NO: 15028 - DNA, 91 bp, Homo sapiens; identical to SEQ ID NO: 14931

SEQ ID NO: 15029 - DNA, 216 bp, Homo sapiens; identical to SEQ ID NO: 14713

SEQ ID NO: 15030 - DNA, 381 bp, Homo sapiens
aacatctataaaatttcctcatacagtcattaaaagcttaaatgaaacaatgtatataaaatgttamacatgtatatatacatatagatacacacctgctaagtatccctcacagatttgtgagaaagaataattaactgtcattaaataacccctgctacaaatctggattataaattgacttctgtagacaccctgaaggatgatgtccatttcttggtagtctctcttgtgccttcacttggagaccctcctgaaggacttagtgcacattttctttttagtctaaattttaagtcagaccaccccaaatatgtcccaaaagttctaagaaactttttaagctatggtaatacaatggtaggcttgattttatttatt

SEQ ID NO: 15031 - DNA, 82 bp, Homo sapiens
cttccctgttatctttgtgacccactgatagcagctggtggtcctggtgcggtgagattttgactctttttttttttttttt

SEQ ID NO: 15032 - DNA, 432 bp, Homo sapiens
gtcacaagggagatgtccgcccccagtcgtagcctcggacggtttctgagcgttggtgtttggcacgcgccaccctctcttgctttggttccgccatgccgatgtaccaggtaaaaccttatcacgggcgcggcgccttctccgtgtggagcttcccacctgcatgtaccggctctctaacgtgcaaggcaggagcggcggcccagcgcccggcgttggccacctacagtctttggtagatgagtggctggatagctacaagcaagaccaggatgcaggatttctggagcttgttaactttttcatctgatcttgtggatgtaaaggactcgggggactatcctctgacagctccaggtctatcctggaagaagtyccagggcagcttctgtgagtttgtggggacattggtctgtcggwgccagtacatcc

SEQ ID NO: 15033 - DNA, 302 bp, Homo sapiens
gggcaaatcacaaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttwaaagcctcctgtttagttttggtttttt

SEQ ID NO: 15034 - DNA, 422 bp, Homo sapiens
tcgcagtggcaaagacttggagtcggcccaggtgtccatcaatgatagactggattaagaaagggtggcgcatatacaccatggagtactttgcagccataaaaaaggatgagttaatgtccattgcagggacatggatgaagctggaggccatcgttctcggcaaactatcacaggatcagagaaccatctgcatgttctcactcataggtgggaggtgaacaatgagagcacatggacacgggaagggaaacatcacacaccagaacgtgtcgcgggggtaggggggtgggggaggaataacattaggagaaatacctaatgcaggtgatgggttgatgggttcagcaaaccaccagggcacgtgtacatctatgtaacaaaactgcacgttctgcacatgtaacccagaactgaaagta

SEQ ID NO: 15035 - DNA, 492 bp, Homo sapiens
aaacaagggaaggaagccttcagctgaggcaggtaagcgccgatcggagggtttgaccgagtggcttagttaaatctctgttttcaccgttttgtaattgagaaaggcatccgcagcagaagccgatttttcagtcggcttccttttgtttaacatagaaagtacctgtattaattttgatgaattagagcatgcagcaaattcaattgaaaatagatttgtatagtaaatgcatttatactgaatgatttctcctccgttttatttaaggagagagatgagaaagatgattttgatcagaatagcactttgcattacgttaaattctaaacggctaacggaaagaaaaataatccaattgatactgcttttgaactccgggacttaaaccctaggagacagctgccatttgaaatkktttcttctaactgaacttctgatgtgttataataatttttcactggaggttttagcaaggggtagagtttattt

SEQ ID NO: 15036 - DNA, 284 bp, Homo sapiens
  misc_feature 282..283: n=a, g, c or t
cacaaaaagatgccaggcactgtgggaggctgaggtaggcagatcacctgaggtcaggagtttgagaccagcctggccaacatggtgaaaccggtctctgctaaaaatacaaaaattagccgggggtggtggcgcatacctgtaatcccagctactcaggaggttgcggtagggaaattgcttgaacccgggagacagaggttgcagtgagctgtgactgcaacactgcattccagcctgggcaacagagtgagactcctcctcaaaaaaaaaaaaaaaaannc

SEQ ID NO: 15037 - DNA, 154 bp, Homo sapiens
gcaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtct

SEQ ID NO: 15038 - DNA, 454 bp, Homo sapiens
ctgaaatgatacctaatttaatccagttttatgtagagacacttgatatatgtagtgttctcttttgttttgaacattataaaaaagaaacaccctagtcttgtcttttctgattagtgtcaaggaatgaagtattttttccattgctaactgttctggcagttattgsacaataagtcatgtgcctatatgtgtaatgtatattgagtaatctttatttttaactggggcttttagatatgttatagttattaaaaaatatctaataggatttgccaaaataatataggataaatcttatggacattatgtattttttaaatggaagtataaaaatttgtctacacttttgcacattgttgatacctgaaagttaatccaagggaaagtttattactgctgagaattaggaaaagaagatatttgggaagactgtagaaatatgaacctagaa

SEQ ID NO: 15039 - DNA, 338 bp, Homo sapiens
ctcggaaaccatgggttattgcagtggcaggtgcacgcttatctttatctgtggcatgcaactgagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacacttttgaaaatgaaaaaa

SEQ ID NO: 15040 - DNA, 431 bp, Homo sapiens
tatgtcacgatttgataggaatgtcaaatgtgataatgctgtgctttcataaattcacctaaatctcaaaymtactgcttttttctgtttttaatatgttaaacaaaaagttccaataagcctgggcaacatacagagacctcatctctactaaaaaaataaaaaaaatggccgggmacagtggctcacacctgtaatcccagcagtttgggaggctgaggtgggtggatcacctgagttcaggagtttgagaccagcctggccaacatggtgaaaccctgtctctactaaaaatacaaaaattagccaggtgtggtggcaggcacctgtagtcccagctactcgggaggctgaggcagggagaattgcttgaacccgggaggcagaggtggcagtgagctgagatgtgccattgcactccagcctgggca

SEQ ID NO: 15041 - DNA, 90 bp, Homo sapiens
catttcagtagtgttaagtacattcggctgggtgcggtggttcacgcctgtaatcccagcactttgggaggccgaggtgggcagatcaca

SEQ ID NO: 15042 - DNA, 503 bp, Homo sapiens
ttttatttttttgatgatagcagctatggataatcattgcctagacccattaattccttggaagttacaaatggtgatattgtaattgtgccatttcttttaaaacaaaacctttttattttattttattttatttttttttagagacagggtcttgctgtcacccatgctagagcacagtggtgcaatcatagcttactgtagcctcaatattttgggctcaagagatctttccacctcagccttctgagtagctgaaactacaggatcttggagtcccacagacctggatttgatttcttgctctgctacttaacagtttcgtatccctggtgagttgtggaatcccctggcccttggattcctcctctgtataatggggcaacacgtgcttgtctatctccagatgtgttgcaaggataataaatgaaatatgagagtgctttgaaaactataaactgcaaggtaaatagtgcagcaagttgttatggattggactggat

SEQ ID NO: 15043 - DNA, 301 bp, Homo sapiens
taagaagatgtttggctgggcgtggtggctcacgctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtmstaggtacttgaggggctgaggcaggaggatggctagaaccttggagattgaggctgcagtgagctgagatggtgtcactgccctccagcctgggtctgggtgacagagtgtgactgtgcca

SEQ ID NO: 15044 - DNA, 248 bp, Homo sapiens
ttttttgtttgtctgttttgagacagggccttactgtgtcgcttaggctggatggggtgcagtggtgcagtcacagctcacacagctctgtctcctggacttaagcagtcctcctgccttagcctcccaagtagctgggactacaggtgcatgccaccacacccagtgagtttttctttttaaaaaaaaattttatttgtttattttttgagacggagtctcgctctgtctcaaaaaaaaaaaaaaaa

SEQ ID NO: 15045 - DNA, 329 bp, Homo sapiens
  misc_feature 298: n=a, g, c or t
atacaatacctaggaatccaacttacaagggatatgaaggacgttttcaaggagaactacaaassactgtgcagtgaaatgaaagaggacacaaacaaattgaagaacgttccatgctcttggatacgaagaaccaatattgtgaaaatggccatatggccaaggtaatttctagattcaattccatccccatcatgctaccaatgactttsttcacagaataggataaaactactttaaagttcatatggaaccaaaaaagagcccgcattrccaagataatcctaagccaaaagancaaagctggaggcatcaagctacctgacttc

SEQ ID NO: 15046 - DNA, 174 bp, Homo sapiens
cgcctctagaaaaacaggcggcgtmrggtgggcagcacgttgccatgatgtgccgtggsccggccgtggctggcgtgatcccaccagagtgagctggagcagatctgcaccatgggccaagtttctcagaaaatacatggsttcmtgagggctgcagctaatgcccacgttcct

SEQ ID NO: 15047 - DNA, 164 bp, Homo sapiens
ctttgggagggcgaggcaggtggatcacgaggtcgggagttcgagaccggcctggccagcatggtgaatgccctgtctctactaaaaacacaaaaaaattagccgggcgtggtggtgggcacctgtgaatctataattacttcaaaataaaaagttgaaaacaa

SEQ ID NO: 15048 - DNA, 431 bp, Homo sapiens
ggcgatggcggcasggcaggtggaggggctggcgcggccgctccctctcgccttccgaggctgcctggctggcgcgctgctcggggactgcgtgggctccttctacgaggcccacgacaccgtcgacctgwsgtsagtcctgcgtcatgtccagagtctggagccggaccccggcamrcccgggagtgagcggacagaagccttgtactacacagatgacacagccatggccagggccctggtgsagtccctgctagccaaggaggcctttgacgaggtggacatggctcacagatttgctcaggagtacaagaaagaccctgacaggggctatggtgctggagtagtcactgtcttcaagaagctcctggaccccaaatgtcgcgatgtctttgagcctgcccgggcccagtttaacgggaaaggctcct

SEQ ID NO: 15049 - DNA, 84 bp, Homo sapiens; identical to SEQ ID NO: 14926

SEQ ID NO: 15050 - DNA, 465 bp, Homo sapiens
  misc_feature 153: n=a, g, c or t
atagaaacgagcagaaggaggtgggtggctggagaaggaggcgggtcgggatcggggagtggggaggaggcagcggtggagggagctggctcctgcagttctggcgctgctgccttcctgagtgagcggtggagggaaccctagaggacagancccccagcccggcagcaggccccctctccgcccgccaccacggaggagaaggaggacagccagcccctccagccctggcctggcccagcgggggcagtaagctcctacttgcccccagcttggtgcccacacgggcccagtgcatgagcagccgagcctgctaaccgcagctccgcacttgtccatccccctgcggctacaccatgtccagctcctacgatgaggcctcactggcgccagaggagaccaccgacagcttctgggaggcaggtacagcacagcctttctcagctgttcctatttccctcgctc

SEQ ID NO: 15051 - DNA, 284 bp, Homo sapiens
gttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccct

SEQ ID NO: 15052 - DNA, 474 bp, Homo sapiens
  misc_feature 403..404,465: n=a, g, c or t
aagaattaagaagtgaaagatctctacaattaaaactaaaacattgaagaaagaaatcaaagagaacacagaaaaacagaaagatattcaatgtttacagattggaagactcaattattgttaaaacatccatgctacccaaagcaatctgcagattcaatgcaatccctatcaaagtaacaataacattcttcatagaaatagaaaaataatcctaaaatttatatagaatcacaaagtcccagaatagccaaagaggatagcccacaaaagacctacaggctgggcgtggtggctcgtgcctgtaatcccagcacttttggaggctgaggtaggcagatcacttgaggtcaggagttcaagaccagcctggccgacatagtgaaaccccgtctctactaannatdcaaaaattagctgggcatgggggcacacacctgtaatcccagttactcgggaggctgnggcacaaga

SEQ ID NO: 15053 - DNA, 548 bp, Homo sapiens
tttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaagagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtatgggatcacctcaccatgccatgctctgggctctccctctctgt

SEQ ID NO: 15054 - DNA, 349 bp, Homo sapiens
attgaataatgttgtttccctgsttcactatctcttcccatatctgtgatagctcttccacttcaagaatgaaatcaaggccaggtgcagtagctcatgcctgtaatcccagyactttkggakgstgaggtggatggatcamstgaggtcaggagttcaagascagctaggcsaacatggcaaaaccccatctctastaaaaatgcaaaaattatctgggsgttgtggtgggtgcmtgtaatcmsagctastcgggaggstgaggcaggagaatcacttgastcagggaggcagaggttgcagtgagccgagatcatgccattgcactccagcctgggcgacaagagtg

SEQ ID NO: 15055 - DNA, 310 bp, Homo sapiens
taagaagatgtttggstgggcgtggtggctcacgctgttaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtgccaaaaaaaaa

SEQ ID NO: 15056 - DNA, 113 bp, Homo sapiens
gcaaaaattagccgggcatggtgacgtgcacctgtagtcccagctactagataggctgaggcaggagaattgcttgaatccgggaggcggaggttgcagtgagccgagatcgt

SEQ ID NO: 15057 - DNA, 74 bp, Homo sapiens; identical to SEQ ID NO: 14705

SEQ ID NO: 15058 - DNA, 464 bp, Homo sapiens
caaggttaacaaggttgatggggaatggtscttgctctsaagaagctcgtaggcggccaggsactgtggcttatgmmtgtaatsccagcattttgggaagctgaggcaggtggatcacctgaggtsaagagttcaagaccagcctggcsaacatggtgaaacccgtctctactgcaaatacaaaaaattagtagccgggcgtggtggctcacgctgtaatcccaacactttggtaggccgaggcgagtggatcacctgaggtcgggagttcgggaccagcctgaccaacacggagaaaccctgtctctactaaaagtacaaaatymgccagggatggtggcatgtgcctgtaatcccagctatttgggaggctacggcacaagartcgctttgaacctgggagacagaggttgcagtgagctgagatcgcaccattgcactcccgcctgggcaacaagagcgaa

SEQ ID NO: 15059 - DNA, 468 bp, Homo sapiens
atcagcgctctgtgtctagctaaaggattgtcaatgcaccaatcagcactctgtaaaaacgcaccaatcagtgctctgtgtctagctaaaggattgtaaacacaccaaccagcactctgtgaaagggaccaatcagctctctgtaaaatggaccaatcagcaggatgtgggcggggccaaataagggaatataagctggccaactgagccagcagcggcaaccctgttgggtccccttcaatgccgtggacggtttgttcttttgctcttcacaataaatcttactgctgctcactctttgggtcctcactacctttatgaggtgtaacactcaccacaagggtctatagcttcattcctgaagtcagcaagaccacgaacccatcagaaggaagaaactctggacacgtatgaacatctgaaggaacaaactccagacataccatctttaagaactgtacaccatga

SEQ ID NO: 15060 - DNA, 91 bp, Homo sapiens; identical to SEQ ID NO: 14931

SEQ ID NO: 15061 - DNA, 162 bp, Homo sapiens
  misc_feature 135: n=a, g, c or t
catttcagtagtgttaagtacattcggctgggtgcggtggttcacgcctgtaatcccagcactttgggaggccgaggtgggcagatcacaaggtcaggagatctagaccctcctggccaacacagtgacaccccngtctctactacaaaaaaaaaaaaaaaa

SEQ ID NO: 15062 - DNA, 399 bp, Homo sapiens
agttcctagcgaggwggcgccgcsgccattgccctctctcggtgagcgcascccgctctccgggccgggccttcgcgggccaccggcgccatgggccagtgcggmatcacctcctccaagaccgtgctggtctttctcaacctcatcttmtggggggcagctggcattttatgctatrrwgggagcctatgtsttsatcacttatgatgactatgaccacttctttgaagatgtgtacacgctcatccctgctgtagtgatcatagctgtaggagcsctgcttttcatcattgggctaattggctgctgtgccacaatccgggaaagtcgctgtggacttgccacgtttgtcatcawmmtgstcttggtttttgtcacagaagtttgttgtagtggttt

SEQ ID NO: 15063 - DNA, 126 bp, Homo sapiens
aagataaaatttgaaatctgttaggctggtgttagggttctttgtttttgaggtttggcagagatgtgtttaagtgctgtgscagaagcggggggaggggggggtttggtggaaattttttgttac

SEQ ID NO: 15064 - DNA, 72 bp, Homo sapiens
aaaaaaaaaaaaaaaaaaaaaaaaaaaaaaaaaaaaaaaaaaaaaaaaaaaaaaaaaaraaaaaaaaaaaaa

SEQ ID NO: 15065 - DNA, 477 bp, Homo sapiens
ctacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttagtgatggagaagagtgctcacagacagttcccagtaaggt

SEQ ID NO: 15066 - DNA, 70 bp, Homo sapiens
ataggtgttcttcaagatgactaatgtcaaaaattgagacatctgttgcggttctttttttttttttttt

SEQ ID NO: 15067 - DNA, 445 bp, Homo sapiens
ttattgggtttttggaaatttaaggctaggcttgttgcttttccagccacagagcatggtaaagtaaatgaaacccgacagatttcattgttcggatgctgatcacagcttggcacacatggaattcaatgtgtctcttacatgcatattgagcccgtgtttaaaatagtataagtgagtaagaaaaatttaagtacaggcaactaaagaatgatttgcaactacaaatgaaagtagcttggatctttgaaggctaagtccatggttggttaggcagggtgagattgcataaatgaatcagcaggcagactttgccctaaagctgagtagaaaatgaagtatggaaatgatgcataggctttggggaagcctgggaagtgtaggattgattttgatttgtgtctttgtccagctctagagttgattggattcttgctgggggagg

SEQ ID NO: 15068 - DNA, 281 bp, Homo sapiens; identical to SEQ ID NO: 14775

SEQ ID NO: 15069 - DNA, 436 bp, Homo sapiens
  misc_feature 102: n=a, g, c or t
actatgtgcttccggtctccaataccgcagagggcggtcttccccggctcgccaactcggctgctctgggggattcgtgcgcggtaagaagctgcgcggtangtgagaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatcttccatttcagaaatcgcccttacgttttcttgtctgctc

SEQ ID NO: 15070 - DNA, 491 bp, Homo sapiens
ccttaatgtattgctctttaacatttaataaaactattttaaatttttagaatataatccttaacataattatcatgtagaaatcacttagttcaattgtgagttttttaatgtgggaattggtttagtctcattttctattttacagtttctagtgttgaccggtagaggcttagtcacagaatatctattaaattttgctagttgtatggtgtaaaagtgctgaaggatacttgcatgtttggcctgtatgtcaatattgtatttctccctgaggatctcttacttcagttcccacgccaatctttaaatgtaaatgtcattgcctatggttgctgtggactcagtgctaccagaaatatttttaagagtattatttaatagattttatatttcctttcatatggctagtctttcacacagctgtcagcactgttaaggcatttgtatgtcaaaatatatgctaaatatcacgtatatctttttaggaa

SEQ ID NO: 15071 - DNA, 478 bp, Homo sapiens
  misc_feature 250: n=a, g, c or t
caggaaaccagaaattgtcaggatcgaggattatgggaaaagagtaaaagcctagctgtcagatctgaggttccaccaaggagcactgatgggtgcttctcattaggaaggcggtgcggtggctcacacctgtaatcccagtactttgggacgccgaggtgagtggatcacctgaggccaggagttcgagaccagcctggccaacatggtgaaacgtcatctctattagaaatacaaacattagctgggngtggtgatgggtgcttgtaattccagctattcaggaaaccaaggcaggagaataacttgaatccacgaggcagagtttgcagtgagccgagattgctccactgcactccagcctgggcaacagagcaaaaactgcatctcaaaaaaataaaaacaaaaaaacagaggggataccagttcccagcactccaggcctaacttcatagcactcacatcatgtcaagtgagt

SEQ ID NO: 15072 - DNA, 425 bp, Homo sapiens
tcatgtaatctgagactcttgaactttatgacggakyttcaatattttgatgtatatgaaacttttgttaaatatgttgtatacttcgctggctgtgtgaagtaaactaaaactctgatgaacactttggagtctgctttaaggaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgta

SEQ ID NO: 15073 - DNA, 75 bp, Homo sapiens
  misc_feature 70: n=a, g, c or t
aaaaaaaaaaaaaaaaaaaaaaaaaaaaaaaaaaaaaaaaaaaaaaaaaaamaaaaaaaaaaaaaaaaanttttt

SEQ ID NO: 15074 - DNA, 406 bp, Homo sapiens
tacaatatggagagaagtggtgtattttgaaaacatttggggccgggcgcggtastcacgcctgtaatcccagcactttaggagactgaggggggcgaatcacgaggtcaggagtttgagaccagcctgaccaacatggtgaaacctgtctctactaaaaaaaatacaaaaattaaccaggcgtggcacctgtagtcccagcactttggcaggttgaggcaggtggatcatttgaggtcaggagtttgagaccagcctggcccacatggtaaaaccccgtctctactttaaaaaatacaaaaattagctgggcggtagtggtgcatgcctggaatcccagttactccagaggctgaggcaggagaatcacttgagcctgggaggcagaggttgacagtgagcagag

SEQ ID NO: 15075 - DNA, 177 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgcagtgagccaggatcgcgccactgcactccagcctgggcgacagagcgagactccgtct

SEQ ID NO: 15076 - DNA, 418 bp, Homo sapiens
atcagcgctctgtgtctagctaaaggattgtcaatgcaccaatcagcactctgtaaaaacgcaccaatcagtgctctgtgtctagctaaaggattgtaaacacaccaaccagcactctgtgaaagggaccaatcagctctctgtaaaatggaccaatcagcaggatgtgggcggggccaaataagggaatataagctggccaactgagccagcagcggcaaccctgttgggtccccttcaatgccgtggacggtttgttcttttgctcttcacaataaatcttactgctgctcactctttgggtcctcactacctttatgaggtgtaacactcaccacaagggtctatagcttcattcctgaagtcagcaagaccacgaacccatcagaaggaagaaactctggacacgtatgaacat

SEQ ID NO: 15077 - DNA, 349 bp, Homo sapiens
cttttgggttgggggcgactttgtggggagcctagctgctgctgggcgtttaccgcgggagcccttagcggtctggagctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggtattctcatcagtatcaggggaaatctaaatttccgattctaggatttcctgttttgtctataatataaattatttgaatcaaaaaaaaaaaaaaaaa

SEQ ID NO: 15078 - DNA, 75 bp, Homo sapiens
tgcttagccctaaacctcaacagttaaatcaacaaaaaaaaaaaaaaaaaaaaaaaaaaaaaaaaaaaaaaaaaa

SEQ ID NO: 15079 - DNA, 177 bp, Homo sapiens
tgcctgccctcccttggttccagtctctcttctctctctctgccttggaacctgaccatactttagttgtgcccttcccaggcatcatcctcctaccaccaacctggggcctcatcttggaagtgggggctccttggggccagcccatgtgtggctcaccacactcttctttttttt

SEQ ID NO: 15080 - DNA, 484 bp, Homo sapiens
cacaatttacgtacttacataattccaagatcagtattatttttctcaggtgatgcactggaatctcagcaggagggggtagttagagaagttaatgatgcaatttatgacaaaattatttatgataattggatggctgcaattgaggaagttaaagcttgttgcaaaaaccttgaggcattagtagaagacattgatcgttagagcagagtatacatggccctgaaattaactgccctagatatagttactcaaggtataagaagccttgtgttctgtatttttcttgtagtgttagttaaaacatatgtttcaaaaatataagaaaagttcaaaaactaattaatttgaccttgagttttagtagtagaatgttttcaagaaatgtacactgtggtaaatgatttaaaacactagtatagtgttgtgtagcttaatccttctgaagtctttttgtcatgtagctattaatctgtggctatga

SEQ ID NO: 15081 - DNA, 409 bp, Homo sapiens
  misc_feature 241,256: n=a, g, c or t
attctcccgcctcagcctccctcagcgtccggagtagctaggactacaggcgcccgctaccacgcccggctaatttttttgtagttttagtagagacggggtttcaccgtgttggccaggatggtctccatctcctgacctcgtgatccgcccgcctcggcctcccaaagcgttgggattamaggagtgagccaccgcgcccggycggtcacagtgtccatgtaactaactcctggttaanaggatatggatakwnggcacatgttcaacttctggcttctgtccttgawaagtgtgatgattccatcctttgctgtcttccttcccgctgactggaatgtggacttggtagtgagctaccttggactatgtggatgaagacaaagataaaaggaaccaaggagttagt

SEQ ID NO: 15082 - DNA, 189 bp, Homo sapiens
cataaaattccctttaaaaatgtacaattagtggctgggtgtggtggctcatgcctgtagtcccggcgctttgggaggctgaggtaggagaatggcgtgaacctgggaggcggasttgacagtgagccaggatcgcgccactgcactccagcctgggcgacagagcgagactccgtctcaaaaaaaaaa

SEQ ID NO: 15083 - DNA, 321 bp, Homo sapiens
taaaagagctctggamatcsgagaaaaggttttggggaaggatcaccccgatgttgccaagcagttaaataacttggccttactgtgccagaaccagggcaagtatgaagaagtagaatattattatmaaagagccctcgagatctaccagacaaaactgggacctgatgaccccaacrtggctaagacgaaaaataacctggcatcctgctatttgaacaaggaaagttcaggcaagcagmamcactgtacaaagagmttctcactcgtgcacatgaaagggagtttggttctgtagatgatgaaaatamscccatctgg

SEQ ID NO: 15084 - DNA, 77 bp, Homo sapiens
ctttgatacgggagttcctccttgctctcgcssctactctttctggtgttagatcgagctaccctctaaaagcagtt

SEQ ID NO: 15085 - DNA, 436 bp, Homo sapiens
taaaatcatctagggggcttgattaaattacacgtcatacctctaccctsagtaattttggttcagctggttcgagatggggatgctgtctgcagtcttcaacaagcatcttgaagtttctgttttgaatgaccagtccacactggtcattttgagaagtgtacctttaaggatattcacaagaaatggtggtatatattaaggtagttccaaaagagaaattccaaaaatgttctggtcaacagggatataagtggcatgtattgtgcctccttggggtgactattctcttgtagatgatgcttatttagaataaaatgttcagttttatttttaaaaagaatcagccggccaggcacggtggctcatgcctgtaatcctagcactttgggaggctgagttgggcagattgcctgagctcaggagttcgagacca

SEQ ID NO: 15086 - DNA, 255 bp, Homo sapiens
atgtttgtttgtttttgagacagagtctctctctgtcaccaggctggagtgcagtggcacaatctcggctcactgcaacctctgcctcccaggttsgggsgattctcctgcctcagcttccctaatagctgggactgcgggtgcccatcaccacgcccagctaatttttgtatttttartgaagacgggggtttcgmcatgttsgccaggatggtctcgatctcttsgccttgtgatccacccgcctcgacctcc

SEQ ID NO: 15087 - DNA, 132 bp, Homo sapiens
atttccagcggttgctgttctgacgggttgtagtctgccaggacaatgagttatgactaccatcagaactrgggccgtrawgggggtccccgmarctcmgrtgggggcwatgraggggggcmagcagggggt

SEQ ID NO: 15088 - DNA, 373 bp, Homo sapiens
cttttgggttgggggcgactttgtggggagcctagctgctgctgggcgtttaccgcgggagcccttagcggtctggagctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgcaccagtgaaagtcatctcagctggtattctcatcagtatcaggggaaatctaaatttccgattctaggatttcctgttttgtctataatataaattatttgaatcaaatacagcattcttttaagaggaaaaaaaaaaaaaaaaag

SEQ ID NO: 15089 - DNA, 162 bp, Homo sapiens; identical to SEQ ID NO: 14777

SEQ ID NO: 15090 - DNA, 79 bp, Homo sapiens
aaaaaaaaaaaaaaaaaaaaaaaaaaaaaaaaaaaaaaaaaaaaaaaaaaaaaaaaaaaaaaaaaaaaaaaaaaaaara

SEQ ID NO: 15091 - DNA, 98 bp, Homo sapiens; identical to SEQ ID NO: 12160

SEQ ID NO: 15092 - DNA, 78 bp, Homo sapiens; identical to SEQ ID NO: 14824

SEQ ID NO: 15093 - DNA, 342 bp, Homo sapiens
attacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaacccatctctactaaaaatacaaaaaaaaaattagctgagcatggtggcgggcgchtgtagtcccagctacttgggaggctgaggcaggagaatgacgtgaacctgggaggcggacttgcagtgagccgagatctctccactgcactccagcctgggcgacagagcgagactccatctcaaaa

SEQ ID NO: 15094 - DNA, 445 bp, Homo sapiens
agtacggtgtgtggagctggagcaccgtgagaagaagcgaggttctttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacggtggactttgtcgcccctgatgatcgagttgtcttccgcacctgtgaaagagagcagaacagggtggtcttccagatggggacttcagacgcagag

SEQ ID NO: 15095 - DNA, 351 bp, Homo sapiens
ttttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagagggtccaagcgg

SEQ ID NO: 15096 - DNA, 371 bp, Homo sapiens
  misc_feature 281: n=a, g, c or t
agagaaagatgttccaggcagagggaagaggcctctttcctccaggcctggagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcasatttataatcctggtgctcatgggcactgggcattcttagctgcgggaggcactgccganagcctgaaactctgcctgctctgccaagacaagaactttcttctttacraccagcgctccagataacctcagggaaccagcacttcccaa

SEQ ID NO: 15097 - DNA, 506 bp, Homo sapiens
aacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcarctgtcaaacttgaatgtgtaagtccccacagagcatggacagtcggtgcagagttccaaggaaacaattattgcctgatgaccacttccattttgtatacactctttggttcgt

SEQ ID NO: 15098 - DNA, 520 bp, Homo sapiens
cgaaaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattctctcctgctgaatgacatgcgactgtaaagcctctttataaaccatttccaatgttagtatataggattatttgggaagcatatcaatacctttatagacacatatgaacatgtatgcacacaaaacatttaactatggtatttatggaagacaggtaacaaacattaaaatctagtttgcatttccc

SEQ ID NO: 15099 - DNA, 450 bp, Homo sapiens
actacaaccaaattaatccagcaagctaaggctcagatcactgtggatatgtccaaatcctccatgagtgtttaaaacaactaatttaagagagaaaaagaaaatctatgcctgtatccccattgccttatctacattgggttttatgagcacattattattaatttgaggaatagtttgtttcttaactttattctagcatttattccatggagataaaatgtattatgaaaacatgaatggagtgcttttaaaagacatttttcatggcaagtgaggaattgatttgagccaatttttctcgtattcaactgtgaaatagaatccaatataacagcaaagtcattagatctctcatctgagtgtgagtgtcctaattgtttggagggtcctccgaatgagtctgattggaacacctgttccaacgagagtggtaatggctcttgacat

SEQ ID NO: 15100 - DNA, 440 bp, Homo sapiens
  misc_feature 207,216..217: n=a, g, c or t
ttctttttaaaatttctccttcctttgttcttcatcctttctttctgttataaacattcacatatttacaaagctcatcaataagtgcaagcagtaatgggattgggcaaagcaaaatgttgaattgtgagataaaaagaatcactttttgtttactagagaaattgaaatataacagaataacaatagattattttaaatgcctrntagctatannttgtactttccattagttatataaaacaatggttttgggggcaaaaaaaagaagcaagttctgaagtdcactcttgattgcacccaccctgtagaatcatggatgctgccaattttgagcagtttttgcaagaaaggatcaaagtgaacggaaaagctgggaacttggtggaggggtggtgaccatcgaaaggagcaagagcaagatcaccgtgacatccgas

SEQ ID NO: 15101 - DNA, 573 bp, Homo sapiens
ttttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaactgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctga

SEQ ID NO: 15102 - DNA, 290 bp, Homo sapiens
aagtgggcgtgtcttcagacaaaggtggctttgctttgttgaagttactgatataaagatcagcgcctgaaacagattctccgggatattaccggagacggagtgttttattattagcctttcttaggtggacatttccatttgaattaaaagtcctttaggctgggcgtggtgcatggctgtaatctcagcaccttgggaggctgaggcaggaagatcacttgaggccaggcgttggagagcagcctgggcaaggtggcaagaaccttgtctctacaaaaaaaaaaaaa

SEQ ID NO: 15103 - DNA, 489 bp, Homo sapiens
aacacacgtagcggccaagatggcgctasggttggagcaggggctctgctgcgacctttacggtagtgaggttagggacgatgggagagcagctttgttcctgaagtgccgtcgaggattaggatcgagtttcttcgatcgtgagggcaattattagtggcctctaggcccccagatggcatcttgaggagagagaatccacgctacgagaactaacatagtggacatcgcagttgtccgtagccgatttgcgggttacggagttgttgcaagtaaagaaggggaaatccgagcgttctcgcgttggatttcctccacgtgtgaagtgggaatggtagtgatatctcgtgctatctctgtcaagggcaagaaggagaaggaatttatttgaggccctacgacgtggtgcggtggctcacgcctgtaatcccaacactttgggaggccgaggcaggcggatcatctgagatcgagagttcgagaccagct

SEQ ID NO: 15104 - DNA, 368 bp, Homo sapiens
aagaatatttgtggttctactgactgaagtgatcctatcttgtgactcatgcatggcacgtctataagtcaagctggaatcctctaaaataagtcacatgggaaaaaattctgatcttattctagacgaagaatgaaaagccaggaagctacataacccaagggtccccagtttgaaatgtcttgttactgctgacaagacctgcatgactgaccatttgctccctaagatatgaaaactgaccttgctttgaagttcaaaatgacattgccaaaacaagaagaaatggaaaataactgcagcacgtttatgacattcgtttctttctccacatgaaacatacaatgagaacactcaaaaaaaaaaaa

SEQ ID NO: 15105 - DNA, 454 bp, Homo sapiens
agtaagcagtcaagaatatttgtggttctactgactgaagtgatcctatcttgtgactcatgcatggcacgtctataagtcaagctggaatcctctaaaataagtcacatgggaaaaaattctgatcttattctagacgaagaatgaaaagccaggaagctacataacccaagggtccccagtttgaaatgtcttgttactgctgacaagacctgcatgactgaccatttgctccctaagatatgaaaactgaccttgctttgaagttcaaaatgacattgccaaaacaagaagaaatggaaaataactgcagcacgtttatgacattcgtttctttctccacatgaaacatacaatgagaacactttatagatgaattgtgtcttcgattgaatagggaatggtggactagctttggttttatggaattggataatttgtcatagtttctgtc

SEQ ID NO: 15106 - DNA, 405 bp, Homo sapiens
atttttgtggttctactgactgaagtgatcctatcttgtgactcatgcatggcacgtctataagtcaagctggaatcctctaaaataagtcacatgggaaaaaattctgatcttattctagacgaagaatgaaaagccaggaagctacataacccaaggattttagcacatggaagaaatgtccctacccatgcatacagaaacgcataagaacaggaagtgacgtattgtttatcaggaaaaacagtattcatgtattatttacaaaaattgaggctgatctccaagctctactgtggaaagagttcatcaagttcctagactgaagaaagctaattgtaagaaatacatatgtagtatgcacaagtttcattataaataagagtaaaaacgtgcattgtatat

SEQ ID NO: 15107 - DNA, 406 bp, Homo sapiens
aagaatatttgtggttctactgactgaagtgatcctatcttgtgactcatgcatggcacgtctataagtcaagctggaatcctctaaaataagtcacatgggaaaaaattctgatcttattctagacgaagaatgaaaagccaggaagctacataacccaagggtccccagtttgaaatgtcttgttactgctgacaagacctgcatgactgaccatttgctccctaagatatgaaaactgaccttgctttgaagttcaaaatgacattgccaaaacaagaagaaatggaaaataactgcagcacgtttatgacattcgtttctttctccacatgaaacatacaatgagaacactcaaaaaaaaaaaaaaaaaaaaaaaaaaaaaaaaaaaaaaaaaaaaaaaaad

SEQ ID NO: 15108 - DNA, 337 bp, Homo sapiens
tagaatctgaggaaatgtcagttaacaaaactacaggtttcagccctttctgatctagtctgagctcctctcccagaaggaaactgctacttcctgcacagtttgagcacaaaaatatcaatgtaaccatataaggaaaaattacagcaaatgcctgggaagaaggagccccagatgccatgaaagtgtatagtgggggaactggtctgcggggtcaggagagcctctttgtggaagggcatgtcgtctgacccttstagcattagccaaaggaagaagttgggggaggggaaatgccccaggaaagggcagcaccctggaggcttttktttttttt

SEQ ID NO: 15109 - DNA, 568 bp, Homo sapiens
  misc_feature 539: n=a, g, c or t
wkwwkkkwkkysgwmssccyscrkcrkggtcwgrmgkgwgktsskmgccytsskkystggyskkkysygwrykyygrksyytggygtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaastgccaaaagtgacatgcagggatgtccttcctgagatccgtgctatctgcattgaggaaattgggtgttggatgcaaagctacagcacgtctttcntcaccgacagctatttaaaatatattggt

SEQ ID NO: 15110 - DNA, 481 bp, Homo sapiens
agaagaaatagcaagtgccgagaagctggcatcagaaaaacagaggggagattgtgtggctgcagcgagggagacaggaagatctgcatggtgggaaggacctgatgatacagaggtgagaataagaaaggctgctgactttaccatctgaggccacacatctgctgaaatggagataattaacatcactagaaacagcaagatgacaatataatgtctaagtagtgacatgtttttgcacatttccagcccctttaaatatccacacacacaggaagcacaaaaggaagcacagagatccctgggagaaatgccggccgccatcttgggtcatcgatgagcctcgccctgtgcctggtcccgcttgtgagggaaggacattagaaaatgaattgatgtgttccttaaaggatgggcaggaaaacagatcctgttgtggatatttatttgaacgggattacagatttgaaatgaagtcaca

SEQ ID NO: 15111 - DNA, 372 bp, Homo sapiens
ttctcccccgagccggccgggagccgggacgggggcgcgcagggtccgggagagttacaggcttcagactttatctcgttgtggaaagcaagagaccaagccaaaaactttggtcgtgcttttcaacatctccggtcaaaagaggtcgccaatctgcttttctcccattgctgcgtcttagaggggtgtggtgccatctcattgaacaatgaggatatttagctcccctcagagctaccctcagagttggatgagctatcctcagagttggatgccaccaccgggagcagcaaaagcgaaggcaactcatgattctgcctcagaagcaatcgaataaaatattttgaaaatggaaaaaaaaaaaaaaaaaag

SEQ ID NO: 15112 - DNA, 391 bp, Homo sapiens
aatcccctgtggttggtgatcaaggaagagcatagtgccagacctaggkgycctcctgggaatgttccaggagggcaggagtaggaggaggagtgttagagtagaggggaaatgatgagagcagaaaggagagtctcgctctgtcacccaggctggagtgcagtggcaggatcttggctcacttcaacctccacctcccgagttctgcctcagcctcccaagtagctgggattacaggtccagtcactccacgcttgcagagtccaattaacaagagcaagttctggtagaaagaaggtgactttattccagagctcaggtgtttgaactgatgtctgatgaggatgaatccagcgactacctctgcctgtccatcctggggcctctttct

SEQ ID NO: 15113 - DNA, 406 bp, Homo sapiens
gtcacaagggagatgtccgcccccagtcgtagcctcggacggtttctgagcgttggtgtttggcacgcgccaccctctcttgctttggttccgccatgccgatgtaccaggtaaaaccttatcacgggcgcggcgccttctccgtgtggagcttcccacctgcatgtaccggctctctaacgtgcaaggcaggagcggcggcccagcgcccggcgttggccacctacagtctttggtagatgagtggctggatagctacaagcaagaccaggatgcaggatttctggagcttgttaactttttcatctgatcttgtggatgtaaagctatgaaactgatgacctccctggtaagagttgccctccaactgagtctgcacgaagatatcaatcagcgtcagtatgag

SEQ ID NO: 15114 - DNA, 539 bp, Homo sapiens
ttttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaastgccaaaagtgacatgcagggatgtccttcctgagatccgtgctatctgcattgaggaaattgggtgttgatgcaaagctacagcacgtctttcctcaccgacagccaaaaaaaaaaaaaaa

SEQ ID NO: 15115 - DNA, 408 bp, Homo sapiens
accttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctgtggaagaaggctgctatgactctttggatgggagtctggcaagaggaaattggaagataaaataaataa

SEQ ID NO: 15116 - DNA, 558 bp, Homo sapiens
aaatcagtccctatgatctgatacagattagcttgaagggggaagaaaaactttttcagatattggtgctgcaaatttattttaaatggaggcaggctggctttttactaaaagatgaagaaaaggaaccaattaaaatagaaacttcttcccaggtagaatcagaaataaagcaggaatcgtgattggaatccaccagcccagcaccctgtactctggtgccccaagtgattacatgtgagcctcccagaaagaacaaatattgctcttgccactcctctccaatgctgacaggactgagtcctggggcaagtggatccgggaattgcattgcagacaattacgcagtaatttccctgtctggagaagcacaccagttaacactagactgtcacagccctaggagagctgtaggtatgcatcatagcttctgtgatctcagaaccgtttctctgaccagcaaaagaagagatgaaaatgctcctcttgacctctatctgcactacaccagaaacgtcattgagcagtttcttctaaggagatacagaacttctatgc

SEQ ID NO: 15117 - DNA, 529 bp, Homo sapiens
  misc_feature 500: n=a, g, c or t
gcgcccgcagcagggtcagaagggaggtggtcgccctccgtcgtggtctggcgtgtattccgagccttggtgtctggcggtttccgagcgttggtgtctggcggtttccgagcgttggtgtcttggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaastgccaaaagtgacatgcagggatgtccttcctgagatccgtgctatctgcattgaggaaattgggtgttggatgcaaagctacagcacgtctttcntcaccgacagctatttaaaatatattggt

SEQ ID NO: 15118 - DNA, 407 bp, Homo sapiens
attgagttcaaagcagtgatgtttggatcaggcagtagatgaggttaagggttcctgtggtggtttatttggatctgaacgtctatgacactctttcgagctgacacagtgaagaacatagaaggagaactcacccagtctgccagggtcacagaatgatcatactcaagatcttcctggggagtcaatggcaaatttcactgggctattttacagatgaagaaggaacataaagaaggttctgggaccccgaagtccacggaacacccaccattacctgatctttggagcttgtcatttggccagtggaccctaataaacacgtccacggggatgtggggatagaatgccggagcctggctcgctarggcatccaggttcttccttcctctttgccctgctgtctc

SEQ ID NO: 15119 - DNA, 495 bp, Homo sapiens
ttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttg

SEQ ID NO: 15120 - DNA, 478 bp, Homo sapiens
aataaacaatggactgttttattcttggtgctttcaagacctgatgctttgttttgaacaggttgatacatctaggagtgaaatacatcaccgctttccctgctcccgccgccattaaaattgtgtttggcatctgaccaccaagatacagatatttcctagactgttttgcagctaggtacttagcatttctctttcctctggagaaaaatatctgctttctttaaaataaatgttccatccatgcagctaagcagctaaggacacgaacagccactgatacaggccaactcatcagtagattattgagatttcatactaggacctttcattggctgaacaaagacaaagacagaaatcaaggaaggtcaaagaagcagtcagttttctggcacccaaagttgttggagaagggtacagagtcggtaaataagtcatatgacagacaggcagtattttcttattttaataacaagtt

SEQ ID NO: 15121 - DNA, 483 bp, Homo sapiens
  misc_feature 442: n=a, g, c or t
ataagcaatggactgttttattcttggtgctttcaagacctgatgctttgttttgaacaggttgatacatctaggagtgaaatacatcaccgctttccctgctcccgcsgccattaaaattgtgtttggcatctgaccaccaagatacagatatttcctagactgttttgcagctaggtacttagaagtttttctaagttatttaaacttctcaccacacaaaatctggatttgtatctgtcacgtataattgcttgataaatcatttctctttcctctggagaaaaatatctgctttctttaaaataaatgttccatccatgcagctaagcagctaaggacacgaacagccactgatacaggccaactcatcagtagattattgagatttcatactaggacctttcattggctgaacaaagacaaagacagaaatcaaggnaggtcaaagaagcagtcagttttctggcamccaaagttgtt

SEQ ID NO: 15122 - DNA, 525 bp, Homo sapiens
ataaacaatggactgttttattcttggtgctttcaagacctgatgctttgttttgaacaggttgatacatctaggagtgaaatacatcaccgctttccctgctcccgcgccattaaaattgtgtttggcatctgaccaccaagatacagatatttcctagactgttttgcagctaggtacttagaagtttttctaagttatttaaacttctcaccacacaaaatctggatttgtatctgtcacgtagtaattgcttgataaatcatttctctttcctctggagaaaaatatctgctttctttaaaataaatgttccatccatgcagctaagcagctaaggacacgaacagccactgatacaggccaactcatcagtagattattgaggatcattctcttcagtcagatcacgatttgagtttgaactaaccagagagtagcagaaggaacgttttctcatttccatgtccagaaagatatattcctgctascctcctgaagtcagaggatgaaatcatagtcaaa

SEQ ID NO: 15123 - DNA, 478 bp, Homo sapiens
cagaacagggatttccctgcaagtgtctccctcatgctgaagtgaactagctgaatatgctcttaaagaaagtagtcagaaaagaaaaaaaagattatcttctccaaaatttgagaccaagtagctgtaaaaaacataataaacccagatgaaaaccaggcttcgttttcttgaaatgattttcttcatcagaatggtagatcagagccattggtgtgcagattccaatcctttaaaaagtaaacacatgccttttgataaagcggaattgaggtgatcagaaattctgttgagaacccagctatttgtgtgagtatattttagctatcccaaaaactttttctgacctttctctttctgggataggatatgtgtgcttagagtatcattcagaagggtacctaatagttaatctgttaattagttacatcaggtttcaatactaggtcagtgatatgagagcgagagagagagattt

SEQ ID NO: 15124 - DNA, 375 bp, Homo sapiens
aattaaaatgaatgggagttacatgcaaatacctcaaataaaatacctcaaataaaaaatgtagaatacctttccactgatgatttttagttgtcaggacaagtgagacccaaacagcagacagaatggtcccagcatgcttgttgcctttttttgtttgcacagtggctgtcagttccagccttgcaggtagtggaacccagccggaagaaggggcgggacccagcattgcagcctgaactgagagcaaatttaaattactgagccttttttttcctttttttatttttctactctgcgacaaactgaaaagattccagcacgctaatttaaccaccctgcttcttctttgcctttttttttttttgggatttt

SEQ ID NO: 15125 - DNA, 64 bp, Homo sapiens
ataaaaagaaaagactccgcacggcgcgggtgagtcagaacccagcagccgtgtaccccgcaga

SEQ ID NO: 15126 - DNA, 100 bp, Homo sapiens
ccctctcagcatcgcttttgctgggccgtgatcgtccccctttgtgggctggaaaagcaggtgagggtgggctgggctgaggccattgccgccactatct

SEQ ID NO: 15127 - DNA, 165 bp, Homo sapiens
ccctctcagcatcgcttttgctgggccgtgatcgtccccctttgtgggctggaaaagcaggtgagggtgggctgggctgaggccattgccgccactatctgtgtaataaaatccgtgagcacgaaaaaaaaaaaaaaaaaaaaaaaaaaaaaaaaaaaaaaamaa

SEQ ID NO: 15128 - DNA, 144 bp, Homo sapiens
ccctctcagcatcgcttttgctgggccgtgatcgtccccctttgtgggctggaaaagcaggtgagggtgggctgggctgaggccattgccgccactatctgtgtaataaaatccgtgagcacgaaaaaaaaaaaaaaaaaaaaa

SEQ ID NO: 15129 - DNA, 235 bp, Homo sapiens
aatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagayaaaaaaaaaaaaaaaaagg

SEQ ID NO: 15130 - DNA, 421 bp, Homo sapiens
tcttagattagtgaatgccaagtgactattctttcatcagggccaaggtggcactaacactttattagcccatatggatgggtctcaaaagcagtaatatagaaactttgcagcttagctgtataagaataatgcttataaataaaataccataacgtgtaaaagtaaaaatgtctctcttcyttttaaawawacttcagtcwattcaagacaaagaagtagccaagaaacataagaaaaaaatgctcaacatcactgatcatcagagaaatgtaaatcaaaaccaccataagacaccacctcacattatccagaatagctattattaaaaagtcaaaaaagattggctgggcgcggtggctcatgcctgtaatcccagcactttgggaggccgaggtgggtggatcatgaggtcaggagt

SEQ ID NO: 15131 - DNA, 617 bp, Homo sapiens
atcaccatggcaacagccttatctgccgccctagagccttttccctataacagtgaaatcaacaatgactgtgtcaggagagatctttaacttattatttattacaagatattctaatgtttaaagagcaatccaacataaatgaagagaacataagaaacagcatacacaatactggacatcacaggaccctctccggctggataccaggctgtagaaccaccagatgcttcagatgagaaaggttggatctgtttcacagggaaggggctaaactgtttcaagaggcgaccacgcgctgggcactctgtgtctcgctctgtcacccaggctggagtacagtggtgtgatctcggttcamtgsaamctcaaactycyhmgsttcagkkggatcctccsaacstcagctycttaagtagctgagactacagtactttgcaacctaccaagtatcatcacaagagctatgaaagtgaagagagacatacgttatctaagaatctgagagagatgactcagtcagcatcctctctcttggtgtacaatggtagggacagctactgtgtcatctggarcatgacaatgagaacacagacactggatcgtcctgatatagc

SEQ ID NO: 15132 - DNA, 540 bp, Homo sapiens
aaatcaacaatgactgtgtcaggagagatctttaacttattatttattacaagatattctaatgtttaaagagcaatccaacataaatgaagagaacataagaaacagcatacacaatactggacatcacaggaccctctccggctggataccaggctgtagaaccaccagatgcttcagatgagaaaggttggatctgtttcacagggaaggggctaaactgtttcaagaggcgaccacgcgctgggcactctggctggagtacagtggtgtgatctcggttcactgcaacctcaamctcctcggytcakgtggatcctcccamctcagcttcytaagtagctgagactacagtactttgcaacctaccaagtatcatcacaagagctatgaaagtgaagagagacatacgttatctaagaatctgagagagatgactcagtcagcatcctctctcttggtgtacaatggtagggacagctactgtgtcatctggarcatgacaatgagaacacagacactggatcgtcctgatatagc

SEQ ID NO: 15133 - DNA, 232 bp, Homo sapiens
  misc_feature 144: n=a, g, c or t
agcaatgtcatccagaccagagcagggacagaggggctctggtgtgtagaascagggaaacagcatcaggcctgggtatcagrragaaccaaattccagccttagctcacccactaactgggctcactaaccctcggcaagtcnvttatcctctttgagcttcttcttcccctaaaacatgggatttaataatgcctgccttgacctggcttgcaaagttgttgtaaggaac

SEQ ID NO: 15134 - DNA, 351 bp, Homo sapiens
  misc_feature 147..148,351: n=a, g, c or t
agcaatgtcatccagaccagagcagggacagaggggctctggtgtgtagaagcagggaaacagcatcaggcctgggtatcagaaagaaccaaattccagccttagctcacccactaactgggctcactaaccctcggcaagtcaadnnatcctctttgagcttcttcttcccctaaaacatgggatttaataatgcctgccttgacctggcttgcaaagttgttgtaaggaacaagaaatacagagtgtgaaagtgcattgtaaaaaaaaaaaaaaaaaaaaaaaaaaaaaaaaaaaaaaaaaaaaaaaaaaaaaaaaaaaaaaaaaaaaaaaaaaaaaaaaaaaaaaaan

SEQ ID NO: 15135 - DNA, 440 bp, Homo sapiens
cccatatttaaaaaatataaccacaataccttatcagagccaaaacaaatatggtcgcacacctgtaatcccaacactttgagagactgaggcgggcagatcgcctgaggccagaggttcaggaccggcctggccaacatggtgaaaccctgtgtctgctgaaggtgcaaagattagctaggcatggtggcgggtgcctgtggtcccagctactcgggaggctgaggcaggagagtcacttgaaccagggaggtggaggttgcagtgggccggggttgcgccgctgcactccagcctgggcaacagagcaagactctgtctttaaaaaaaaaattaattaattaattaatttaaaaaactacttactatcgtttaatacctatcagtgttcatatttcccccacttgtcaaaaatatcttgttattcagcagcaaagcag

SEQ ID NO: 15136 - DNA, 493 bp, Homo sapiens
aaaggcacacaaggtgggactgtccagttacagggaacacacttcagagtttctaccaattctacattatgacgtccctattccctgagacacaatcaaaattaggccagttaataaccctacaatggcctctaaatgttcaaatgggaggaagagttacacatctcttcttttaaatcaaaagctacaatgattaagcttagtgaggaagccatgttcaaagctgagctaggccaaaagctaggccttttgcaccaaacagctaagttgtgagtgcaaaggaaaagttattgaaagaaattaaaaagtgctaccctggtgaggacataaatgataaaaaagcaaaacagccttaatgctgatctgaagaaaattcaagtgttctgaatagatcaaaccaaccaaaacactcccttcagccaaagcctraatccagaccaaggcactaactctcttcaattctgtgaaggcttagagaagtaaggaagctgca

SEQ ID NO: 15137 - DNA, 348 bp, Homo sapiens
aggcgcgcggggattggcgggatgcggcgcgccgccgtgaacctccttggcctgggcgaastgtgtggaccaagcaagtcaggagtgtggccatgttttctgagcaggctgcccagagggccacactctactgtccccaccatcagccaacaatgccacctttgcccgggtgccagtggcaacctacaccaactcctcacaacccttccggctaggagagcgcabtttagccggcagtatgccacatttatgccacccgcctcatccaaatgagacccttcctggagaaccgggcccagcagcactggggcagtggagtgggagtggaagaagctgtgtgaactgcag

SEQ ID NO: 15138 - DNA, 399 bp, Homo sapiens
aaggcgcgcggggattggcgggatgcggcgcgccgcggggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagtgttgtggaccaagcaagtcaggagtgtggccatgttttctgagcaggctgcccagaggsccacactctactgtccccaccatcagccaacaatkccacctttgcccgggtgccagtggcaacctacaccaactcctcacaacccttccggctaggagagcgca

SEQ ID NO: 15139 - DNA, 225 bp, Homo sapiens
agaccttgcctgatgtcccctgggggaagtcaccctgggggacggctgctggtgagcgctcacagatgtgtgtccatagcagctgactctcctttgcatctcctccccgaggacgcatggcaggcaggccacgcccctccatgtgtaagacctgccgaaaacactcctcgtggggttggggtgggagtgcaggggccttggtggtttctacacccatgggcctgc

SEQ ID NO: 15140 - DNA, 535 bp, Homo sapiens
ccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttgattacttgttgcatgactcttaacacagctgactttttgtgtcagtgcaatgtatattttttgtcctgttattaacttgtaagccctagtaatggccaattatttgtacagcaacagaagtaaattgaagatactggct

SEQ ID NO: 15141 - DNA, 439 bp, Homo sapiens
agagggagggaacggtgcggasggccaacatggcggaactcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagtagtggactgtcttttggattcaaagtgggcaaaggccaagaaagggagaggaagctttatttyacaaccagggtagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaa

SEQ ID NO: 15142 - DNA, 289 bp, Homo sapiens
  misc_feature 289: n=a, g, c or t
aacacacctgtaaccccagcatttaggaaggctgaggtgggaggatcacttgaggccaggaattcaagaccagcctgggcaacatggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaaaaaaaaaaaaaaaaaaaaaaaaaaaaaaaaaaaaaaaaan

SEQ ID NO: 15143 - DNA, 479 bp, Homo sapiens
cattagatgaaataagaatgaaggcactttgttggcggagaccgtatctcatttacagaaaagcagtggtctctttcaaattcaagttcatatctaatttgaaactacatcttatattctgattgttctaccatttcccttgagtgcttaagcaatcatggtatctctctgccaaattaagtcaagacagagcttactatatgacttattaaagaatcagcaccaggctgtgaacagcagtagtcctgagcagggggtggttgtgtgccttaaagattattaattgcaatagactacccatgctagtaaattaccttttacgtgttaacatggtaaggccacagtgggctgaattgtttgcagatagacgacaataagaagccagaaattgtggggaaatggaatgtatactgtggtaaagatgggggagatggaggctacaagaaagaagagatcagcatagaagactgagttttgtg

SEQ ID NO: 15144 - DNA, 447 bp, Homo sapiens
attttattttaccaaggagcaaaactgagtaagtttcctgacgaaaataatgagtgtctactgttctagggcctttaacaacaacaacaacaaatttacattaacgcacattatgtgccaggaattgcaagatgcataagattagtttttaaaatgtgcctgctagagctgaacaggtaacgagagttcgaagccgggtccagagctatcttctgtaacattcttctgggtcgagtccctgccccgctacgagactatacgtaacatggacctggaaaagcttaaaaatatgaagaggattgaactggctgccatctgtgcatcttcatttatgaaaacactcctcatagacttaaaacaaatgacagagaacaaattagtcagcttcttctaaaatacagtggtctcccttamcctcagtttcactttctgcagtcaactgcagtc

SEQ ID NO: 15145 - DNA, 457 bp, Homo sapiens
ataaagactgttccagtcagggaatctcacggaggtccctgtcctgggtctgattggagaagaatcaccaggaagccctgaggttactcaggactctgatccttgtgaccatggttgaggaattttcatccgtttcarcgtcaatctgcattttgtgccarggagaaarggtcctcatatgcatagagaagacattgttaggcacagttttctaaatttaagaggttccctggggaactgtcagaagaagacaaagtcccacatcctgacaggaaacagcctccatctgcacctgcctccagggctgactctgatcagtggctcctgagcgccccctgcagctgatttccccccagcgttcctgsagggaggtttgtgtctgggcsacaatgacctcccctcactgtgtattactgtggcgaaagattccaggcctctagggggaatagtgacagcc

SEQ ID NO: 15146 - DNA, 462 bp, Homo sapiens
catcttctgagttctatgtgtctcatttcagacatttacatctggtcaggatcctttcctagggagctagtgagaggctttggagatcacaaaacactctggctttgtgtattgccagacttcttgtgcttattcctttccatctgcgggagttgacacttcttttttgaatttgcttcatttagatggggtttgtattagtcagagttctctataggtaccgaagtaataggatagatgtacatttgaaggggagtttattaaggatcattgactcacacgatcacaaggtaaagtcccacaataagccatctgcaagctgaggagcagggaagccagtccgagtcccaaaacctcaaaagcagggaagctgacagtgcagccttcagtctgtggctgaaggctgagagcccctggcaaaccactggtgtaagtccaagagtccaaaagctgaagaactgg

SEQ ID NO: 15147 - DNA, 353 bp, Homo sapiens
aaacagcctcgccccgcctacgcgggacccaaccgcggcgaccggacgtgcactcctccagtagcggctgcacgtcgtgccaatggcccgstatgragragktgagcgkgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttattggaaagatccaaataatgacttcagaaaaaacttgaaagta

SEQ ID NO: 15148 - DNA, 486 bp, Homo sapiens
tagaaatgcagcatctttgtggacgtctttttcacaagcctccaaggctccttagattgggtcgttactaaaagtacattaaaacactcttgtttatggaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttatttaaatatccagtgagctcagaaggactcagtattatttcaagactatttttgaggtaattctagccttttaaaatattctacagac

SEQ ID NO: 15149 - DNA, 437 bp, Homo sapiens
tatttaacctgttatctgtagctatctgcttgggaacaaaaggaaaagcagtttattgcatgactcagcttgcagcttaattttttctcttgacatggtggattggggtcccaagtttttgttttgtttttagtgtcaacagcctaaaataggcaataggaaagaaaatactgtatgagagatgtcatagtgttagactgtggagtttggcaatctattgtatatgaaagttgacagcagagagagtttaaaactattattaagattttagcctgggctggggcacaatgtctcacacctatagtcccagcactttcggaggctgaggcaggagaatcacttgatcccaggagttcaagtctccagtcagccatgatcacaccactgtgacagcctgagggacagagcaagactctgtctcaaaaaaaaaaaaaaaa

SEQ ID NO: 15150 - DNA, 570 bp, Homo sapiens
aagtatacatccataggtaatggctgcaagtgagaatctactttttgaaacaagttgaaaaaaagcatttgtctacaaaagaacatcagatactgcactttttacaaattgaatgtttgtggcaagcctgcatcgagaaagtccattgatgccatttttttcaaacagcctttctattgcttgagacacaacaatattgaaattaggcaaattgatagccctacaatggcctctaagtgttcacgtgaaaagaagaatcacagacctctcatttgaaattcatgttgttttcatgcctgctaacacaacatccattctgcagcgcatggatcaagggttaattttgattttcaatgttattatttaaatatatttcataatgctatggctgccatagatagtgattccattaatggatctgaaattgaaggaaaagtaaagatgtttctggaaggcaccaggagtcctgtctgcactgagcaccatgaagttcacctgcattgagttctttccctttgtacaacacttactcccagaccaaaaaataactccttctctccaatctgtgtt

SEQ ID NO: 15151 - DNA, 464 bp, Homo sapiens
tttatctgatattttgaagggtatattgctttgaagtaagtctcaataaggcaatatattttagggcatctttcttcttatctctgacattgttcttaaaattatttgaatatcataagagccttggtgtctgtcctaattcctttctcactcaccgattctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagct

SEQ ID NO: 15152 - DNA, 201 bp, Homo sapiens
tagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggcaaaaaaaaaaaaaaaaaaaaaaaaaaaaaaaammm

SEQ ID NO: 15153 - DNA, 344 bp, Homo sapiens
agaccagaccaacagtaacaccaagggcaggtgggcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaatgagcaaaagtcacctgcccaataaagcttgacaagaaaaaaaaaaaaaattg

SEQ ID NO: 15154 - DNA, 484 bp, Homo sapiens
cccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactgtttgcagactgtggaaggatctgcagttttgtttttgatcaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgtggcagccctgagcctggagttgagactttggggtctcttagtttggaggtgttgagtgcatttgtgcccctgcctggttgagagcttcttggta

SEQ ID NO: 15155 - DNA, 896 bp, Homo sapiens
ccaaagattaaagccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaaccttcccacatgccgtgactctggactatatcagtttttggaaagcagggttcctctgcctgctaacaagcccacgtggaccagtctgaatgtctttcctttacacctatgtttttaaatagtcaaacttcaagaaacaatctaaacaagtttctgttgc

SEQ ID NO: 15156 - DNA, 475 bp, Homo sapiens
  misc_feature 251: n=a, g, c or t
aactttcagattaatgaattaaactttttgaataatcaaagggaatctatgcgcagttgtagggagggggcgacgtaggggaaaagttagttttacaaagtgaagctaactcagtttaataaatagttttagaagtttttagtggttaacaaaagactgcatctctcttatgcaagaactgcccatgtttcatcttgtccgaggttgaccatccgcctgtgctctcaatgagacttctagcccctcagagnccacaccagcgagcaacatcgccacctgctgggagttagaaaaattacagaattggattatctttattcaaatattcttggattctgggtttaaagatggagtctcagttttataagggggagtttccctgcacagctctctctctttgtctgctgccattcatgtaaaatgtgacttgctcctccttgccttccgtcatgattgtgatgcctcccagccatgt

SEQ ID NO: 15157 - DNA, 79 bp, Homo sapiens
agaccagaccaacagtaacaccaagggcaggtgggcaggcctccgccctcctcccctactccagggcccacttgcagcc

SEQ ID NO: 15158 - DNA, 315 bp, Homo sapiens
gaagcgggagagawsagagccgaggacgcgcgtttggggaggacgcagaagccgccgaaacaataagggcgaccgasaccttagacagggagagacagagacctcgatcggctgccggccgtcgcgccgagggacgatggagggactgagaaaggcgaggctaagtcagacgttgttattgaagatgataggattgatgacgtgaaaaatatgaccgacaaggcacctcctggtgtctaactcccccaaagacaatgagttaagggagagaataagaacggcggtaacagttattggcaaaaaaaaaaaaaaaaa

SEQ ID NO: 15159 - DNA, 495 bp, Homo sapiens
ttgtatgagcagttgggtttcgggacgctttttggggagaacccgatggagtctgaaggatctctaaatcaggcggaacccacggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagtcacccagggcatgatc

SEQ ID NO: 15160 - DNA, 495 bp, Homo sapiens
aagttaaggaggggagggggtggagggaaaagcaagccaggaggtgcttgcggccgcttctagtagtttccaggcgctgccggcggctggcactaagcggtcctgaggctgtggctacggctgctccggagctggtggcgccgcgataggagagccgatggccaagtggggtgagggagacccacgctggatcgtggaggagcgggcggacgcaccaacgtcaacaactscactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaacagcgt

SEQ ID NO: 15161 - DNA, 203 bp, Homo sapiens
tcgcctcksggagctggaaatgcagctattgagatcttcgaatgctgcggagctggaggcggaggcagctggggaggtccgagcgatgtgaccaggccgccatcgctcgtctcttyctctctcctgccgsctcctgtctcgaaaataacttttttagtctaaagaaagaaagacaaaagtagtcgtccgsccctcacgcccty

SEQ ID NO: 15162 - DNA, 420 bp, Homo sapiens
  misc_feature 114: n=a, g, c or t
tatctgtcaacctgtcttgggcagaaacagcggcggcgacasagcaggagcgtcatggccgtggcgctgtctgcgccggcggatccgsctttcggactgaggcccagcgcagcnttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatccctttcctcaatgtcttcgagttggagcggctcctctacacaggcaagacagcctgtaaccatgccgacgaggtctggccaggcttctatctcggagac

SEQ ID NO: 15163 - DNA, 436 bp, Homo sapiens
  misc_feature 351: n=a, g, c or t
gctttgtaattggtgcagctctgagaacacacgcatgcattccaggcggtgctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttttgaaccctgcttcgacgtgtgtgtcatggcttaaaaatagctgctaatctgtcaacctgtcttgggcagaaacagcggcggcgacasagcaggagcgtcatggccgtggcgctgtctgcgcgggcgatccgctttcggactgaggcccagcgcantttgcaaagagcagcagctacctggcaactgaacccatcatcaccacagccactcctgcagctgccacggtttctgccacctcta

SEQ ID NO: 15164 - DNA, 533 bp, Homo sapiens
acagaaaggctaagtcacttcctcaaggaaaccaggataacaacagaatctactcccagcagtgttgtgaggatttggagcattgcgtaagggaaagcccgttgctgagtgcctggcacgtggggaagagtgggtggaagaacatgcttcctctcatcactgtgcccccatctgagaggtcgcatccgattctccagaaacaaggaagtagatgagaggccccaaacatcccatgctgttcccatctcgaggcctctgcacgtgcccttcttgtctgaaatgcatgcatctgtcctttctcaacatggccaaccccaacccatcttctaagactcggctcagccatcacctcccctgggctgcttgacttctgagctcccagagtaccctgcgtcacccagcatcgtccgatggaaagatctggcaagccacatcttcaaaatccaatgaactcactgcacatctcaagttggacaccagattttcatcggcacatgatctgtgtgctatcattatcatcatctctacagata

SEQ ID NO: 15165 - DNA, 254 bp, Homo sapiens
ataaaaaaaagctggccaccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaatgagcaaaagtcacctgcccaataaagcttgacaagacaaaaaaaaaaaaaawtgcgaaa

SEQ ID NO: 15166 - DNA, 484 bp, Homo sapiens
ttatcaatagaaatgccgaatattataatttcatatttttatgtagttggtccatctgaaatgtaacaaatgcatcaagataagagtatatttatttgctagcagtgaagtgtttttaagtaaacggttggggagagttatgtaactgacactgttggcaaatgtaaggattgaaaacctttggtaataaaggttcatgtgggctgaatacagtggctcaggcctgtaatccaggcactttgggaggctgaggtgggaggatcgcctgagcccaggagtttgagaccaacctgggcaacacagtgagacctcatctctacagataataaaaaaaaaaattggttggctgtggtggtgtgtgcctgtgattccaggtactcgggaggctgcagtgggaggatcactcgagcccgggaaatcaagtctgcggtgagctgggatcacactactgtactccaaccttccagcctgggcagagagtgag

SEQ ID NO: 15167 - DNA, 351 bp, Homo sapiens
attggctgaaggcacttccgttgagcatctagacgtttccttggctcttctggcgccaaaatgtcgttcgtggcaggggttattcggcggctggacgagacagtggtgaaccgcatcgcgcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaagatgaggtattaatcccctccattgctctccaaaagccaataaagtgattacacccg

SEQ ID NO: 15168 - DNA, 294 bp, Homo sapiens
atcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaa

SEQ ID NO: 15169 - DNA, 140 bp, Homo sapiens
tcactgtggtgtccagcagcatccggsttcatggggggacttgaaccctgcagcaggctsctgstcctgcctctcctgstggsttttaccttstttttcctcctcaggtctccgtcctgtccaggcccaggcccagagcg

SEQ ID NO: 15170 - DNA, 478 bp, Homo sapiens
taaggccaggcacggtgggtcacacctatagtcccagcactttcagaggccaaggtaggaagattacttgagtccagaaatttgagatgataaatatccattggctaataattaaatgcatcatctatagttattgctgaacagatatgggcagcacagtgagaagatttcttgtctctacaaaaaaattaaaacaggccaggcgcagtggctcacgcctgtaatcccagcactttaggaggccaaggtgggcagataacctgaggtcaggcatttaagaccagagtgaccaacatggagaaacccattctctactaaaaatacaaaattagccaggcatggtggtgcatgcctgtaatcccagctacttgggaagctgaggcagaagaatcgcttgaactcaggaagcagaggttgcggtgagccgagatcgtgccaccgcactccagtctgggcaacaagagcaaaactatctcca

SEQ ID NO: 15171 - DNA, 416 bp, Homo sapiens
gcctcacacctcagccctgtgcctaaggacatctggctgtgcaatccatgttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggctgcaaattgagtacactgggaatcaacaaatttgatgaagcctgtctgtctcttcaccagtggagtgagtgcagcagttagaaagagaagcaatattgtgcaactggtgcagtggtgattttgttttcaaatgctcct

SEQ ID NO: 15172 - DNA, 437 bp, Homo sapiens
  misc_feature 281..282: n=a, g, c or t
atkatgssagaaatggactataagacctacttggrstttgtccttgcattagaaaacagaaaggaacctgcagctctacaatatattttcaaactgcttgatattgagaacaaaggatacctgaatgtcttttcacttaattatttctttagggccatacaggaactamtsmaaatccatggacaagawcctatttcatttcaagatgtcaaggatgaaatctttgacatggtmaaaccaaaggatcctttgaaaatctctcttcaggatttaatcaacdnnmatcaaggagacacagtaaccaccattctaatcgatttgaatggcttctggacttacgagawcagagaggctcttgttgcaaatgacagtgaaaactctgcagaccttgatgatacatgatctctgaaagactagactgtcttatattatgagat

SEQ ID NO: 15173 - DNA, 475 bp, Homo sapiens
agctgtttcttgaagctctgcataagcctcgcccgcggccgccgggttgcgtccgcacttctgcgcgctggcccctcccttgctcctctccctagcagtctccagggttttaccgggaggacctaggcaacggcctgagactccgagactctatgttgaagatgcctggactaacctactgaagatacgtggttttaccaacagccagcaccaataggaagatatgaatgaagccatctgagaccagccatctggcagccaaactgccaactgactgcaaatgcatgaatgatcccactgacaccacgtagagcacaaatgagttgcctccactgagcccagcccaaattgttatcctataaaatcataaaaacataaacagttgttttaagtcactaagttttggatagtttgttatacaacaaaagctagctgaaacaaatgtattagctagagcagctgtgaatggcactat

SEQ ID NO: 15174 - DNA, 508 bp, Homo sapiens
ttatagtagtttggattaatagatttaaggaggtatggtcaataatctcaaatgcctctcaagtgtgtttttgtattataagattttctaaataaaagtttctaaataaaacctaataatatttattttttaagagatagagtcttctattttgggagtggcgggtccggcagagagggatcttgctgtgttgctcatgctggagtgcagtggctattcacacatgtaatgatagtatactgcaactatgaactctagcaatgtttccagctcagcctcccacatagctgggactacaggtacatgtcaccatacctggtcataattattatttttaatgggaagcaatcgggagtcttcacttcttaatctgtctctgacattgttagctaatgtcaagtgacttcttccccaggtcatgttacctgtagtcccagctacttgggaggctgagacaggagagtcgcttgaacccaggaggcggaggttgcagtgagctgagatcacg

SEQ ID NO: 15175 - DNA, 487 bp, Homo sapiens
attctacaggaagcaattttttggttgtgaagggagaaatgggctcctcatggaggttcctgggctccactgaggaagagcccttcctcccagcagtgttgtataaagtagagaagataaatggatggagaacgcctgctccaagccggacgacgacattctagacatcccgctggacgatcccggcgccaacgcggccgccgccaaaatccaggcgagttttcggggccacatggcgcggaagaagataaagagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccca

SEQ ID NO: 15176 - DNA, 445 bp, Homo sapiens
agaatctgacattccaggactccactaggcctgttttcctctgtgggaactagagccaaggcgagagacccgtgccagccccgaggctcccggggcccatgggcaaggcggggctggtacagggccccggggctctctcagcccatctgtsayccctcccccccaacacccagatgtcccgtcttggcagtgctgtcccggactgccacattaatgctccagaacccgccagctgggccctggggcgggtggggctcctgcagagccttggacaaaggcgagggagggagggaaggggatcctaagcacccctccctccctggccctaggaggcagacatgcccgatgagatcaacattgatgaattgttggagttagagagtgaagaggagagaagccggaaaatccagggatcctgaagtcatgtgggaaactgtcgaggact

SEQ ID NO: 15177 - DNA, 478 bp, Homo sapiens
tttttttctgttagtgactaatcattggagacaaccatgtttagtatttgagcattggttaaatgctaaagaaaaatcgccgttaaagcagttttctttttcactgtctttttcttttcgcggggaaccagctgttcctgcgagggccacctcctcaggaagaccccgcagctctcccgcggcgcttctgcaggaggcagcgacagtttcgagaacccgggccttcccctcccagtgcctcccggggttccggcgtttcaggcgctgctgttttccgggaagggcaggcgcgctgggccttggggagctgcgctcggcgggcggacgcgggggatcatggaagctgataaagatgacacacaacaaattcttaaggagcattcgccagatgaatttataaaagatgaacaaaataagggactaattgatgaaattacaaagaaaaatattcaactaaagaaggagatccaaaagcttg

SEQ ID NO: 15178 - DNA, 312 bp, Homo sapiens
cctgttcattaagctcctgggcaatgccccgcctttaggcttcctaggacccattgtgaacctcagcgagcccamcggccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtgtgagtcggtcaccctgac

SEQ ID NO: 15179 - DNA, 473 bp, Homo sapiens
caactgtaagttcagctcagggcttcctagcagccatgtttagcgaagtgtgatttttttttttaaacaaaaacaagcaaagatttggaagaaaatgctttagacctaactttacaattattataacataagatgttccagggtccttgaataaatgctgagttttagggaaatgattccaagggaccaagaattggtagaaataatttcaaggcagagaagactaattctacaggccgggcgtggtggcttatgcctgtaatcccacactttgggaggctgaggtgggtggattgcctgaggtcaagagttcaagaccagcctggccaacatggtgaaacctgtctctactaaaaatacaaaaaattacccaggcatggtggcgggcgcctgtaatcccagctacttgggaggctgagacaggagaatggcttgaacccaggaggtggagattgcggtgagctgaggtcgtg

SEQ ID NO: 15180 - DNA, 463 bp, Homo sapiens
  misc_feature 74: n=a, g, c or t
acgacagaccgtgtgtttccaaaatggcggcaggatggatgtggataccccgagcggcaccaacagcggcgcgngcaagaagcgctttgaagtgaaaaaggcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctggaacgaaaaaaaaaaaaaaa

SEQ ID NO: 15181 - DNA, 591 bp, Homo sapiens
tcctctgtccacgcctgttcccttcgtcgccgcggctctcgtccgggacacggctttccggagtagagcccttggaggtgttaagtgtgatgcttccataatacatttggatgctktcagctaagttcacttctgaactaaggggttcctccaaatgttggctgaaattcatcccaaggctggtctgcaaagtctgcaattcataatggagctactgtactggctattggaaggaggagattctgaagataaggaggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaayatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcac

SEQ ID NO: 15182 - DNA, 250 bp, Homo sapiens
aaagatggattttggagawgttgcctgggctggtcttgaactcctgggctcaagtgatccacccacctcagtctcccaaagcgctggaattataggcatgagccactgcgcccggcctaatttgactatttttgcgtgatgagtatgcagtggaatgtggcaaattttattttcagctacataaatggaatatttgactcgtatacaatctcttcccttagttgtgtgtgtggctttttttttttttggg

SEQ ID NO: 15183 - DNA, 377 bp, Homo sapiens
  misc_feature 233,323: n=a, g, c or t
acacggtgttgtcattggatgtgactttctgaagtggtgggcaattcttgttaatgttttaaacaaaaaaaaaaaccttacagtcttgccctgatttacacagcagtcacattcctggaaaattcaagtgtttattaaaactatgcaacagttactgtgtgttatacgttgaaaggtcttcactaatatctcactaagtaatgagaatgcctacatatcagaatttttttttncaggagccaagcacatatactgatttggaaaaaggcacaggtagctcagtttatttgctttctaccctgcctggccacttgctgtttctncagtttctaatttgagctgtaactacacaaggaaagctaaatagtctggaaaat

SEQ ID NO: 15184 - DNA, 454 bp, Homo sapiens
aaagtttctctagcaacaaaattccatcagaatcatagcagcttccagtcagatccaaatgctaataaccaactccaaaattactttttatcattctcaaatctgctttatttttttgcttcttttcccaatgtctcatctctctgttaatttactggtggctactctgacttttcaggctcaagaaagccacacatcttaatctgaccattatatcaatgtgtagccactcggctacacgtaagactgagaagtcttatggggtcttttttgctcaaagccttcttaaaatccatcttttatttttgagagtttaaaaacagtcattttttccaattctgaatttctggttattattttctttcactcctgtaaaccaaacaatagtttcctaaactcatctcttccttgactacatttggcaaggtaatgcaattacaatgaacacacacta

SEQ ID NO: 15185 - DNA, 376 bp, Homo sapiens
tgagtaccaagatgcattcaggcaagtttggtgttgcccaggcatcaggaatggtgctccggtttgagacatactgatgttcagacaactttgtagaaggctcagacaatgacaaggaattagtttctctgagaactggacctcactggcctgtgttgattgcagattttcatcagattgtttgcaatgccatttctcctcccaaatcatgtgagctgtaggggctttttagactttctgttgtggggacctctctttgaaatggaccgtttctatcctagtttcttggcccttatgaaatactatcactggtttgagatagtgcaaacctttgtkaaatcaagatggtcagattttagcccaagagttaaatcat

SEQ ID NO: 15186 - DNA, 436 bp, Homo sapiens
caatcctggcctttcaggctgctgagaagttatacttactgaggagaaggatagaacatttaagagaaggtattggtctgatttataatttttaaatatttagatttaagggtgagtggacaccagcctccaccaatatcaagagtgtgtttggcctagaccctaggagatattcaatatttatcaaatagatggatgaatctcatttaatttaatcctcacacagactcaacggagggaaatcacatcgtctgtgctttattgatgagggaactaaggcttggagagatttaatgactggcctatttgtcaagttagaagtttgtctagcagagctgagagcctcaagccctaacgtgtctgattccaaaatccattgcaattggttcatgacaagttcactcccattatgaccacattaaatatattataactg

SEQ ID NO: 15187 - DNA, 382 bp, Homo sapiens
atggttttaggcctaggcagggattagattttatctcagattttgctaagagtatttcttctggagactagcaggctgctagtaagawttgatagaattggctctgtgtcactgggagaactggagttgaagggttacaggagatgagtcctggagaaggggaggcagggacaagggtgccaggaagctcaggggatgaaagggaaatggagagtccagtgagagaaggctggtgaggtgtagagagtggccagacacatgcctgacagttgggaccacttctctatacaaatcwggaggaggcgaggtaggcaggatagttcagagtttgtgggaaggaacctgacatctgaagtcagtggagtgtgtcttgggctgctgc

SEQ ID NO: 15188 - DNA, 494 bp, Homo sapiens
tttctaagccagttttctgttccatagaatggaaggtattcattttataggtggttaggcaggctaagtgagaatgcgtgtaaaagcacacagctgaataccagacacattcatgacaaacactcagatgtcatccatctatcttcattaaatatttgaagctgatcttattaaacactttgattcccaaagtcaaaaccaagcctagacctgatcaccttaaaacacttttggtataaggscggattttaattatcaaatgagactgtttctccaaactattgccagtctctttctccctacttctctttttttctcctatcccgttcaaatgaaaacatatatgatgtagaactagtatttgtgagagaagaaaaataccatcatttttattcttttccatttctatgtgtttctgttctgatctcttttaactcatttaatattcaagatcatttctacttatacacagacctttctacctacttgacccc

SEQ ID NO: 15189 - DNA, 521 bp, Homo sapiens
aatggactcattcagccccaggtttgaattttttctagttttcacacacacacacacccacaaaaaggcataatacctgtaagaaggaaagcagtcctctagaattgaagtgtttgaaaaaaagctatgagctcaatgttttggaggaaatcccttctatagcagtggaaagaaggcagctcactttggagtaagtgtggatagaactggaaataggagatatgggagggacaagagaaggccaataatctatgagtttatgtcctcagctttgaatggtaggaccgtatctgctattcagtttttgaaatacagctgtgccatgtgcactgaaccttcacactgggactcagctgccatgcttcaccttgggtataatgatgacagaggttgagaaaggtgactccctccattgatgtatttcgccatgattacctcccaccaaatgatactaatactcctgaaaatacttaacatttataaaatgtttattttctgattcatgtcaaaaaaaaaaaaaa

SEQ ID NO: 15190 - DNA, 503 bp, Homo sapiens
agtgctctttcacactgtcatgggctgcactctggtcattctttattcagggaaaagcacacaatcgtaaacaacggagagtgaagacagtaacaactggtttgatattgaatttttaaaatcttgattcaaatggaattttcataatctaccacttaaaatttatttttaattagaagaaaactatgtaactgtgaagagaagcacatttcagcctctcagtcagccccaccgtgcctctgcttcacatccaggaagaagggagtcctcggggcagccaccaaatgcaaggacagagagtccagagaataccacttggcctccaggtgcatgccttccaagtctactctgcagacgcaaatgtcatgtgggtttttgccaaaatctcaatggaaacatttctatttgctttaatttatttttaaagtcaaacaccacagttcaggatgtggaagaaatatgaagtcagtggatgaagatcttgcttctaccagcttatgatc

SEQ ID NO: 15191 - DNA, 433 bp, Homo sapiens
ttttggtccctaacgcttggctacagccagtgctctttcacactgtcatgggctgcactctgggtccttcagaagacctgcaaggrwggaacgcagatgtcagcgtctactggggaaagaaccaccactggaaaagcacacaatcgtaaacaacggagagtgaagacagtaacaactggtttgatattgaatttttaaaattttgattcaaatggaattttcataatctaccacttaaaatttatttttaattagaagaaaactatgtaactgtgaagagaagcacatttcagcctctcagtcagccccaccgtgcctctgcttcacatccaggaagaagcgagtcctcggggcagccacgcaaatgcaaggacagagagtccagagaataccacttggcctccaggtgcatgccttccaagtctactctgca

SEQ ID NO: 15192 - DNA, 567 bp, Homo sapiens
atttttcatagagacatggtttcaccatgttagccatgatggtctcgatctcctgacctcgtgatccacatgccttggcctcccaaagtgctgggattacatgcgtgagccactgcgcccggctagttttctctttttgtcgtgtctaccttcctacttgcctcacaccagtcagttggctttctgtgtcaagcctgaggaatgaatctcatgaaagagcattgggagagcggagattttggaaattgctttcagaacacaaaatcccacatgcgtgggcttgttccctgcaagcttaatcttgcctgatgtatatgtgtacatgtggaaggctgaaggaagtgctataaatgccccattcgtaagtattcagccatcgtgtgctgaaasctgccgtctgccggacactgaaatgtggccttcacaggccgagggtctttaagaagcatggccgtgggggctgagagcagggtggggtgacaggacaggttactgagactgaattttgtctgaagagtagggagagctgtagtggttcccctttgctggttgttggtttttgtgtgc

SEQ ID NO: 15193 - DNA, 215 bp, Homo sapiens
atcgcttctcggccttttggctaagatcaagtgtaktatctgttcttatcagtttaatatctgatacgtcctctatccgaggacaatatattaaatggatttttggagcagggagatggaataggagcttgctcgtccactccacgcatcgacctggtattgcagtacctccaggaacggtgcaccccctccggatacaaaaaaaaaaaaaaaaa

SEQ ID NO: 15194 - DNA, 264 bp, Homo sapiens
aaaatcccagccaccgccgccctgtttggcgtctctgatggagagctgagcttcctgtgtcctcggagcctgcagggatcagcacccgccacggtagctcccctttcccgcctgctctgctggatgctgggtttcagtccaggtccttcgggcgccctggaaccctcttcccctccccgacctgggcctgtcatgggccactttagggccctggatggcggccctgctccctggcgccgcatcagccatccgtggcagactccc

SEQ ID NO: 15195 - DNA, 451 bp, Homo sapiens
tttctattgtagttccatttgtgaagattgtgactttttgtttattagctataatttctacacttgtaaggcttacaaacaagttaaaaagaaaattgcaaataacatttgtccctttcagtcttcacctagttgtgtaattattttaattcactttgcctttgcagaaatttgggtattttctttgtagtgctattgagtctcatctggaaagattatataaattgcattctccttgcttatgtgggtagaatgggagaagaaggcaagacaaagtatacttaaattctatgcatatttctgttatgctttctgttttttttagttgattctgaaatgaatatgccctattcttttgaaagaatggccttttagttgtatagccaaagacatttagtattttccggttccttaaggtattactgtaccattttgtaaaaggaatattata

SEQ ID NO: 15196 - DNA, 368 bp, Homo sapiens
acttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgaaaaaaaaaaaaaaaaag

SEQ ID NO: 15197 - DNA, 302 bp, Homo sapiens
cttttacgtcggccttcgcgagcgtctgggcgggtggtaggaacaatggcgctgtcttaagtggcacagtggagcagctctgaagatgcaaagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgaaaaaaaaaaaaaaaaagsctttttttttttt

SEQ ID NO: 15198 - DNA, 459 bp, Homo sapiens
acttttacgtcggccttcgcgagcgtctgggcgggtggtaggaacaatggcgctgtcttmagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatttagttgaatccatggacatgaaacccacagatatagagggttggcccggtgcagtggctcacgcctgtaatcccagcactttgggaggccaaggcgggtggatcaccttaggtcaga

SEQ ID NO: 15199 - DNA, 431 bp, Homo sapiens
cttttacgtcggccttcgcgagcgtctgggcgggtggtaggaacaatggcgctgtcttmagtggcayagtggagcagctctgaagatgcaaagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttta

SEQ ID NO: 15200 - DNA, 460 bp, Homo sapiens
aamactttttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggawaaaaaaaaaaaaaaaaaaac

SEQ ID NO: 15201 - DNA, 464 bp, Homo sapiens
ctttttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggat

SEQ ID NO: 15202 - DNA, 496 bp, Homo sapiens
ttttctttttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcatt

SEQ ID NO: 15203 - DNA, 397 bp, Homo sapiens
cttttacgtcggccttcgcgagcgtctgggcgggtggtaggaacaatggcgctgtcttaagtggcacagtggagcagctctggaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccaaaaaaaaaaaaaaaa

SEQ ID NO: 15204 - DNA, 394 bp, Homo sapiens
cttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgaaaaaaaaaaaaaaaaaaaaaaaaaawwwaaaaaaaaaaaaaaaa

SEQ ID NO: 15205 - DNA, 436 bp, Homo sapiens
  misc_feature 414..415,421: n=a, g, c or t
ctttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaannaaaacngtawtttgaaaaaaa

SEQ ID NO: 15206 - DNA, 435 bp, Homo sapiens
cttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttaaaaar

SEQ ID NO: 15207 - DNA, 448 bp, Homo sapiens
aaaatcccgctgcagccattgccgcagacacgatgccgaaacgaaagaagcagaatcatcaccagccaccgacacagcagcagcccccgctgccgagcgggaagagactggagatgaggaggatgggagtcccatcggaccacccagccttctgggcsctccccccatggccaatggaaaacctggcgaccctaagtcagccccaaactggataccacccacatgtccatcatcagtagaatggataaataaattgttgtgtatgcatgcaatgggactacactgcaacgaaaatgaatgaactgctgctacaggcaacctggatgaatctcacaaacatgatgttgagcgaaaggagccagacataaaagaatgcagactctcttcacagaggtcctccaggatcaaggggaccactgattccaccactgctgagtctcccacctcc

SEQ ID NO: 15208 - DNA, 437 bp, Homo sapiens
cttttacgtcggccttcgcgagcgtctgggcgggtggtaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgagaaaaa

SEQ ID NO: 15209 - DNA, 435 bp, Homo sapiens
cttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaatttcgaaaaa

SEQ ID NO: 15210 - DNA, 435 bp, Homo sapiens
cttttactcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgaaaaaa

SEQ ID NO: 15211 - DNA, 474 bp, Homo sapiens
attctactgacattctctacctttgacttactgatgagttaaggaaggactgaagacaaaagaaactatgggctgctctctctttccctttctttctatgtcaccattttcacttaagtggttggtcgatacaaggaattaacactaatgctatgtgcaaatgggataggaagaaatggcagcatgcattatgcacacctctcatctgctcagacactcccttgcaccatatttgcttgtctaatgatgtacttgcttagaagttccaggggctaatcttgaaataaaccaggcatagagatccagttgtggaagtctcccccacctagaaattgcctcaaggtggttaatctacaacccaaccattgtcaaaatggccccagttcatactacaggtggacaacaactcaagatagccattggagcaagatatgccgacctccatcctgcaccactcccacatgcttcccatac

SEQ ID NO: 15212 - DNA, 509 bp, Homo sapiens
  misc_feature 482: n=a, g, c or t
aatgctctgggcaatcccacaaagcgaccacctggcccatatctggcatgactttcatgtcccgccagacattcaaggaatccgactatgttttctatataaacatatagtatttttcacatctgaaaatatacactgaattttccaggactgtgtataaatagaggtttggaagktgagaccagagagctggcacatcggtctctaggtcatgtactggatcatgaaacatctgatggcttctgactcccagtcccctagtccctctgttgaaccatagctacctctcagtggaaaactaaaaagaaacacaccatgtaacttgattaattatccttcctgctgtgactgctagccaacgtgccttttagttgttttgcttatatctgttgccacatgaaaattggaacatatggtctggagggccaagatggtattctaagaatatctcataccctgcatgaaactagaccaaagaaganaggtagagaaacagagaggattgacaa

SEQ ID NO: 15213 - DNA, 490 bp, Homo sapiens
aaaatgttgaagccctgagtcttcagggaagactgttctttttcactagaagaatctcacatgctccaggtattatatgaggttctaattcctactcgtttattgtaaaaatcctggagaaagctcattgatgtaacaataaaatatgaatttttccctttaatgcagccctgtaaaacacatcctcaaacctcatgtcatccaatataccttttgtattttttcttataattcatgtgtatgaatgcatagagctgctttttttaaatgaaaaaatacagaatttcacggtctttttggatttcttttaaggcctttcagtatatccaagctgaagtaacatctatgcattgttttgttattatggtaataacaagttctagtttataataatatatagtacttttttgggactaggagcaatgatatactgctttttagtaactggtaaatagtatgtttttgtctatttgaactagaaatgagaagg

SEQ ID NO: 15214 - DNA, 472 bp, Homo sapiens
aaaacaatgctctgggcaatcccacaaagcgaccacctggcccatatctggcatgactttcatgtcccgccagacattcaaggaatccgactatgttttctatataaacatatagtatttttcacatctgaaaatatacactgaattttccaggactgtgtataaatagaggtacaagaatctgagcctcccttgtcctttagtgcaatcaagcagagtatccacatactgaaatacacaacattttctgattacaaaggcccaggaatagctagttagcttgccctggtgtcactgctcactcctgtgaagaataaggataaaccatgaggatagtagtggtaatggtgaaacagaaagaacacagaaagctgattctagagtagggctatctaatagaaatatcatgcaagccaccaattggagccacatatgtggtttacatttggaagtagctacattttaaaaagta

SEQ ID NO: 15215 - DNA, 461 bp, Homo sapiens
aatgctctgggcaatcccacaaagcgaccacctggcccatatctggcatgactttcatgtcccgccagacattcaaggaatccgactatgttttctatataaacatatagtatttttcacatctgaaaatatacactgaattttccaggactgtgtataaatagaggtttggaagktgagaccagagagctggcacatcggtctctaggtcatgtactggatcatgaaacatctgatggcttctgactcccagtcccctagtccctctgttgaaccatagctacctctcagtggaaaactaaaaagaaacacaccatgtaacttgattaattatccttcctgctgtgactgctagccaacgtgccttttagttgttttgcttatatctgttgccacatgaaaattggaacatatggtctggagggccaagatggtattctaagaatatctcataactgcat

SEQ ID NO: 15216 - DNA, 406 bp, Homo sapiens
catataataatattgttaataaaatgtatctaaaattcataccaccagcacacaaggtctccggctagcagcagtaaatggcatttagtacttacttagcccccaagcctggatgactgactatactgacttattattacttttagctatttgtaggtagttacatctgaaaattgaccaggcacagtggttcatgcctgtaatctcagcactttgggagaccaaggcaggaggatcagttggggccaggaatttgagaccagcatgagtaacatagcaagaaccatctctacaaaaaataaaaattaaccaggcatggtgatgcatgctacttggggggccggggtgggaggatcgcttgagcctgggaattagaggctgcggtgagctaggaaaggtgccactg

SEQ ID NO: 15217 - DNA, 469 bp, Homo sapiens
gatattattgtatttctttgttctgcccacttggactttcctgatttcacatttgtaattttgactacttatgagtgaacttgtatcactccgggtagcactttggatgaggcatgaaatttcatttcatgagttgtgtgcttaatctttgagaaagaactttcagctaatgtgtgagtcaactctagctggccattcaacatcaacatctacatgatatgactgtttttacactgcaggcacttctaggaaattgtgtgtgtttatagtgtgctcaaacacatacttatagtgagcatttgttgttttattatttccagcatcctcccatagcctgaaaacagaactcgaactttgctttggaggaaccatttttaatcacctttcatgatatatataagattgacctcatccccaaattttaaagtgggaattgattagcttaagtcctcttgtgatctctccggcc

SEQ ID NO: 15218 - DNA, 460 bp, Homo sapiens
gggatccgtctgccctagaagagggggcaaggaaggaaaacaaagctgcaagcactgaagaatattaacaagagaataaggttgccagatttaacaaataaaaatataaaacgccggccagcttttcactgtgcccactggtcaccccttgctgggcctccaggggtctcagtaaggctggcccaggtacctgctgccctgcctggaacccacctccctaagaatcctgactgctccacaggaaccatgggctcctcagagaaatggctgattctaggactggggcaagaaatatacaagataaatctacataaaggaagtgctaaaaaaaatctccaaatcctacattaaagggacacaggagccaactggaagagctcccaacggccaaagccagaacaacttgagaaacaaaataaagtagggtcgagtcatgacccataatgaaaaaaaaaaaaaa

SEQ ID NO: 15219 - DNA, 519 bp, Homo sapiens
aaagaagaaggaagccaaagtatctgatgcactggagaatgaaaacccgttcaaaatcagaagtatagagaagttttctgtaaaatggaaatgagtatcatgaagttttaaatgaacagtgtaaaacagaagacatcagcattcattaggtcccagacctctttgagaatctgatgaaattctggacaacctctcctcccacaaacaagatgtacttgaatacctacacataaaatgttgcattcaattttggaatgtgaagagatcatttgaagccgatccagaggcctctaaggacttgactggtgcagtattggtggctgctgggtcagatgagctccctgctattccaagaaacaatacatgtttgcagccactaagatttgaggacttttgttattactgcctatcctgacagactcaggtgctacaactatttaagggctgaccggatctcactctggcacctagactggagggtactggcatgaactcctgggctcagatgtcctcccacct

SEQ ID NO: 15220 - DNA, 544 bp, Homo sapiens
attttcccagagcgagaggcagtgacactgagcgggcgcagggggccgagtcggagaccgtgccggagttcgggagcggcaacagagtggggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacaagcagagacgtcatacttggaaatggctgcaggttcagagtaagtattttaaattgg

SEQ ID NO: 15221 - DNA, 349 bp, Homo sapiens
  misc_feature 174: n=a, g, c or t
attttttcccagagcgagaggcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatnccccagtgttttggataccaatgcataggactccatagtaatcgaatttaccagagkcgaacgtcatgagcatagtgatcccattgggggttgatacagcagagacgtcatacttggaaatggctgcaggttcagaaccagaatccgtagaagctagccctgtggtagttgagaa

SEQ ID NO: 15222 - DNA, 556 bp, Homo sapiens
gtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgaa

SEQ ID NO: 15223 - DNA, 544 bp, Homo sapiens
gaagatttttagaaaaaaataaagaaaaagattttagagccacagaatctctttttagagtatgggaagaacagaaattctctgggtagagcaatttttgacagaagatgatttgggtttatatgagatatacaaaactattcttacgcatttttactgcatgccacaacttgggatttcttagtattttccacatcaaccacactactttaagtcgtctggttagaagtgtatgaacatgttataagctcagaaaatggcatgtaaaagcaatagagggccaggtgcggtggctcacgcctgtggtgccagcactttgggaggccgaggtgggcagattgcctgaggtcaggagtttgagaccagcctggccaacttggcagaacctcatctctactaaaaatacaaaaattagccgggcattatgacgggcacctgtagtcctagctactcaggaggctaaggcaagagaatcacttgaacctgggaggcggaggtttcagtgagccgagatcttgtcactgcactcagtctggcgacagag

SEQ ID NO: 15224 - DNA, 494 bp, Homo sapiens
aagaagaggctgtgcttcggcgctccggctcctcagagagcctcggctaggtgtggaaacaggaagagaactagaactggaagtaaagcattgaagatgtgactgaattgctgcaatctcatgatcaaatttgaatggatgaggagttgctttttagggatgagcaaagttgctccttgagggcaggacagttcttatggctttatccgttgcgtaasacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgt

SEQ ID NO: 15225 - DNA, 484 bp, Homo sapiens
aagagagcctcggctaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggtkgctccttgagggcaggacagttcttatggctttatccgttgcgtaasacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattagcaattctcctgcctcagcctcctgcataactgggactacagggaagcaccattttccacaaaactctcaagaaggacttgttgcaaactggaaaagcaattaaatgtgaatc

SEQ ID NO: 15226 - DNA, 86 bp, Homo sapiens
aattttttaaatgtgtgtttgtgggtgaaatggctgcgcaggtcggagcggtgcgcgtagtactggcggtggcggcgcaggaggag

SEQ ID NO: 15227 - DNA, 417 bp, Homo sapiens
aacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggsggcgaasctkggactaaggatcaccattactttaagtactgcaaaatctcagcattggctctgctgaagatggtgatgcatgccagatcgggaggcaacttggaagtgatgggtctgatgctaggaaaggtggaatggtg

SEQ ID NO: 15228 - DNA, 523 bp, Homo sapiens
cattttatgtcacaagagccttagggaagcttagattttcaggcatctgtggtatgaactttacagattattgatacataacgccaaatggctttccagagaatctacagcagaataaccatgctgatagcgagcagccttatctccttcctgtcaggcctctgagcccaagccaagccatcacatcccctgtgacttgcacgtatatacgcccagatggcctgaagtaactgaagagtcacaaaggaagtgaatatgccctgccccaccttaactgatgacattctgccacaaaagaagtgtaaatggccggtccttgccttaagtgatgacattaccttgtgaaagtccttttcctagctcatcctggctcaaaaagcacccacactgagcaccttgcaaccccaactcctgcccgccagagaacaaaccccctttgactgtaattttcctttacctacccaaatcctataaaacagccccacccctgtctgcctttgctgactctcttttcggactcagc

SEQ ID NO: 15229 - DNA, 511 bp, Homo sapiens
ttaaggacctgtcgccttcgaggtcgtgttgatctttttgtcctcttattttttcctcctctttcctctaattgctcagagtgggccgtgtcccccctcttcccactcccccgggaagatcccctaactctgcgcggatgtttgtaactcaccaaccctcgcacacagatacacatactccattcctgactgccgcgctgcaactacagctcggtgcctcctgaggctgctcggggacccaagcactggagcctcaggactcagtgctcagcctcagcgcctggcctgggtgctcagctgcctggacgcgaccgcagctgcccgaccctgcccccaccacccccaagtctcacttttctgagcaagagaagaacggttgccccgctggccccttttgtgccactgggcgagggctaaaatccctcttacggagaaagccgagtttcagtaattgctcagctcccctcataatcacactatttggttaaggctttgctgttctggagcgact

SEQ ID NO: 15230 - DNA, 348 bp, Homo sapiens
ttaaggacctgtcgccttcgaggtcgtgttgatctttttgtcctcttattttttcctcctctttcctctaattgctcagagtgggccgtgtcccccctcttcccaccacccccaagtctcacttttctgagcaagagaagaacggttgccccgctggccccttttgtgccactgggcgagggctaaaatccctcttacggagaaagccgagtttcagtaattgctcagctcccctcataatcacactatttggttaaggctttgctgttctggagcgactgctcagttggcccgattggtctatgattagacttttttatttagaaattaaaaaataaattctactcc

SEQ ID NO: 15231 - DNA, 517 bp, Homo sapiens
aacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaasctggactaaggatcaccattactttaagtactgcaaaatctcagcattggctctgctgaagatggtgatgcatgccagatcgggaggcaacttggaagtgatgggtctgatgctaggaaaggtggatggtgaaacatgatcattatggacagttttgctttgcctgtggagggcactgaaacccgagtaaatgctcaggctgctgcatatgaatacatggctgcatacataga

SEQ ID NO: 15232 - DNA, 300 bp, Homo sapiens
atatcacgctgtactctagctaaggactgggaagcaagtctatccaaggctccttcatgtaaccacgcggcagttggcaggcactagtcctagacaactgagttctccctgaagaagagttaaagcaaaataaaaactcacaaaaaggaaaacaacacgaataaaaagaactagcatgggacctaaaggacgttgctgaacaaggaaaagagcccatcaggtagaagacccagaggaacaccaggcctctgaaaactatttctgaacctaaaataaagatatttagaaaactgaaaaaga

SEQ ID NO: 15233 - DNA, 398 bp, Homo sapiens
  misc_feature 299: n=a, g, c or t
atcacgmwgtactctagctaaggactgggaagcaagtctatccaaggctccttcatgtaaccacgcggcagttggcaggcactagtcctagacaactgagttctccctgaagaagagttaaagcaaaataaaaactcacaaaaaggaaaacaacacgaataaaaaagamctagcatgggacctaaaggacgttgctgaacaaggaaaagagcccatcagctctggaggctggaaaatccaagatcaagaccctgggagattttttgtctggtgacggctgctttctgcttccaagatdntgttttcttgtggtgccctcacagggtggaagcaacagaagtgccaggcagctctctgaagcctctgtaataaaggctttaatcccatcaaaaaaaaar

SEQ ID NO: 15234 - DNA, 389 bp, Homo sapiens
atcacgctgtactctagctaaggactgggaagcaagtctatccaaggctccttcatgtaaccacgcggcagttggcaggcactagtcctagacaactgagttctccctgaagaagagttaaagcaaaataaaaactcacaaaaaggaaaacaacacgaataaaaagaactagcatgggacctaaaggacgttgctgaacaaggaaaagagcccatcagctctggaggctggaaaatccaagatcaagaccctgggagattttttgtctggtgacggctgctttctgcttccaagatggtgttttcttgtggtgccctcacagggtggaagcaacagaagtgccaggcagctctctgaagcctctgtaataaaggctttaatcccatcaa

SEQ ID NO: 15235 - DNA, 338 bp, Homo sapiens
agttgtttccgggaagcgggactccaaatgggtcgcagtcgcggccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgat

SEQ ID NO: 15236 - DNA, 311 bp, Homo sapiens
actcttaagaagggacggggccccacgctgcgcacccgcgggtttgctatggcgatgagcagcggcggcartkggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaatcacacctaaaagaaaacctgctaagaagaataaaagccaaaaaaaaaaaaaaaaaagct

SEQ ID NO: 15237 - DNA, 514 bp, Homo sapiens
ggataggccgagttccgggcgcgaggcggccaccgtggagagcagagcgcggcggctggaagctgctaagtcagagccgcgatgttccggattgagggcctcgcgccgaagctggacccggagagatgaaacggaagatgcgcgaggatgtgatctcytccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaactc

SEQ ID NO: 15238 - DNA, 442 bp, Homo sapiens
ggataggccgagttccgggcgcgaggcggccaccgtggagagcagagcgcggcggctggaagctgctaagtcagagccgcgatgttccggattgagggcctcgcgccgaagctggacccggagagatgaaacggaagatgcgcgaggatgtgatctcytccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaktttggctctggtaactgaccttcaaagctaaaatataaaactatttgggaagtatgaaaaaaaaaaaaaaaa

SEQ ID NO: 15239 - DNA, 394 bp, Homo sapiens
actatacctgagtgaagtggagacaccgaacgctcgggcccagaggcttgctcggccaccgctcctccgggacttatgtacatgggatacaaatttgagcagtacatgtgtgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaagggtcccgaatgttgttgctggcttccgtaacccagacggtttgtctcttcctcaagacctttcctaccatgaagatgtttgaatatgtca

SEQ ID NO: 15240 - DNA, 475 bp, Homo sapiens
atcatagatgtcctaatgtagcacgggtaaacaagcctactgcactgccagtcatgtaaaagtatagcacatataattatgtacagtgcataatacttgataataaataactatattactggcttatttactatactatactttgtatcattattttatagtgtactctttctacttatttaaaaaaaaaagattaactgtaaaacaacttcaggcaggtccttcaggaggtattccagaagaaggcattgttctcataggagatgacagctccatgcgtgttagtggccctgaagacctttcagtgggacaagatgtggaggtggaagacagtgatattgatgattctgatgctgtgtaggcctagggtccacagagcagtcagagaagagcaacacatgcctgtccgatgagtgctgactgagcaccaggaactgtgctagaagttagaagttaagtgatttgccctgagtca

SEQ ID NO: 15241 - DNA, 435 bp, Homo sapiens
tctcagccttccgctcccggcaggttcgcagacccaccggagctcccgagagagggccgctctacccgcccccgccccgggactgtgcccgtgctcacctggctaccaccgtagcgacactgccggcctaaggaagtaccttcggggagagaaaggagagacgggtctgttggggcgaaacatgggccccgacggaagcggctccgagccggcttctctcgtggctcccaactctccctcctttctcttcacgtgccatgggcggcggtggggcactgagggcctcctggtaaaatccgaagaggggagattcaaccggggttccatatgggctttacgaataaacaagaggttgaaaatcccagcttcgtgggagctagctacagaaagagtggattggtttcaatattcttgccccaaaaaaaaaaaaaaaaa

SEQ ID NO: 15242 - DNA, 394 bp, Homo sapiens
tgtaaatgtaaaatagatatttgatttcaaagccttagtaccaaaaaaagtaagccatttcataaataattttaatcttgaatacatattgagatattttgtatatattggaataaataaaatatatcattgaaatgaaaacctgtttcttcttaccctttttaaaaatgtaactagaagattttaaactatgtttgtgacttgcatgatatttcgtttggatagcactggtctagaaatccctaagagtaaatactttcttttttttttttgagatggagtcttgctctgtcacccaggctggagtscagtggtgtgatctcggctccctgmaagctccacctcttgggttcamaccattctcctgcctmagcctcctgagtagctgggacta

SEQ ID NO: 15243 - DNA, 276 bp, Homo sapiens
agaaaagctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctccyttcccgctgagcttcccttggacactaactcttcgccagatgataacaatggaattaggtgcct

SEQ ID NO: 15244 - DNA, 601 bp, Homo sapiens
aaggagattggcctggattatccaggtaggctcaatgtaatcaggaagggcctttaaagtgagagagggaggcagaagaggaagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatragagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaayttaatgtgtaattaagaaagaactctccaccacggggaatgtgaaaggtatatgagtcccttttcacgatgcgatgtcatgtcttttaaataagccatactttatgttcaataaaaagagaataagcaaaaaaaaaaaaaaaaaggctttc

SEQ ID NO: 15245 - DNA, 506 bp, Homo sapiens
agaaaaaagaattggatctttgactaaagaacaacaaaaacccaaacaaaaaatccaggtggattaaagacctaaatatgaaaagaaatacagaagaaaacagatgtaggggaggacttcctgagtaaaacacaaaaagcacaaagtaaaagttcaacaacaaacttactgagaacagatgaatgaaaccttgcctgtcctataaggaatacagtcatctgccagaagaaaaatggtgattcttcccagtccaaaggtgaagatggtgactgtgaaagtatcagctttagccagaccactgatgaagctcccagatgtcacagcatccatgggcttgtgatctcaggtgaaggcgttgaaccctgagccctggattcccatctcttcacttgctccctccaccaccccacccccatattcagaatggcctctaggcttctaggtttgtgtctttaatggcacctaggcaataaataaaaaatacagtgcagtgctgactgcatctt

SEQ ID NO: 15246 - DNA, 521 bp, Homo sapiens
aagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaatttaatgtgtaattaagaaagaactctccaccacggggaatgtgaaaggtatatgagtcccttttcacgatgcgatgtcatgtcttttaaataagccatactttatgttcaataaaaagagaataagcaggattcgcaaaaaaaaaaaaaaaa

SEQ ID NO: 15247 - DNA, 468 bp, Homo sapiens
aattctaatttacttcatcaatatgacaaaggaagacctttatactgtggtaaaagcatcatggattttatcattttaatattatatttttggaaaatgccatatttagagtcctaactataatttggcacagcattactatctccaaataatgttttttcctcctggactgggtcacaattcgtcagatgctccacacaggaacctctggcacagataagttaacaggttaacatccacacagagggaaatacagcataagctatatcaaggaattcctttcctggcaccttggctggagagccagaaagattgcttctttctgtggttgatgtgttgagatataaatgtacactcaggtaggagcagcaataaaagaaaataggaggacctggaaggcatttatattccttacttttagttgttttcctacagtccagatgtattgctatctttggaccctgggaa

SEQ ID NO: 15248 - DNA, 345 bp, Homo sapiens
aataactggccggcactgggccatgaatacactggatcatgtgtccactcttgggtgaggtcacccaaggctgccccttcctgagctatggcaaagcagattagttcagaaattgactgacaggtttggtagagatgccaaagagaaacaatcaaagacaacagtaaggacaactcattcttactggaaaacactggtgyacttcactgaaagaaaagcatgaacttgggcatttggtaaacttcaacaccaggtgttgttgttgttgtatgtwgttgttgytgttgttgttgttytgttrctgttragacggagtctggctgtgtcacccaggctggagctgta

SEQ ID NO: 15249 - DNA, 293 bp, Homo sapiens
aakwrrwratatgaccaywctccagctgggatcacatgtggacttttatttccmstgaaatcagttactcttcagttaagcctttggaaacagctcgactttaaaaagctccaaatgcakctttaaaraattaatctgggccagaatttcaaacggcctcactaggcttctggttgatgcctgtgaactgaactctgacaacagacttctgaaatagacccacaagaggcagttccatttcatttgtgccagaatgctttaggatgtacagthmtggattgaaagtttacagk

SEQ ID NO: 15250 - DNA, 109 bp, Homo sapiens
gggagtttctgagggtctgctttgtttacctttcgtgcggtggattctttttaactccgtctacctggcgttttgttagaaatgtcagataggaaaataaaaaccattt

SEQ ID NO: 15251 - DNA, 577 bp, Homo sapiens
accccaggatcgaagagggcgcacgggcccggccctcccacgcgccctccarggacccggcagccagacagacggacaggcggaccgctagggagctcaagtacccggacacacgcacgagcgcagaacaaagggccggacatgctccagcccgctccgcctgcgcctcggccttgcgcgcgggggcccgggttacctgcgcagagccagctgtgatgtaaagaagtttgtgctgcatgagagagatagcacctgaagaaaatgaggccctggaggatgagagactctaaaggaaaagggaagggcctgctgtcttccagccacgccagcccccaactgagaagctgggtgaagccatcttgcatctttagccccagtcaagttacctcagcaaagactagctgaccctgccaagccctgcccaagttacagaatcatgagcaaataaatggctgtttctgttttaagcttttaaattttgggggtggtttatgtgtcaataataactgaaacagataatatatacagaataaactttagttttaataatctaagtaaaagcccactaattcatttt

SEQ ID NO: 15252 - DNA, 425 bp, Homo sapiens
acaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgaggtgtgcctgcacaggagacagcaccagccaagctgattgtgtatctacagcgtttccggcctcaagactatcagcgcctgctagaagtgaacagctccagagagaggccacaggagactgaagatcctgaccastgcctgggctaggggtgtcacttcctagaaggggaagggaactctgggtctaacggatccactgcctgggcccactgtrcctstcacctcagtgtcccttctgacagtgactcctstctctccagcgct

SEQ ID NO: 15253 - DNA, 185 bp, Homo sapiens
ctctaatatttattgtgagaacctggtcaaactcttggaggtaaaactcacagaagcttgggttctccctcccctgtttctggtttcttctggaatttttgactctcagacttgtctacacttgcctctggcaattcaattacagttcatgtttttctgccctggcattggttcctttgtggaga

SEQ ID NO: 15254 - DNA, 434 bp, Homo sapiens
atatagtggtcaagagagacaaagtgatgtcaccaaagtcaaccaacttcttcctttcttctaggatggcttgatcaggaggctcttcaggtgtggctgccagcagtaccaaacttttccttacaacttagcaactctattccagcaaagtcccaggctagtcacatgccatgctaatttctgaatctgtcaccatgactctgtccaagtctggcttctgtcgagctctgaagccagaacgtgaaattggccccatgaaaccacatggcccgaagtaggaaaggaacgattttccaaaaagaaagagcctttttttttgaaaccaaagggaccatggtattaggcaaacatgcctctcaggaaagccaaaggggagatgatattctcccagacagattawaaaaaaaaaatcagrgatctaaaaaaaaaaaaaa

SEQ ID NO: 15255 - DNA, 198 bp, Homo sapiens
caacttcctggttcgagcctcctgccgccttcgcttgtaacctgggaaagaatatttgatcatgggtctggatggggccacctatgacctcgagggacagtgagtcatctggtcccctcagtctcttgtcctccccatgcctcgccacctaggccttgccctcagaagccagatgcctgtgctctccgtttccacctg

SEQ ID NO: 15256 - DNA, 501 bp, Homo sapiens
tgagatgggtttctggactcgcgavggctgcaacaaggcatcactcactgtataagtatttccatttctgagagcaaaaggaagaacttaagcgggcggcacttggagtgtaaattgctttgtagtatttaaaggcagaatggatcctgggcagccgagctgatcatgaggttcctgaggcctcctagccatgcttcctgtgcagcctatggaactcaacaaaccggcaggacttcctgtgaaatcatgaccaccatgtgctctttcagcctctatcagttcctacctctaagcacctgagagccaaagcaaaccacaggaaaccacagactcaaactaaacgtcagcttttcccggctctcaagcctgctggtccctgaactaaaactcacattatcaactctactggttcttaggmctttggagtcagactggaactacagcattgactcttccggaactccagcttactgactacagatcttggaacttttcagcttc

SEQ ID NO: 15257 - DNA, 493 bp, Homo sapiens
agctcaaaataaaagatgcagaccaggggccggacgcggtggctcagcctaaaatagattgttttttatatactaaaacccatcaggattggtaggtattgctagatgcttcaggttgtgactaaggagtgacatcatattctgatatgttttttctccttaacattttcctatattatatctcaaaagaccaaaaacaaacaaaaacttgtaattaactagtagataaaataggggtagaagttgtggtgagaacatgtcacttcctatttccagtaagacccaagtaagatagtaaaaagaaagcagagctgaggaacttggtctgttgggggtgaaggtagctggttgtaggtgtgcagagcaggaatgcatgtaagtgtagatcatctgatcttacccatcggatcgcttgtaacttgatgatactgtttttttgttgtaagactgagaaaaccctgtatttcagtgtcttaagatacagtgatattct

SEQ ID NO: 15258 - DNA, 454 bp, Homo sapiens
atacttagaaatggaagttctgattctaaatgtctaaggttacttcctagatcttttgaaggctgccatccttcagaaattggtatatttcttgaaatttttggactctggaggtctcttctcagggtataaagaaaaaacttggccaggtgcagtggctcatggctgtaatcccagcactttgggagaccaaagcagctggatgacctgaggtcaggagttcgagaccagcttggccaatatggtgaaaccccatctctactaaaaatacaaaaattaaccaggagtggtagcatgcacctgtaatcccagctactccagaggctgagacaggagaattactggaaccaaagaggcagaggttgcagtgagtcgagatcgtactacgccaggcactccagcctgggtgatagagcaagattctgtctctgaaagaaagaaagagagagagaga

SEQ ID NO: 15259 - DNA, 466 bp, Homo sapiens
aagatctggttgtttaaaagtgtgtggcacctcccccttcaccctcttcctcccgctccagcctcaaaggatgtgccggcttccccttcaccttccaccatgatggaaggtctcccgaggcctagccagccgtgcttcctggacagcctgtgggaacgtgagccgattaagcctctttataaattacccagtctcaggcagttctttatggcaatgtgagaacagactacaataccaaccaacattatcggtgtatctacaggaaaatgtctttccctacaaaagcmaatccataaaattagaagaaatgactgttacaccagatgctcagatatcaacacaaggacacaagaaacacacacacacaaaggaaacgtgacgcctccaaaggaacacaatatttctccaggaacagatcctaaagaaatgatgaaatgctcaaaaaaaattcaaaataagtttaaaa

SEQ ID NO: 15260 - DNA, 199 bp, Homo sapiens
ataggggcgggaacagccagcgggcgtcccatcggcttttgggtctgttacccaaagaatgataaagttggttttatttcaagaagtcgatcaaaaagaaagccccagcgctctagagctcagctgacgggaaagggggtgcgcasctcgagtttgagagctacccggagctccaagacaggggtgggttccagctgcc

SEQ ID NO: 15261 - DNA, 402 bp, Homo sapiens
tggacaaatggacctgcggtaggagagagggacaacagtaggagcaggcagatcttgctgtttcaaccaaaacctcatgctgaccagagttgaggaacagaagaagatggtgaaggcctgcaggtataggtgttcagcatgtcatctgaaatattccccacagaggcaaaaagaaaggaaattatctctgaaaaggaatgggaggacaagtcagcagaatatgtcaatgttttggttgaagaagctgcttgaatctgggcttttctgtgccatgtgttctcccagggccagcacaaagatgggcttttggtgcaggcccaagaccaccataatcatcattgattattcctctccacgccagtgtctctaaataaactttctcttctttctctgaaaaaaaaa

SEQ ID NO: 15262 - DNA, 448 bp, Homo sapiens
aacttgttatctattgcaggaaagtgcctgcaatatgccattgtgacaaggcaccatcaatcatcatgtccctttaccaggagggcccgtgtcataagccactatataaagggaatgatgggtggactgctttggacaaatggacctgcggtaggagagagggacaacagtaggagcaggcagatcttgctgtttcaaccaaaacctcatgctgaccagagttgaggaacagaagaagatggtgaaggcctgcagtcagcagaatatgtcaatgttttggttgaagaagctgcttgaatctgggcttttctgtgccatgtgttctcccagggccagcacaaagaagggcttttggtgcaggcccaagaccaccataatcatcattgattattcctctccacgccaggtctctaaataaactttctcttctttctctgaaaaaaaaaaa

SEQ ID NO: 15263 - DNA, 492 bp, Homo sapiens
aaaatggacctgcggtaggagagagggacaacagtaggagcaggcagatcttgctgtttcaaccaaaacctcatgctgaccagagttgaggaacagaagaagatggtgaaggcctgcaggtataggtgttcagcatgtcatctgaaatattccccacagaggcaaaaagaaaggaaattatctctgaaaaggaatgggaggacaagagcctccctctaatcttgtccatgcagtaaagagagatcacacgaaccctggacctacctctttgaggtggtactctcaaactctttgaagtcagcagaatatgtcaatgttttggttgaagaagctgcttgaatctgggcttttctgtgccatgtgttctcccagggccagcacaaagaagggcttttggtgcaggcccaagaccaccataatcatcattgattattcctctccacgccagtgtctctaaataaactttctcttctttctctgaaaaaaaaaaar

SEQ ID NO: 15264 - DNA, 381 bp, Homo sapiens
gggcacagaactgcgggaaacatggcagtgaaaaaaaggaaacccgtgggggaccttacagttgtttagtgtgaaagctgaaacagggcaaagcagggccgggcatggttgcgcatgctataatcccagtgctttgggaggctgaggcgggtggaatacctgaggtcgggagttggagaccagcctggccagcgtggggaagaccccgtctctactaaaggtgcaaaagccggccgaacatggtggcgcacgctgtggtcccggctgcttgggagactgaggcagcagaatcacttgaacccgggagtggaggttgcagtgagccgagttcgcgccactgcactccagcctgggtgacagagtaagactctgtctccaaaa

SEQ ID NO: 15265 - DNA, 530 bp, Homo sapiens
aaaagtctcacctaggttgagaaggaaggggaatagacttcagctcttgatgaaaagtggcaggattctggaaaagcacataggaaacattgctgtggccagtttcagttaatacagtctgcagtcggtggtcacctgtccaaaacagaattacattaaacgaggctgcttgtaaagtgaggtgcaaatccatactgaagactataatttcatgtactgctacatcctgcggagtgattaccagataaagtacctcagtggctacataaaagtcatttgcagcaactattcaatttccagaattaggttatacttgtgtttgtggttgttttcctgaggaaataatctaataatcagaaaagctaatatttatttgtgtttataagagccaggcactgtggtattttttgatttaatgagagaaattcgagcgagaaagatggaagacagcaaagaaaagaatggaaaaaagaagaggaaaagtttagccaagagaatcagagaaagatgctgcattttataatcaaagc

SEQ ID NO: 15266 - DNA, 437 bp, Homo sapiens
acaaaaaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggcgttcaggccaaggcgtacaagatcgcgccgccctgtagcttgaggaggcgccgggattcgaaccaaggctgtgccaatcctaagccctgcgaggtcttgtggaccgacatgacccactctttggtttgtccagagacagtgagcagggtgagttcagtgctgaatcgcaacactcggcagtttggaaaaaaacatcttttcgaccaggatgaggarrcatgttggaactcagaccaggttcacagggca

SEQ ID NO: 15267 - DNA, 488 bp, Homo sapiens
tatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtccaagcaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttatttgtgggagctgaagaaagtatttgaaatcatctaattttttcacat

SEQ ID NO: 15268 - DNA, 201 bp, Homo sapiens
atctgaatcaggaaataaaattctggaaggacgatcttcccataaatacataaagtccagggaaaactacagtgaaaacagaattgtcaggatcaactgtgtgactgataaggcaaatggggataggaaatgtctgaggccagaataaacaactgctcaacaaaaaaaaaaaaaaaaaaaaaaaaaaaaaaaaaaaaaaar

SEQ ID NO: 15269 - DNA, 201 bp, Homo sapiens; identical to SEQ ID NO: 15268

SEQ ID NO: 15270 - DNA, 180 bp, Homo sapiens
atctgaatcaggaaataaaattctggaaggacgatcttcccataaatacataaagtccagggaaaactacagtgaaaacagaattgtcaggatcaactgtgtgactgataaggcaaatggggataggaaatgtctgaggccagaataaacaactgctcaacaaaaaaaaaaaaaaaaaaa

SEQ ID NO: 15271 - DNA, 163 bp, Homo sapiens
atctgaatcaggamataaaattctggaaggacgatcttcccataaatacataaagtccagggaaaactacagtgaaaacagaattgtcaggatcaactgtgtgactgataaggcaaatggggataggaaatgtctgaggccagaataaacaactgctcaacar

SEQ ID NO: 15272 - DNA, 226 bp, Homo sapiens
cttttttcttttccgtggcgcctcggaggcgttcagctgcttcaagatgaagctgaacatctccttcccagccactggctgccagaaactcattgaattggacgatgaacgcaaacttcgtactttctatgagaagcgtatggccacagaagttgctgctgacgctctgggtgaagaatggaagggttatgtggtccgaatcagtggbgggaacgacaaacaaggy

SEQ ID NO: 15273 - DNA, 512 bp, Homo sapiens
  misc_feature 18,484: n=a, g, c or t
ctcttcgcttcgcctgcnaacgcggtgggggctgctcggcggtcaggagcaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatggcaaaagaggagccccagagtatctcaagggacttgcaggaactsagaagaagctgtctctgctgatagactccttccagaataactcaaaggtggtggcctttatgaagtctccagtgggtcagtacttkgacagccatccgtttctggccttcaccttgctggtgttcattgtcatgtcggccgttcctgttggattcttcctgctcatcgtggtgcttacnacctggctgctctgctgggggtcataat

SEQ ID NO: 15274 - DNA, 187 bp, Homo sapiens
  misc_feature 162: n=a, g, c or t
cttttttccgtggcgcctcggaggcgttcagctgcttcawgatgaagctgaacatctccttcccagycamtggctgccasaaactcattgaagtggacgatgaayscaaacttcgtactttctatgagaagcgtatggccacagaarttkctgctgacgcyntsggtgaagaatggaaaggttatgw

SEQ ID NO: 15275 - DNA, 155 bp, Homo sapiens
ctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttkctgct

SEQ ID NO: 15276 - DNA, 149 bp, Homo sapiens
ctcttttccgtggcgcctcggagggttcagctgcttcaagatgaagctgaacatctccttcccagccactggctgccagaaactcattgaagtggacgatgaacgcaaacttcgtactttctatgagaagcgtatggccacaggaagtt

SEQ ID NO: 15277 - DNA, 224 bp, Homo sapiens
ctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtcccgaatcagtggtgggaacgacaaacaaggttt

SEQ ID NO: 15278 - DNA, 157 bp, Homo sapiens
ctctcttttccgtggcgcctcggaggsttcagctgcttcaagatgaagctgaacatctccttcccagccactggctgccagaaactcattgaagtggacgatgaacgcaaacttcgtactttctatgagaagcgtatggccacagaagttrctgctg

SEQ ID NO: 15279 - DNA, 533 bp, Homo sapiens
  misc_feature 499: n=a, g, c or t
tgatgtttggagaatcatgtgataactctttcaaacagtatcctatgctgatttataaccccaatccagatgtctctaactatcttaataggaattgcacattttaaacaggtagagttaatatttgcttataattggaagtgacatgaaatcaaacaataaaaccttatcatgactgtaaaaaattgagaattgctgtttaatagaacataggtactgaagattcaatttaatccatatattcatacttaaaaagacaacatagaatattatagtgctcctacttttaagaactagctatttatcaacaagtgttaacttgtggtgtactaagtgcaagagacagcctttagcccgaagatagtgataaaaatgacatakkygctttgggaggctgagamrggtggatcacaaggkcaggagatcgagaccatsctggctagcatggtgaagccccgtttctactaaaaataaaraaaaatkggatggggrtgttggnttatgcctgtaatmccagcactttgggaggctga

SEQ ID NO: 15280 - DNA, 459 bp, Homo sapiens
catttaaaacagaaatatgctagaaaaaattgcaaatcactgatacgacatccatgttatacaaagctaatttcccttagttactgtgatttgattttatgttctcgttcgtttttaaaatttattttttttttcagtttcttttggtttgatgaatgtcaaacggtctctagtggttttggtttttatcttcctaatcaattatattgtgcatcttttccttcttcattaaggtttttaaagataggagaaagcttagatatgacttactatattacagtttctgcttttactgattattcaacagacccaaagagattaagatcccatattaaggtacaaaactaagattagaagtatagtgaggcactacctatagcaaagcctccccatacttaaaaagataaaatgttctctgtgcatttgaaaatacatttttattattaataaagaaagtgg

SEQ ID NO: 15281 - DNA, 460 bp, Homo sapiens
ttgtaagttaattgtttaattctccttgtgactagttattcatttcagtataaaatatcgttatcatttctaagtttttacagaggaaatatttcaagaatgttttcatccaaaagggaacatgagaagagacaggatcacatgttctaagtgcatgatttttcaaacagggaacaaaagcctctgatgagtttcttgtctagtaaaacataaaatgctaagatggggttggaggtgtatgtgggagtagggacaaataagaatagagattatcaattagaaaccataaaatttaaaatgaaaaaaaaaataccagctaatacattgcaccattctgtcagatgagaaaatgtactgaaaaaattgccatagacaagtcctggtccatgacaaaatattcaccaaataacagttgaaatgtaaaaaawtaaatagaggraaagctgtagawtttcatgaa

SEQ ID NO: 15282 - DNA, 506 bp, Homo sapiens
ttgtaagttaattgtttaattctccttgtgactagttattcatttcagtataaaatatcgttatcatttctaagtttttacagaggaaatatttcaagaatgttttcatccaaaagggaacatgagaagagacaggatcacatgttctaagtgcatgatttttcaaacagggaacaaaagcctctgatgagtttcttgtctagtaaaacataaaatgctaagatggggttggaggtgtatgtgggagtagggacaaataagaatagagattatcaattagaaaccataaaatttaaaatgaaaaaaaaaataccagctaatacattgcaccattctgtcagatgagaaaatgtactgaaaaaattgccatagacaagtcctggtccatgacaaaatattcaccaaataacagttgaaatgtaaaaaaataaatagaggaaaagctgtagaattttcatgaaactaaatgtatcaaaatgaaatgattattcattagtatgagttta

SEQ ID NO: 15283 - DNA, 641 bp, Homo sapiens
  misc_feature 47: n=a, g, c or t
acattcccccgaccccctccagcagtgaagtctaagagcaccgcganagtaatttaaattttcgagggaaagcacagcgccatctgtcggacatcatgccaattactcttgttaagttcctacctgacggttactttatactttgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaagaatgttttctctcttcaagattctcttttgaaagacatctaaaaagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactc

SEQ ID NO: 15284 - DNA, 295 bp, Homo sapiens
aaaggaaaaaaaggataactgacaaaccacagctattcagacttgggacttgggaatctgttatgttaatgggctgctttttttgtttgtgtctttgaggcagggtctctgtggcccaggctggagtgcactggcgccatcacgactcactgcagcctcaaagttccaggctcggctgaggtaggagaatcgcttgaaactgggaggcagttgttgcagtgagccgagattgggccactgcacactccagcctgggcaacagagccatactccgtttcaaaaaaaaaaaaaaaaa

SEQ ID NO: 15285 - DNA, 445 bp, Homo sapiens
caaaccaaaaaaggaaaagcagctaaactcacactaatacaacataaatacatgtaaattttaaaagcgattgtcttaccctcagtaccatactactttttgcaacctatagtatttccgaataactcacttatttaacaaataatgatggaatacccagcaaggccttactctttttcaaggtggtgagaatgtagcagtaaataaaacagacataatctccctgcccatgtggaacttaagttctggcggaaggaaagagacactaagtaaattatctggttcatcagaagataagtaccatgggtcgtgcgcagtggctccctcctgtaatcccagtgctttgagaggctgaggtgagtggatcacttgaagccaggagtttgagaccagtcggggcaacacggtgagactccgtctctcttaaaaaaaaaaaaaaaaaggc

SEQ ID NO: 15286 - DNA, 292 bp, Homo sapiens
aatctttcttacctacacctcagaaaggaagcacttacaagggtgaataaaaaaaggccagtgcagtctctagcaaatacagctctttaatgaaatctccagaggaagaagagagaataattttcatgacaattagaagatagacagagactgaacatcactggaggcaaataaattgcttagaagactttgaaaaaaaagtccaaatgagagatgaagagcacccaaaccaagaaactggcagtgctcatggagagcaagaggatgtgatacagagatccacattaggtgt

SEQ ID NO: 15287 - DNA, 378 bp, Homo sapiens
gcggatggaatctcaatctttcttacctacacctcagaaaggaagcacttacaagggtgaataaaaaaaggccagtgcagtctctagcaaatacagctcttaatgaaatctccagaggaagaagagagagctgcagctagacgtggaggcaagaagaaggagccatatactactaccccttacattacctcttctcttctggagttaagttgccggacatggtgtctgcaaccttactgagacaaggctatttgaaacaccacaagggcaggacttgtgctgttcagaactctacatcaggtgaaaggtcaagcagacttcatcagagttgcagaagtttcttgcaagtaattctaaaacacttggaatgtacaataa

SEQ ID NO: 15288 - DNA, 503 bp, Homo sapiens
cacacgggcggacacacacacacgcgcgcacacacacacgcacagagctcgctcgcctcgascmacgaacgtggacgttctctttgtgtggagccctcaaggggggttggggccccggttcggtccgkgggagatggcgcscatcctgggccatgggagcctgcagcccgcctcggccgctggctggcgtccctggagctcgactcgtcgctggaccagtacgtgcagattcgcatcttcaaaataatcgtgattggggactccaacgtgggcaagacctgcctgaccttccgcttctgcggggtacttcccagacaagactgaagccaccatcggcgtggacttcagggagaagaccgtggaaatcgagggcgagaagatcaaggttcaggtgtgggacacagcaggtcaggaacgtttccgcaaaagcatggtcgagcattactaccgcaacgtacatgccgtggtcttcgtctatgacgtcaccaagatgacatctttca

SEQ ID NO: 15289 - DNA, 377 bp, Homo sapiens
catcatcaggaaagccaggcagcgcgtctctgtggttgggagatgctttctaaggccctgctgaactccaagaggccatgagaagcatatagtcttctaaacagaaaagcattaactctagcactctctggagcccctcccaccacacacggtccccagcaggtgcacagcctcaaacagcatcactgggtgggggctgagtaccaagaagtgtggtgacctgcccagggttgaaaactttcttagttcaatactgttgcccagattgttccccacaaaatcacaaaagaagttaagaggttcctggccggacgcggtgactcatgcctgtaatcccagcactttgagaggccgaggcaggcagatcacaaggtcag

SEQ ID NO: 15290 - DNA, 533 bp, Homo sapiens
ctcagactcttgttgaaacagcttattcattgtctctatttggatgtctaataggcatctcagacttaatatgtccgcagctgagttcctgatactaacctgttctgccttgagtcttcattatccagtaaatagcaactccatccttctagtttaggtcccttgcagtcatcctggactcctttctctcacatcccatatccaaactgtcaagaaagtcttgttggttctatctataaaacatattcagatcccaggcggggcgtggtggctcaacgcctgtaatctcagcactcggggaggccaaggcaggtacattgcttgagtctaggagttcaagaccagcctgggcaacatggcaaaactctgtctactaaaaatacaaaaaattagctaggcgtggtggcacgcacctgtagacccagctacttgggaggctgaggtgggagaatcgcctgagcctgggaggttgaggctgcagtgagcccagatcacaccactgcactccagcctaggtaaccagagtgagactc

SEQ ID NO: 15291 - DNA, 404 bp, Homo sapiens
accctcagccgttcctccacctctcagccatatctttcagccccccctcccctggatccgtgtgtgtgtgtgtccgtgtgtgtgtccccctgtaaatagccagctgttatttatacatatataatattatatatatktggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtcsctstsctttccttsttcttccctcagatttagcdgatccttsctcccaccctggccttcctttcctctttcctcctcactctccccgtcatgctccctctgmscgccctg

SEQ ID NO: 15292 - DNA, 230 bp, Homo sapiens
tctagattggagggtacagggcagcagctcacaggtgcccattagcacatcccacaagcagtcacggcactgcacttgcactggaaacagcttctcattttcccgggagtaccttctgccaactttgagaacaccaattcctaattcctgttccagtatccactttggttttatacataggacatcttttcctataagttttccctgaatgttttgtttttttttttttt

SEQ ID NO: 15293 - DNA, 534 bp, Homo sapiens
tcattccctgccccaggaagggacccagcctcaccctcctggggtggccccgtgttcctcctgcccaccctgcsccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctcsssctttgctaggagttgggtgggaagagagggtggcctctgtgccccaggttgtcagtggaggggaaggggtgtcactgcacctctgtgggactgtcatgccagtgtgcccasctgactggtctacatcctaaagagatgtaccgtcccccctccatgcgggcacaccactcccaggagccaagctggaggaccgcgacstgggctgggagcagagctgactgasatgggtggaggtgacctgagccaagttctctggcacttgctggga

SEQ ID NO: 15294 - DNA, 142 bp, Homo sapiens
aagttatttcgcaaccttcatctgttcctggaagatacccgtagcctgccttccttcttgacaggctgatttaggggtgctccccaagaagatcaggactgctgaaagaatgaagaagaacttacttggcctaggatgtggc

SEQ ID NO: 15295 - DNA, 73 bp, Homo sapiens
asttatttcgcaaccttcatctrttcctrgaagatacccgtagcctrccttccttcttracaggctgatttag

SEQ ID NO: 15296 - DNA, 412 bp, Homo sapiens
accctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggscttcctttcctctttcctcctcactctccccgtcatgctccctctgssccgccctgaaaaaaa

SEQ ID NO: 15297 - DNA, 564 bp, Homo sapiens
aaaatccggatcgttgggactgcggtcgttagtctccggcgagttgttgcctgggctggacgtggttttgtctgctgcgcccgctcttcgcgctctcgwwatcattttctgcagcgcgccasagggatgggcccacaagcagatctactactcggacaagtacttcgacgaacactacgagtasccggcatgttaatggttaacccagagaactttccaaacaagtaacccttaaaactcatctgatgtctgaaagaggagtggaggagacttggtgtccaacagagtctaggctgggttcattacatgattcatgagccagaaccacatattcttctcttttagacgacctctttccaaaagatcaacaaaaatgaagtttatctgggggatcgtcaaatctttttcaaawtttaatgtatatgtgtatataaggtagtattcagtgaatacttgagaaatgtacaaatctttcatccatacctgttgcatgagctgtattcttcacaggcaacagagctcagttaaatkgcaactgcaagtaggttactgtaagatgtttaa

SEQ ID NO: 15298 - DNA, 172 bp, Homo sapiens
agtctccggcgagttgttgcctgggctggacgtggttttgtctgctgcgcccgctcttcgcgctctcgtttcattttctgcagcgcgccasaggatggcccacaagcagatctactactcggacaagtacttcgacgaacactacgagtaccggcatgttatgttacccaga

SEQ ID NO: 15299 - DNA, 491 bp, Homo sapiens
aatctaattttagaacattttcaatgccccccaaagaaactctctgcaggcctgggcaacatagtgagaccctgcctctagaaaaatttttttgattagctgggtgtggtggcactcacctgggaggctgaggtgggaggatcccaggagttagaggctgcagtgagccatgatcatgccactacacttcagcctgggcaacagagcaagaccctgtctctattgaaaaaagtggtgggaagtgggggagaaaccctgtgctacagcagtcttcctgattcctgcttacccatctcctactccatccccagacaatctctctatggattggcctattctgacatttcacatcagtcatctgttgcttaatgacagacacacatttggagaaatgtgtcattaggcaattttcttcatgtgtacacatcaaagagtgtccttacacaaacctaaatgggacaacctactgcagacctaggctgtatgacaga

SEQ ID NO: 15300 - DNA, 416 bp, Homo sapiens
aataacaccaactgtcacacttcctctcaccccctgcttcccaccctggtcctggtacaagatgctcttatgatccaagcactccccatgtggatgaggctggcaaaggatgcagtgttggtgacccctctagagtcatttagcttgtgttgagttcacagaacattagcagtcatgttgcttggaccttcttctgcccagtgcatatatgaaagtgttgataaatgtgttccatggctgttctggaagttcatgtgtagaatcctgttttgtgcttttgaataatttttctttagtgtattgaaaaatcttccataacacattgatgaaagtttatgtctctgggtagggaagagcagaattttgtggatggggagtcttcgtcaaaaagaacatttataacactaagtgggaga

SEQ ID NO: 15301 - DNA, 412 bp, Homo sapiens
gtagtggtagttatttttgcaagtgggtgttatgcaatgatggttatattcaaaatcctgaacctacttttctatacctttgaggtagtaattaagtttaagaatcacggccaggcgtggtggctcatgcctgtaatcccagcactttgggaggccgaggcaggtagatcacctgaggtcaggtgttggagaccagcctggccaatgtggtgaaactcgtctctactaaaaatacaaaaattagctgggtgtagtggcaggcgcctgtaatcccagctactcgggaaactgatgcaggagaatcacttgaaaccagaaggtggaggttgcagtgagccgagatcacgccactgcactctagctcgggtgaaagagtgaaactctgtctcaaagaaaaaaaaaaaaaaaaagc

SEQ ID NO: 15302 - DNA, 53 bp, Homo sapiens
stmttsgtagttatttttgcaagtgggwgttatgcaatgatggttatattcaa

SEQ ID NO: 15303 - DNA, 784 bp, Homo sapiens
agtagcactcaaccgttaatagggaaccagcagagcgctggaggctcattagaggaatcgttagagccggtcgttaacgcatcaacctctggaaaggacagggaaacaggaaccaccgtccagacactttcggagcttctgtctcgatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtactataaatgtcttctgctgctaatatttatctcagcactttctaaacccaaaagtgctacctaagaagaaatttagccaaaaaatacccagctaaggtagccatagccaagtgtatttaagtatgttatagaatatatttgaaagcttcctttcagtttgagctttgtatctgctgtggaactgttatggttgattgggtagttatttttcattcttataaggttcaaagtaacagctgaggatttagaaaacaagaataccaaatagaatacgaaataataaagataaaccaaaaaaataccaaataataaagatttttaagaaatggaaaaaaaaaaaaaaatgcgaa

SEQ ID NO: 15304 - DNA, 488 bp, Homo sapiens
aacccatattttattttctaaattgttttttctaattgaggaagcttttattcctccttctcccctctcaattcctgtccctctctctgtccttccttttccctcatcctctttctctttctctcaaacctcatttttcctttgaaaagtttcaagtagaattaattcagtgttctcagccgagttccagcataaagagctcactatgcacttcgacagaattatctcctttgaagaatgcccactttaatctcctctaagacaggtttttgtggtgttagaacaaaatgacataatactcttcaagctaaatggcttattaagtagcattcagaaaatcctgcaacttcctcgtaattggaggcttaattgggtgggtttagtagcatttggttattagggctaatcaaatattccagaataattgactcaacttttttttgggggggggcaattatcatctctaatattgttgtgattaaaaagat

SEQ ID NO: 15305 - DNA, 445 bp, Homo sapiens
ggctccacttctaattctagtttttcccaccacatctgcagttatttcatccatgaggcttggaataaactcctccaaactcatattcatgttaatattctgatctgctcccatgaatcacaaatgttcttaatggcatctagaatggtgagtcctttccagaaggttttaatggacwttgcccagatccatcagagaaatcgccatgacaactacagccttacaaaatgtatttcttaaataacatgacttgagccaggctcagtgactcatgcctgtaatcctagcacttccagaggctgagacgggaggattgcttgagtccagaaatttgagacctgcctgggcactatagggagattstctctctataaaaattcttaaaaaagttagctgggcatggtggtgcatgcttgtggtgccagctactgggggaggctgaggt

SEQ ID NO: 15306 - DNA, 491 bp, Homo sapiens
ttataaacttttagaatagaataaaatcctggaattactcagatatatttgtaagtttcatccaaacatttataaatttatgtcagatagcagaagaggattgtgaaaatattttaactttcaccaaaagttaaagctagcacgtggtcttgggggaaaattctttagatccactttaatatgtgtctttttataatttgaataaattaccctgtgggaatgaaaacctctattctgggttttaattttgtgtttgggatattaacattaacctctgcattctgttgtgttgtgtttttccctgttttaagattacgggcagggacgacctgtcaaagcgcggagtggaccaaacctgcactcgagtaattagcaaagcaactccggccctacccacggtctccatctcatctagtgctgaagtctgaggactctgcagcatcagacccacctctaagagaactttctgaattttgcagctaatctcgggg

SEQ ID NO: 15307 - DNA, 480 bp, Homo sapiens
ttataaacttttagaatagaataaaatcctggaattactcagatatatttgtaagtttcatccaaacatttataaatttatgtcagatagcagaagaggattgtgaaaatattttaactttcaccaaaagttaaagctagcacgtggtcttgggggaaaattctttagatccactttaatatgtgtctttttataatttgaataaattaccctgtgggaatgaaaacctctattctgggttttaattttgtgtttgggatattaacattaacctctgcattctgttgtgttgtgtttttccctgttttaagattacgggcagggacgacctgtcaaagcgcggagtggaccaaacctgcactcgagtaattagcaaagcaactccggccctacccacggtctccatctcatctagtgctgaagtctgaggactctgcagcatcagacccacctctaagagaactttctgaatttgcagct

SEQ ID NO: 15308 - DNA, 490 bp, Homo sapiens
agtataaattaggttgtctcttaatttgttagtcccatttcactgagcagaatactgaagccagaaagttaagtaactggagatcacacggctgagtcctaaggatcccctgagctcagaacattaaacctcgagagagaagtgattgggatctaaatgttgaagtggttagattgtgttgaggaaagtgtctcctggtaaggagatataacatcctcaggtagacttaaaaaacaaataagccgggcgctgtggctcacgcctgtaatcccagcactttgggaggccgaggcgggcggatcgcgaggtcaggatatcgagaccatcctggctaacagggtgaaacccgtctctactaaaaatgcaaaaagttagccaggcgtggtggcgggcgctgtggtcccagctgctcaggaggctgaggcaggagaatggtgtgaacccaggaggtggagcttgcagtgggccaagattgcaccactgcactcca

SEQ ID NO: 15309 - DNA, 606 bp, Homo sapiens
agtagcactcaaccgttaatagggaaccagcagagcgctggaggctcattagaggaatcgttagagccggtcgttaacgcatcaacctctggaaaggacagggaaacaggaaccaccgtccagacactttcggagcttctgtctcgatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtactataaatgtcttctgctgctaatatttatctcagcactttctaaacccaaaagtgctacctaagaagaaatttagccaaaaaatacccagctaagggtagccatagccaagtgtatttaagtatgttatagaatatatttgaaagcttcctttcagtttgagcttgtatct

SEQ ID NO: 15310 - DNA, 511 bp, Homo sapiens
attctatgttctagtctccctgctagaaacaggatgtccttcatgccttatcccagagtctcctgggaccctggcatataagacccaggattgctgctttctagaatcctccagggtcagtgcaagtgggacacatgcagataaaattccgtctaacccaagcagcttttctgagcctcagggaaccagctcacagtgaatcccaagtttctgttactccttgccgcccatctataaactgacttcatggatgtttggatgtgtgtgcggatgttctgactcattggactcggacaagttggtaactctgaactttcttcatatccatctaatcatggcactcaaaatgaattaacatacttgagaatttgaaaagatcaaaaatattttctctgatatggacttactactactgctgtatatacacagacaaatgatagtggctatgttccaacaaaactctatttacagaaacaggcaaaaattggccagtaggctgtccatttgctaa

SEQ ID NO: 15311 - DNA, 497 bp, Homo sapiens
ctagatcattttatgagagccataaagattatttgtcttggttgctgcattagtaattttcttcttccttttccttctgctattttaaagacttagccctgtgtatgtgtttttgctcatttttttgatgatggaatttgaccttaataacagtgaagacaaattaacatagtgttattagaatgtgaataggtttttattcagagtttaataccaatggattacatatgtttagtcctgttggaatgttaaacagatatgatctactaaattaaatagatatggattacagatgagatcatctatgatgttgagttaaaagttcacaataatgtaagaatgttcggcatggtacagtggctcatgcctgtaatcccagcactttggtaggccaatgcagaaggatcgcttgaggccaagagtttgagaccagcttgggcaacatagcaagacccgatctctacaaaaataaaaattaaaaaaatgagcaggacatg

SEQ ID NO: 15312 - DNA, 159 bp, Homo sapiens
accatacgaagttgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaa

SEQ ID NO: 15313 - DNA, 210 bp, Homo sapiens
accatacgaagttgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaawwaaaammwwrraarrraaarraaaaaawthaaaaaaaaaaaaaatgcgaa

SEQ ID NO: 15314 - DNA, 195 bp, Homo sapiens
accatacgaaktgcagcaagaagatgctatctatgaagcagagagtgagcctcattagacatagaatatggtgtctccttgatcttagacttcctagcctttagaactgtaagaagtaaaatcctgttatttgtttaaaaaaaaaaaaaaaaaaaaaaaaaaaaaaaaaaaaaaaaaaaaaaaaaaaaaaaaaaw

SEQ ID NO: 15315 - DNA, 490 bp, Homo sapiens
cagaatttaattttaaaatatctgtaaccttacaacagaattatatcctgtggtttgggagtttaaaagaggagtacattctcatttggaattcatcccaaggattagcaattactgaacaataaaacagatgattctcacagaagtaaagggaaagggggaaagaaaagcatgtataagagaattggatggaaggagggagatatttttagcctttgtatttctcgaaatacaaatgtaacacattgagttaaaaagaaatcaatccatttggttcttttttaatgtattttttttttaacgtttgctttggtagccttggcagcaaacaaaccawaatggaaaaataattctcttcttcttcttcctttttaggaaaaacctccataccttggattctagatccctgggtcccytaccccaggtgggcactaatagcttactcagtggtattgaggctgtccagcagaccatccmactttgatttggg

SEQ ID NO: 15316 - DNA, 168 bp, Homo sapiens
accatacgarktgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaaaaaaaaaaaw

SEQ ID NO: 15317 - DNA, 194 bp, Homo sapiens
accatacgaaktgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaaaaaaaaaaaaaaaaaaaaaaaaaaaaaaaaaaaaav

SEQ ID NO: 15318 - DNA, 166 bp, Homo sapiens
  misc_feature 126: n=a, g, c or t
accatacgaagttgcagcaagaagatgctatctatgaagcagagagtgagcctcattagacatagaatatggtgtctccttgatcttagacttcctagcctttagaactgtaagaagtaaaatccntgttatttgttaaaaaaaaaaaaaaaaaaaaaaaaaaaaa

SEQ ID NO: 15319 - DNA, 173 bp, Homo sapiens
accatacgaaktgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaaaaaaaaaaaaaaaaa

SEQ ID NO: 15320 - DNA, 180 bp, Homo sapiens
accatrcgaaktgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaaaaaaaaaaaaaaaaaaaaaaaa

SEQ ID NO: 15321 - DNA, 215 bp, Homo sapiens
accatacgaagttgcagcaagaagatgctatctatgaagcagagagtgagcctcattagacatagaatatggtgtctccttgatcttagacttcctagcctttagaactgtaagaagtaaaatcctgttawttgtttaaaaaaaaaaaaaaaaaaaaaaaaaaaaaaaaaaaaaaaaaaaaaaaaaaaaaaaaaaaaaaaaaaaaaaaaaaaaam

SEQ ID NO: 15322 - DNA, 178 bp, Homo sapiens
accatacgarktgcagcaagaagatgctatctatgaagcagagagtgagcctcattagacatagaatatggtgtctccttgatcttagacttcctagcctttagaactgtaagaagtaaaatcctgttatttgttaaaaaaaaaaaaaaaaaaaaaaaaaaaaaaaaaaraaaaaaaa

SEQ ID NO: 15323 - DNA, 179 bp, Homo sapiens
accatacgaagttgcagcaagaagatgctatctatgaagcagagagtgagcctcattagacatagaatatggtgtctccttgatcttagacttcctagcctttagaactgtaagaagtaaaatcctgttatttgttaaaaaaaaaaaraaaaaaaaaaaaaaaaaaaaaaaaaaaaaaw

SEQ ID NO: 15324 - DNA, 450 bp, Homo sapiens
tcgatgacattattgaccattaggaagaggctagcctcctgccctttaatattacatcttaattagataaattaaccaagtggaaatctggactatatccatagctcaaatttggtcctctccacacactttcataaaacatttctggggccgggcgcagtggctcacgcctgtaatcccagcactgtcggaggccgaggcgggtggatcacctggggtcaggggttcgggatcggcctgaccaatgtggagaaaccccgtctctactaaaaatacaaaaattagctgggcgtggaggtgcacacctgtaatcccagctactcgaaaggctgaggcaggagaattgcttgaacctgggaggcagaggttgcagtgagccaagatcgtgccattgcactccagcctgggcaacaagagcaaaaaattccgtctcaaaaaaaaaaaaaaaaa

SEQ ID NO: 15325 - DNA, 573 bp, Homo sapiens
aaagctcccagaatccaattggatgctgggttgcagggtggttagagctataggcagtgagctgaggcaggaatcagatggctttacccatggagatttttgttgctggctaatttgctacatattcttagaactggtttgattaagaaaaaaaagctgttggtgtggtgactggaagtctaacaacaatcaccacaatagatatctgcagccctgaaaccaattttcaggcttgaatttcttttacttttcttctttctttcttattgtgtgtctccaagtcctgagtctactggggttatgtagaaaaaaagttttaaacatttttttgggaaataattgcaaagttacagctaaattataagaaaaaaagaagagttctacactktgggaggccgaggcgggtggatcatgaggtcaggagatcgagaccatcctggctaacaaggtgaaacccgtctctactaaaaatacaaaaaattagccgggcgcggtggcgggcgctgtagtcccagctactcgggaggctgaggcaggagaatggcgtgaacccgggaagcagacttkcaagag

SEQ ID NO: 15326 - DNA, 381 bp, Homo sapiens
ctacaaattaatatctctaagagggtaattcccaatttaacagaaaattggaccaatttcagacaaaaacaaatctcatagaaaacacacacttgttggccgggcgcagtggctcacgcctgtaatcccaggactttgagaggctgaggcgggcagatcacctgaggttaggagttcgagaacagcccgtccaatatggtgaaacccgtctctactaaaaatacaaaaaaattagccgggcgtcgtggcacgtgcctgtcgtcccatgcaactcgggaggctgagacagcagaatttcttgaacgcaggaggcggaggttgcagtgagcaaagatcacgccactgcactccagcctgggcgacagagcaagactccaaaaa

SEQ ID NO: 15327 - DNA, 490 bp, Homo sapiens
gtagagcatatgatctttactgatgcacctgcatctggctcagacttagtcacccagccctgaaattatatcatatcacaggtcattctctgagtctcttaatgtgaggccttgagagaaaaatcaacatgccttctgttggatgaagaccaatcagcaagatggtggtgattgtgagtcgttgcaaggatcaagtgagttgaaatccgtaagtgcttgggagaatgcctggcgcctggaagcactgtatattccaaaaaaggagatataaacatgaccataaaagacatgaaaagatgtttaaccccattagtcatcgtggaaatgcaaatgaaaaccaccatacagacactagagtggtttaaatttgaatgacttccaacaccaaatgccagacaggacatagagcaactggatgtctcatgctcacaggcagaagggaaaactactgtgtgtgacaggaagatggacttacccaacctttcagcat

SEQ ID NO: 15328 - DNA, 504 bp, Homo sapiens
ctcgcataaaaagccaccgcccccgaaaacccgcgggaaatctgtttcctgtgaaaggccttgcctccgggcattggcggtttccctktatcctctctcccaaattttccggcaggggattgatcgaggcgacatttaggactggggtgggcgagggagtggcggttctcgtcccaagttacaggtgaggacgttcaggccaaggcgtacaaggatcgcgccgccctgtagcttgaggaggcgccgggattcgaaccaaggctgtgccaatcctaagccctgcgaggtcttgtggaaccgacatgacccactctttggtttgtccagagacagtgagcaggtaagagtctgtggggacaggcagtggcgaggccctaagcctggggtcgagccctcagtggacagatctggggggtcaggccctccgcggastgagagctggtctcagcccctctcttcgccttgatcctggtgcctccagggtgagttcagtgctgaatcgca

SEQ ID NO: 15329 - DNA, 315 bp, Homo sapiens
attgattaagtggctaacccttttctctccaagtctctttatcctccagtaaaagaggagtgacagaatacacctcccaggaactgttacaaggattggtgagataacacaagccagaagagataacaccatccacctgctccaaggggaggtgacagccacaagctcagcatttgcagccctcctataccctgcccttatgtgtcttcctttgactggtactagtttgtatcctwttcttgtaataaatgtgactatgagcataaaaaaaaaaaaaaaaaaaaaaaaaaaaaaaaaaaaaaaaaaaaaaaaarr

SEQ ID NO: 15330 - DNA, 545 bp, Homo sapiens
attctcacctaggacttgggcctgacggccacacctgcagtcttcctattagatcatgaaccttggaatagaaacttaccagctttcttacaaatagcctcttctccttcaaaagcagatctaagggcttgaactcttgcaaactaatgcctaccttccttgtgatggggatggggaggggtggatctcttccagtgatcttccctccaacctactcccagcctctcacctccctggccacatgcgacaaattgtctttataataactgcaattcctcaataatctcaatttcatacacactttttaacaccacttctcatattccagctcactttgtctggtcacaaaactccaaaagtcctttgaaaatctaactcactgcacctacagtccattagtctcatatcctttccctggcctggacccccacaccctgtgtcctcacttcactacttaactaaattccacggtcaatcgtcataatcactcccatgcagataccttcactaagtttttccccattccttttcttacctatctgtgc

SEQ ID NO: 15331 - DNA, 167 bp, Homo sapiens
caaattagacatgtctcttgtatagttttatatttcactgaggaaaatttcaagtttggcttctgttttcttgtacatagagtaaatgtagttgtttcatttacactctgtgtctgatactttcagkatttgaagtccctgctctggkgtcttggcttattagatgc

SEQ ID NO: 15332 - DNA, 443 bp, Homo sapiens
agtccgcagcctttttcctccctccttcggccccggggctcacatcctcgctgcctcacaccttgggcgtgtgtgggagcaggagagggattctctggggtccccatttggaacctggagacccacttctgccaacaagtccttcagcccctctgggccttagtttccccccagtgaagtggggatagtgacagctcccccgggagccagtgaaaactttgtgaagggagtgattactgcgggcgaaggcgcttggcacagccacaactgaagctcagccgtcggatgtgattattgttgctattgttaccgctccgcctrractgggtgcccggtcggaaagtcccgctccccgctcctcctcccargcgcggaagcttcgcrccgcmcgcmtcgggggacacctcccgcgccatctggggcactggagataaggaaaggdm

SEQ ID NO: 15333 - DNA, 454 bp, Homo sapiens
aggagacagctacagtgatccaactaaaccaacaggggattttcatcagcacttccctggtgtaatcatggtacagattattaaagacacgggatggtactatcaagaaaagcagccaaggggcaaattgataaagaagggctttcttcctcctggacttttatttcctgcctgacttcaggtgaatcccagaccagctcctagtacatcccatcctgtatctgatcccatggatcgtacctcagttgtgcttggaaaattccatggaactgccggacacaaactcgcagtggttcaattttcttcgaaacggtgtggtccctgcaaaaggatgtttcctgttttccatgagctggctgaaacttgtcacatcaaaacaatacccacatttcagatgttcaagaaaagccagaagatgggggaccaaaactttgtctggtctttgtaaccagaa

SEQ ID NO: 15334 - DNA, 457 bp, Homo sapiens
caaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgc

SEQ ID NO: 15335 - DNA, 278 bp, Homo sapiens
attgattaagtggctaacccttttctctccaagtctctttatcctccagtaaaagaggagtgacagaatacacctcccaggaactgttacaaggattggtgagataacacaagccagaagagataacaccatccacctgctccaaggggaggtgacagccacaagctcagcatttgcagccctcctataccctgcccttatgtgtcttcctttgactggtactagtttgtatccttttcttgtaataaatgtgactatgagcataaaaaaaaaaaaaa

SEQ ID NO: 15336 - DNA, 361 bp, Homo sapiens
ataacacccgcgaccccgcagctaagcgcastcccgacgcaatggacccggcgctggcagcccagatgagcgaggctgtggccgagaagatgctccagtaccggcgggacacagcaggctggaagatttgccgggaaggcaatggagtttcagtttcctggaggccatctgtggagtttccagggaacctgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgc

SEQ ID NO: 15337 - DNA, 376 bp, Homo sapiens
atccagagaggcgctgctgacaccgccgccacaccgccgccacaccgccgctgcctcagtcatgccgatggtctcatttccagagattttaaaataaagtattggtataagtaatccttgtgtgaaagcaaagcaaaagatccagaagttcaaaccagccatgtcaattatccattgactcaaaaaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttgg

SEQ ID NO: 15338 - DNA, 489 bp, Homo sapiens
agaactatggaaagaaccatgtgtggagtttggcaccacagatattctctgagtgattgaagtctcttctaccatggtgagtggtaccatggaagtaatcttgtccccaggcctcctaagcttacttatgatgaagtgatgagactcttacccaagaaaccattacagaaaaaaaaatcctcgcctaataaaattgtgccagtgaacaaactctcagatatatggcgatattgacaagatctgcaatggtatcaaaagaggtcaagctaataacctgaggaaacaggaagaaaactccaattgtcttatacagaaggtctacaatcaataggatgaagtctaacactggcgagagtgggaggccttgaaagctccatgatagagatgacagagctataagatgaaagcagcccaaatccctgagtcaccaatgtttgaagaagagcttcccaggagaggtaccagacccacatgagacttcacatgatt

SEQ ID NO: 15339 - DNA, 200 bp, Homo sapiens
ggattccgttcctgtcagttcagtctctcttatcccaccaccaccgcctccgaaaaatgttgcccgaatgttggcgctasattagctgagtccgcacagcaagcctcaactcagtcattgaagagaccagggacctctcaggctgggtatacaaattatggagacatagcggtggctacaactgaagataatctgtccag

SEQ ID NO: 15340 - DNA, 522 bp, Homo sapiens
attatccattgggtggctgttgaaataattggtggagctaaaatccttcagttctcacaactgggactcgctttccaaatacgttcgtgtatagactctagtcacagtactctgcctgcacttcatcagcacctaccctgtctgctttcagctggatcattgcatccagccggctgtcatcaccaaggatgtgtgcatggtcttctactcccgagatgccaagatctcaccaccacgctctctgcgtasctctttggcagcggctactcaaagtcaccagattcgtaagtttttcacacaagttagcttccagtgtgtttgttcagtacaacagaatcattagtccttaagtattctcggcttactgtctcacggttagtttacagtttatgaaccattttggtaactgacacctggaatgtactgacttgcatgctgacatttaataaaatgttgatggatggacgagttatgagggaaggaaggatattacattgtgaacacgtctaaaacaattttgca

SEQ ID NO: 15341 - DNA, 197 bp, Homo sapiens
acagtggcagccgccattttggagctggagactagcggcggagacgaggaggaacctgggcgagaccatctccggggggtgggcacggtgctgtcggaaggcgacggcggtcacstggcacgcctcgtctgtctggagcagaaattttattcagaaattattggtaatgtttggaagccaaaaaaaaaaaaaaaaag

SEQ ID NO: 15342 - DNA, 350 bp, Homo sapiens
atgattaagtggctaacccttttctctccaagtctctttatcctccagtaaaagaggagtgacagaatacacctcccaggaactgttacaaggattggtgagataacacaaaatttaccaagtttgagttcttcacttgatgatactttcactggaagcggcatcagctggtcacgtgttccaccatttcccagttgtccatcttttccagaaccaaaggaaaagacctttcccaaatcagaaacataggcaagtgtgtgccacctattaaataaaagcacatatggtcaaaaaaaaaaaaaaaaaaaaaaaaaaaaaaaaaaaaaaaaaaaaaaaaaaaaaaaaaaaar

SEQ ID NO: 15343 - DNA, 121 bp, Homo sapiens
acagtggcagccgcattttggagctggagactagcggcggagasaggaggaaccagggcgagaccatctccggggggtgggcacggtgctgtcggaaggcgacggcggtcacstgcacgcc

SEQ ID NO: 15344 - DNA, 428 bp, Homo sapiens
acctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggaggaaccgcctggccttcggggaccaccaattttgtctggaaccaccctcccggcgtatcctactccctgtgccgcgaggcatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtarggtctcccgcccggcgcccccartgttttctgagggcggaaat

SEQ ID NO: 15345 - DNA, 482 bp, Homo sapiens
ttactttgtctaactcttgctaatgaagagctaattttgacttgtctttaaattggatgagctgctggggaagcttcttttatgaaattcaggaggtatggagtgagagatatgggtgagaggacgcccagccgcaaccaaactcaagattgaccagctgtgattaaaacaataggggccaggcatggtggctgatgcctgtaatcccagcactttgagaacccgaggcaggcagatctcctgagagatctcctgagagtttgagaccaacctggccaacatggtgaaacccgtctctgctaaaaatacaaaaaatgagccgggcatggtggcaggcacctgtaatcccagatacttgggaggctgaggcaggagagtcacttaaacctgggaggcagaggttgcagtgaatcaaggtcacaccacagaacttcagcttgggtgacagagcgagactctgtctcaaaaaaaaaaaaaaaaaa

SEQ ID NO: 15346 - DNA, 499 bp, Homo sapiens
attcctaggctgtttctgtttgtgctcactttctttttttgaggctgtgagtggaaagtgtggatccctgtgcccatccaggcctgccttttgcataactctaagcgtgcacagtcccattcctgtttgcagtgttctctcctggaccagctttgaagaatgccatccgggactttgagtacccctgctccacactgtcaaaatcctttcagagaactctgctcccagaaaacaaaagccaaggaaacagatttgttttaggcccagtgatagaactcttctcaaaggaaaggtgacatttaggtctgtttattctcagaacagggaaaaaaaaaaatcctagcaaggagcacagcatgcatcagtagctcaatgatttattctgcctcagtaggatggggtggacttactgggcaaccactgacttcatttaatggtaacctgcagatatctcccggggccaattcagcatctctacctggccatcctaacaaggtga

SEQ ID NO: 15347 - DNA, 447 bp, Homo sapiens
atgccttattctgttttggtgtatttggtgaaacaaacaattttgatgacaccttttccctttctaaacaggtttgctgttatagaagactggaaagattggaaaggttattagagaacacacaggcttctatgttctatgctccttttcctcaggaggaattaacagcttctttatgtttctagagttactatctgaagatttttctcaacctcccaacaaaatcctttgtttgagacatgggattttaaagggacgtggctgcaaatttctcaagaccttgaagtaaggaagcttatgctttgaaaagaaaagtaaaactgggtgtgatggcctatgcctgtaataccagtgctttgggaggctgaggtgggaggatcacttaaggccatgagctcaagaccagcctgcgcaatagagtgagaccttatctcaacaaaaaaattt

SEQ ID NO: 15348 - DNA, 395 bp, Homo sapiens
aggggtatagtgggctgsagtaagcactgggaccttgagagactcaggccagcagaaaaatcaagctgtgacaaccggggcaaaacccagcaaacatcatggctggaaacaaacacagtcgcagctcctgtaagcctagaagacagtgcctttcccgttccagaagagcggastgcagtttcttgttagccacatggaacgctgcctgcgagaaggtcagtatgcccggcacctgagctcaaccacacctgttttcctggctgctgttctcgagtacctgacagccaacatcctggaacaggcaggcaaggaggcccagaacagccacagggtgtgcatcaccccaggaacacctgaagagagcactgcaaaagaatgagcagctaagatggatc

SEQ ID NO: 15349 - DNA, 263 bp, Homo sapiens
ccaaagtaagaaatcacatacgcttacgttttactattcaattcaatcctccctcccattgcacttatctaccttccccaagttgtttgtattaaaaaaaaaaaaaaaaaaaaaagtaaagaaacataaccaaagccatttcatttggctggggggttggggagtggggaggaaaacaatctttatyytaccccatctattgaagagtattattacattkgaaataaaacttccatcagkvcagaaaaaaaamaaamaaagct

SEQ ID NO: 15350 - DNA, 392 bp, Homo sapiens
  misc_feature 335: n=a, g, c or t
aggggtatagtgggctgcagtaagcactggcaccttgagagactcaggccagcagaaaaatcaagctgtgacaaccggggcaaaacccagcaaacatcatggctggaaacaaacacagtcgcagctcctgtaagcctagaagacagtgcctttcccgttccagaagagcggastgcagtttcttgttagccacatggaacgctgsctgcgagaaggtcagtatgcccggsacctgagctcaaccacacctgttttmstggctgctgttctcgagtacctgacagccaacatcstggaacagcaggcaaggaggcccagaacagccacagggtgtncatcacccagaacacctgaagagagcactgcaaaaraatgagcagctaaaraatgga

SEQ ID NO: 15351 - DNA, 517 bp, Homo sapiens
aaatattcaccttgtctttgatcttttcagttttwtatttgttctttccaattcttggtggatttgtaagctcatagaaggcaaggactatgtattattcatttttctgtagcttttttgtagcacttttagccatatgcgctttaaaaatgttaatttataattgacattgaaattgtactccaaagagttaaagaaataaatgcctaacagattcttgagtttgtaggatgacagattaaaaaaacaactacttgctgaaatgctggaactccctctgcttgtaggataacaaaactggctgaaattgattggaaccaatatggctgactacagtctatgcagaatgaacttgctgacatcacagtccaaattcccgccacatggttcatactakcttctcctgaaattgcatgtgtgactcatgaagaggcatgaagagataacagtacatgcttgaggrctctccagacctcctctttccctcccccaatcatgtactaaagccagaatccac

SEQ ID NO: 15352 - DNA, 390 bp, Homo sapiens
aattttttatttgttctttccaattcttggtggatttgtaagctcatagaaggataacaaaactggctgaaattgattggaaccaatatggctgactacagtctatgcagaatgaacttgctgacatcacagtccaaattcccgccacatggttcatactatcttctcctgaaattgcatgtgtgactcatgaagaggcatgaagagataacagtacatgcttgaggactctccagacctcctctttccctcccccaatcatgtactaaagccagaatccacccttgaacattttctaataaaaatactgccttgaaggtggcaccaggagacagaaaaaaaaaaaaaaaaaaaaaaaaaaaaaaaaaaaaaaaraaaaaaaaaaaaaaa

SEQ ID NO: 15353 - DNA, 258 bp, Homo sapiens
tgatgagagagttacaaagaacaaaactccagacacaaacctccaaattcttcagcagaagcactctgcgtcgctgagctgaggtcggctctgcgatccatacgtggccgcacccacacagcacgtgctgtgacgatggctgaacgcaaagtgtacactgttcctgaatattgaaataaaacaataaacttttaaaaaaaaaaaaaaaaaaaaaaaaaaaaaaaaaaaaaaaaaaaaaaaaaaaaaaaaaaaaaaaam

SEQ ID NO: 15354 - DNA, 485 bp, Homo sapiens
acaggattggggttgtgtatttttaaaagtattgagctttataatgtaattattcaagaaatagaatcatggtttttttatgatgttgccagcattttaaattacatgtttattaagtggcattgctcaaataactacagagtatgcgtggaaatatttgctgtctgaatagtttggagattcaaagagaaaaatcaagcttcagaggtgtctgatgatttgtgagcctcaagtgactactctgtggaatcatctgtccttgcctttgaattagctttccctaggccatgagtcaacattagtagtttatacatccaaattgatgacaagagcacctcaaaggcagcagctcaaggagcagccatggccccagacttgtcgcacggatgcagaaaacttaatggaggaggctgaggtcagaatgggaagagtttttaaaaaataaaggggagctaatatgtgagcaaaaaaaaaaaaaaatgcga

SEQ ID NO: 15355 - DNA, 444 bp, Homo sapiens
atgaacacagatgtgaggggatttgaaccatctacaatcaatccatatgtgaccaatggaggagaagcagccccaaaagacgaaggaaccctcaaaagaagatgagcctcagcagaaggagatgccaacccatttgtccttaggagcagagtcaaaggcagaggctaaaactccagttctggttgagacacagacagtggacaatgccaatgagaaatcagaaaaacccccagaaaaccaaaagaagctctctgacaaagatacggtagccaccaagatccaggcctggtggcggggcacctggtsgtcgggcactgttgcacgcagccctcagtgcctgcatcattcagtgctggtggcggctgatactgtccaagattctgaagaagaggcggcaggcagcgctagaggccttctcccggaaggagttgggcagcagtcaca

SEQ ID NO: 15356 - DNA, 500 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcacttgaactctcttgcttctggggagccaggacctatggagtaaaaatcaagttcatttggtgacacattccctccgggcccagatgctgtctctgctgctgtaaactctcctgcagtcaaggccaagcaatatatcttaagcatccctaaaaaaaaaaaaaaatg

SEQ ID NO: 15357 - DNA, 426 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgsttctggggagccaggacctatggagtaaaaatcaagttcatttggtgacacaaaaaaaaaaaaaaaaaaaaaaaaa

SEQ ID NO: 15358 - DNA, 415 bp, Homo sapiens
  misc_feature 287: n=a, g, c or t
atttttcaaccctactgccgtagagcaggcggagtccctcttttcgcgccttaagacagaaacacaaaatgatcctctgacaagtgatgaagaagaatgggaagatgtgaaaatccaagcaagaagaactttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccattbaagagnvttcccagaaatgatgacatccacatccaggaacctcctccttccttcatttgaactctcttgcttctggggagccaggacctatggagtaaaaatcaagttcatttggtgacacaaaaaaaaaaaar

SEQ ID NO: 15359 - DNA, 413 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaa

SEQ ID NO: 15360 - DNA, 416 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaaaar

SEQ ID NO: 15361 - DNA, 412 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaa

SEQ ID NO: 15362 - DNA, 416 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaaaaa

SEQ ID NO: 15363 - DNA, 433 bp, Homo sapiens
cataaattgtgaaatttaaagtacatttgaatagaccttgctgtgagtgatcatgtgctatttttggggggtggattattagtggattggttatccatgacttttcttctcaatacatttcataaaaatgtaagaacggcggggcgcagtggctcacgcctgtaatcccagcactttgggaggctgagacgggcagatcacgaggtcaagagattgagaccatcctggccaacatggtgaaaccttgtctctgctgaaaatgcaaaaattcgctgggcatggtagcacatgcctgtagtcccaggtactcgggaggctgaggcaggagaatcacttgaacacaggaggtggaggttgcagtgagccaagatcgcgccactgcactccagcttgggtgacagagcaagactctgtctcaaaaaaaaaaaaaaaa

SEQ ID NO: 15364 - DNA, 414 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaaa

SEQ ID NO: 15365 - DNA, 454 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaaaaaaaaaaaaaaaaaaaaagaaaaaaaaaaaaaaatgcgaa

SEQ ID NO: 15366 - DNA, 425 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaaaaaaaaaaaar

SEQ ID NO: 15367 - DNA, 413 bp, Homo sapiens
atttttcaaccctactgccgtagagcaggcggagtccctcttttcgcgccttaagacagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcatttgaactctcttgcttctggggagccaggacctatggagtaaaaatcaagttcatttggtgacacaaaaaaaaaaaw

SEQ ID NO: 15368 - DNA, 442 bp, Homo sapiens
aaaccctgagcggtctctgaggacctggtgagcagtcttgctctgttgcccaggctggagtacaatggcacgatctcagctcactgcaacctctgccttctgggctcaagcgattctcctgcttcagccttctgagtagctgtggactacagattgttgcaccattagaagctaggttgatccacagacagatggctgaaagtggaaaagaaaaaataaaatggacaaccaccattattattagctcatctcttaagagttatgaagttgcaactgccctagaaaatcgaagccacaaagttcgatattcagattcagtggaaaatggatcaattatattttctctttctggagttgcatttttattaatggatactaaggaatgtcttctgtcaactgaagaaatatttctagccaaaattgagaaatttattaacattca

SEQ ID NO: 15369 - DNA, 549 bp, Homo sapiens
gcagtattttgtctttccattatgagttagccatttgcaaaactgtggactatggaaagggcacacccgtagagtcatgtcttgctcttttcagtgcactttgactctcttttcccagacacctgctctttttctctcctcagtagcaccagtgtgtcatagtcccttttgtttaataaaggaaaaaattctgaatacattcacactaaaatatgatgtgagttagtatttatttcttttccacgcttgcttaggaaggctaaggcatagctgaaagtcagaaatgtttactgagtgctggatttgaggcacagtggcacttgagaatgtcattctacagtcacagttttgcagccctccacaatgggacacaactgtgtatttctgaaggcactatctgttagagaaatgtgttgaaaaatcaagttcctggcaaaggagaaagctgtgtctattaagcaatgattcccagcaaacctttctccaggctgataagtaggtttggctctttgaaagccttctcgtagtccattaagcagcatgagcatc

SEQ ID NO: 15370 - DNA, 487 bp, Homo sapiens
  misc_feature 405,417: n=a, g, c or t
agaacgtatattttggtggtggtagccttgtgcctccctttgtgcctgttataattgtgttgctctttgttcttagtctacgtctatctttctttgtagaggttgcgtgctcgcatttgaccttcaaatctaatagtttttcctccaattggagacgctttaggattctaagagaaagcaagctgcaaggggtttcccctttaatctagaaatgtggagtctcagcccacttaattttgctcactcttaaaagcatttcaaccaaagccattcattagggatttgatttggaggcaggagggattcctatactgttttaagtgtgtattaattctttcaatttatcgaatatttagtgagtacctgctatgcactaggcactattctcggttgtgggtacagcanggaacatcacanaccaaaatctttgccttcactgagcttatgggatagtgctggtggtggaagtgcamatattggtcaagta

SEQ ID NO: 15371 - DNA, 501 bp, Homo sapiens
tattctcaattcctcttcttttgtgtatgtatatgtgttagccattttttatttccacccttaagttaccaattatataaatggaaaacgtgcttttccttataaaattaatattttaatataggaggctttcaaggttcctgaccttgaaagaggttttcttttccgacttctactttaaatcaaatatgtcttttcctataggatacaagtggcttcacttagaagattctgaattactttgaggttccacttttttattttatttttaaatctactttttttcagtgtaaagccagagattcttaaaaatcaataagcaaattctacataggtggggataatctgtagaacttagtgcatttcgtaagtgtactaacaaaaagattaatactgacttccatacacataagaagcattaaaggaagcctggttatcttttgagacgaagctcgcctctgtcacccaggctggagtgcagtggcgcatcttggctcaccg

SEQ ID NO: 15372 - DNA, 495 bp, Homo sapiens
tagaatagatgtttggtttcttttgggggtgtctgagtgtatatgtgtgtgtatatacacacaagaacacacatatttatatactatacacacacattttaatgtatataaatatttgctacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatggggaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagt

SEQ ID NO: 15373 - DNA, 506 bp, Homo sapiens
tagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtcctttttttttgaggaatagtttggaccttgtgcctcctgtgggaggctgaggactgcaagaggagagctagcagatatgcctgttcacccctctctggtacttgtggcttgctagtatgtttttatgataatctc

SEQ ID NO: 15374 - DNA, 420 bp, Homo sapiens
gattcataggagcatataatataatctttgtaaagtagagggacaattcagtattttgtacaatatgtagaataacatgttctcttagtaggcataggatatactacattaagaaatctgggctaagcgtggtggttcatgcctgtaatcccagcactttgggaggccgaggcgggcggatcacttggggtcaggagttcgggaccggcctggccgacatggtgaagccccgtctttactagaaatacaaaagttggccgggcgtggtggtgggcgcctgtggtctcagctactcggggggctgaggcgggagagtcacttgaacccgggaggcggaggttgcagtgagccgagatcacgccactgcactccagcctggatgacagagtgagactctgtctcaaaaaaaaaaaaaaaaaa

SEQ ID NO: 15375 - DNA, 526 bp, Homo sapiens
acaatacgaggccgagggaggaattctgtcgtctgggaacggctggtttcgcggtcagacgccgagggccctcgaagtccctagcaacggctgcggagggagattccacctaggtccgtgcaggttacaaatggcaaccagaacagggactccaagcacgcccaactagcagcatccaaacatgggacttcaaggacgtgaatgaagaaggtctgctggagcagaggaactgaaattgacaaggcgaaaggggaccctgggaagagtctgccggcagcagatataagtctgtaaaatcggatggaccgccaattggagaatgagagcctcccagcccagccttacattctttcaattaatacataaacagaaagggggatatgcagggagccaaaggcctgtgggacgtgaccaactcagcattctgctggaggctatatgatcaaacagcaaactgtttatcatgaatacaggatgtgagcaaactcaggactgctcctgccaacataaggtttgctggaggcaa

SEQ ID NO: 15376 - DNA, 496 bp, Homo sapiens
gtaaatcgcttgagacctgtatttggttgttttgttggttttgccaagtaaggtcacttgaggatttcttggctcgaggtcccaggttgcgcagactctgactgcatcgagttgagaattttggtcagaatgttaaagtggaaacctaccccaggctgtcatgagatggggtcccactatattgaccaggctggtctgtaactccgggcctcaagggatcttcccaactccacctctcaaagtgctggattacagcctgagccactggacctggctactgtccattctttgatgaagacaaagtttaccctgaaatcctgttcaggggcaagagaaatttcaaaagcgaggatctacccttatacggttcacagatgaattaaggagtgcagatgtgcccagggcagctagagaacaagcaaaatcggtcctcaagcattttcttgcttttctcaaatatgtgggaagacctctaagcaggaagagacacaggtac

SEQ ID NO: 15377 - DNA, 569 bp, Homo sapiens
gtattccaaaaacgagtttatattttcaaacggtttttacagcttagactttgtacttactgccctgcctgtgacagttgtatgccttcattttgtatccaacagcaaagtctacaataaaactttaaaacaatcatgactgaatgtcaaaatcgtgtattgggcagatgctttttaaactgtcgtgtgagaaacttttatattaggccatttggattttattaagtgctaaggaaagagggcttacaaaatgtttcgtaaatattttatactgtttaagtgttaaacaccaaccctgtctttcttttgggttgagcttttttagaaagtcgaagtgaatgttggccaggaaaatggaaaagccattgtataaatttttttttgaggcggagtcttgctctattggccaggctggagtgtagtggcaccatctccacttaccacaacttgtgcctcctgggttcaagcgattctgctgcctcagcctcccgagtagctgggattgcaggtacccatcagcccatgcccagctaattttgtatttttagtagagatggggtttcaccatg

SEQ ID NO: 15378 - DNA, 189 bp, Homo sapiens
gaggcgcgaaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggccaatgcagggcatcatcaatt

SEQ ID NO: 15379 - DNA, 125 bp, Homo sapiens
tcaaatgtcattctaaagaatgaggggtgggagggatttatagttagaaacgacagtgcaggaaggggtattttcttgttgtcagggctggaatgaatcactgctgctcaagtcaaaggttcttg

SEQ ID NO: 15380 - DNA, 506 bp, Homo sapiens
tctcatccatggatgtccactcaaattaggtttcaccctggaccagtcattctaaatacagtgtgtgctacatggaaccccttgtttctaccccactctcaactctccctaatgctgagagacgtcccaccaaagaatgcatcatgagctccagccaccactgaacatttgtggctaccaggccttgtggccacggtgccctctgatgccttcaatgcattttagggtgggtaaatcatgttctaaccatctttgccctctggtaatgaatagctaagggcacacgagggaggccaaatgtaaatgttactaagatgctaagactttctggcccggcacagtggttcatgcctgtaatcctagcactttggtaggccaaggcaggcagatcacttggggtcaggagttcaagactgccctgggcaacgtggtgaaacctgtctctactaaaaaatacaaaaattagccagacatagtggtgcgtgcttatagtcccagctactcag

SEQ ID NO: 15381 - DNA, 487 bp, Homo sapiens
acattctcatgggggatgcagtagcaggggcagaggcatcccaatgagaaggccagggaggctggcttgttcctaaatccacatgggacaccaccctcaggcacccattctctgagatgagaaaactgaggctcaaagagattaagtgactcggaagatgacacagcacagctggccttcaaatcaggtcctcctgactctagaacctgagcttttttgttgagacccattttgccttatgttgctttccagattagttttcattctcttcccacaagggattaataccaaatacggagtgtgatggctcttgagaaacccctgtcctccctgttggtcaaatgctaagaaaccaaacttaaggcagaaaagcatagaatctcacctcttcaccagacagggccacggtgttgagccaatagtaacaaagaatgccaatgattgatattttcaaaaagatgtttctaaacagaagagacaacattta

SEQ ID NO: 15382 - DNA, 413 bp, Homo sapiens
agcaaggggctcagatggagggggaggaggacctgaacaagtccagaagggaagagatttgtccctctatccaacagagtacccagtgagcagcacagagggcacagcaagggacatcacccggttcccccaaatgctcagagccacaagtgaagccaaaagtgaaagacaagatgcagaaaaccgccacgggcctttgagtaagggtaaaggcgaaasgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggsttctccttcgagaactgccaaagaaatgcatcattggaacgcgtc

SEQ ID NO: 15383 - DNA, 491 bp, Homo sapiens
gaccaagttgtaatttttccaatatagagtctttgcatcacactgaggcatcttgcacagctgcagttaaggtgagaaagaatgctctgtgtgaagacagtgtacacaatgggttccggtttccttgccaccttgtgcagtatcctttatttctgtgctgttctctcctgagcatkraaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagkctatacttgatacattcccactttatatacagtaggattctacaaacgkgtagatgtttggccaaatgaatgctgttaakaatakgtaaaattcttkgattaaacatttattacttaaactaaaaaaaaaaaaaaaa

SEQ ID NO: 15384 - DNA, 201 bp, Homo sapiens
gtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaa

SEQ ID NO: 15385 - DNA, 465 bp, Homo sapiens
  misc_feature 403: n=a, g, c or t
gtcttaacaagaagagaaggcttcaatggattctcttgtggtccttgtgctctgtctctcatgtttgcttctcctttcactctggagacagagctctgggagaggaaaactccctcctggscccactcctctcccagtgattggaaatatcctacagataggtattaaggacatcagcaaatccttaaccaatgtaagtatgctccttcagtggcttgcaaaagctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcantggaaagaaatcgaaggagatccggcgtttctccctcatgacgctgcggaattttgggatgg

SEQ ID NO: 15386 - DNA, 172 bp, Homo sapiens
agtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcgttacccaacttaatcgccttgcag

SEQ ID NO: 15387 - DNA, 274 bp, Homo sapiens
  misc_feature 96: n=a, g, c or t
aagtttgaatcgcgatgcgacgaaggagtaggtggtgggatctcaccgtgggtccgattagccttttctctgccttgcttgcttgagcttcagcgnaattcgaaatggctggcggtaaggctggaaaggactccggaaaggccaagacaaakgcggtttcccgctcgcagagagccggcttgcagttcccagtgggccgtattcatcgacacctaaaatctaggacgaccagtcatggacgtgtgggcgcgactgccgctgtgtacascascca

SEQ ID NO: 15388 - DNA, 543 bp, Homo sapiens
  misc_feature 344,373,497: n=a, g, c or t
agtataaagggagcagggaaggcgggagacagcgcagtttgaatcgcggtgcgacgaaggagtaggtggtgggatctcaccgtgggtccgattagccttttctctgccttgcttgcttgagcttcagcgaattcgaaatggctggcggtaaggctggaaaggactccggaaaggccaagacaaaggcggtttcccgctcgcagragccggcttgcagttcccagtgggccgtattcatcgacacctaaaatctaggacgaccagtcatggacgtgtgggcgcgactgccgctgtgtacascaccatcctggagtacctcaccgcagaggtacttgaactggcangaaatgcatcaaaagacttaaaggtaaancgtattacccctcgtcacttgcaacttgctattcgtggagatgaagaattggattctctcatcaaggctacaattgctgggtggtggtgtcattccacacatccacaaatctctgattgggaanaaagacaacagaagactgtctaaagatcctgattcttgttatctca

SEQ ID NO: 15389 - DNA, 313 bp, Homo sapiens
aagtataaagggagcagggaaggcgggagacagcgcagtttgaatcgcggtgsacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagaragccggcttgcagttcccagtggccgtattcatcgacacctaaaatctaggacgaccagtcatggacgtgtgggcgcgactgccgctgtgtacagcaccatcctgga

SEQ ID NO: 15390 - DNA, 417 bp, Homo sapiens
tactttgatgttgctgaaagaattattgtctgttcaaaaaggtagcattgttttttgctgttggatgtttctttcaaccttgtgttttgttactgctcctaaagaatcagttatgcggccaggcgcggtggctcacgcctataatcccagcactttgggaggccgaagtgggtggatcacctgagatcaggagatcaagaccagcctgaccaacatgtagaaaccccatctctactaaaattacaaaattagctgggcttggtggctcatgcctctaatcccagctacttgggaggctaaggcaggagaattgcttaaacctgggaggcggatgttgtggtgagttgagaccacgtcattacaccccagcctgggcaacaaaagtgaaactctgtctcaaaaaaaaaaaaaaaaagc

SEQ ID NO: 15391 - DNA, 442 bp, Homo sapiens
atctaatgaggagcgaggtgcggtgccccgaagcgctcgcttcccgcggtgcgatctagtcctgcagtaggcggcccggggcacaccgcggccgcccaagccagtgcaaggcccaggggctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccaccgagggtccacagagaggggcgccatctcctgcgtctcagttatcctggtgttgggaattctgtgccctaaagaattccgactcagatccgaacggggatctggtggaatcgagggtgaaagaccagakggacaatgttctactatcccaac

SEQ ID NO: 15392 - DNA, 128 bp, Homo sapiens
caaagcatcatgttgacaggttgttagttgatggtgactgcagctagttggaaagtcagaagaatctagaacttgtccatttatactaaagaatttcatagtaagtgcagtattatgagtgtaatgtt

SEQ ID NO: 15393 - DNA, 224 bp, Homo sapiens
cttttcccaggtacttggtactggagcgagtggacgagcagcatcgccgaaagtatgcccggcgtcccgtctaaagttctgcagatccatggaaagcttcctgggaaacgtatgctagcagacttctccccgtgaatcatatttttaagatcccactcttagctggtaaatgaatttgaatcgrcatagtagccccataagcatcagccctgtagagtgaggag

SEQ ID NO: 15394 - DNA, 444 bp, Homo sapiens
attactgttaccatgaaaaagaaatgaacagcagcacgtctgataccatcagctgggcagatgcattaaggttaaatctaagtgtcaagaaaaccctatttctttataatatttatgcagctgttaacgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagttaaaaaaaaaaaaaaaaaggc

SEQ ID NO: 15395 - DNA, 482 bp, Homo sapiens
ttccccacctcccacctctacaatatcttagtaacaatatgcgcttaacaaattatttgctgccttagtaagtgagaagcctgcttgctttcccgtcttgcatccgggcctcctactgtggaaggtgcatgttagtttgcggggcagcagagggtgctgttgcctagccgctgtttagaaaatctgaaaatggccagtggcttgcctcggaatgtttcctcattctccatcatgagtacagtccttctggtgtgtcacctagacagcagaagaccttttagtgcagattcatcasdmagaaactcttttaaaaaattggagtgaagatagggagtgtgaaattcaagaatgactatttctcaaagtgaagtcacgtttttactgcctttttacatggatctcaaatctctgcaagactgraaactttgagraataaaaattgaaggtgccggggcagcctacaacatgtgacacgggctttc

SEQ ID NO: 15396 - DNA, 472 bp, Homo sapiens
acctctacaatatcttagtaacaatatgcgcttaacaaattatttgctgccttagtaagtgagaagcctgcttgctttcccgtcttgcatccgggcctcctactgtggaaggtgcatgttagtttgcggggcagcagggggtgctgttgcctagccgctgtttagaaaatctgaaaatggccagtggcttgcctcggaatgtttcctcattctccatcatgagtacagtccttctggtgggtcacctagacagcagaagaccttttagtgcagattcatcagtcagaaactcttttaaaaaattggagtgaagatagggagtgtgaaattcaagaatgactatttctcaaagtgaagtcacgtttttactgcctttttacatggatctcaaatctctgcaagactgaaaactttgagaataaaaattgaaggtgccgggcagcctacaacattgtgacacagctttcaagct

SEQ ID NO: 15397 - DNA, 490 bp, Homo sapiens
atgattccatctatattgagttatgaagagactacttaaacaaacaaaaccagatcaccacctgtaacaacaccaaacaaacaaaaccaagaactaggaaaatgaggaaaaaatatctgactgaatgaaaattattacctgaagcaatacagaaggagtacttaatgttcaaataaagtcattgaccaaagtatggaacagaaaatataaatgcatatttttaaagcaaacattttcatctcctaaagacaagataagacatggaatgagaaggagaaataaattaatcccaccatccaacagtgaaagaaaaaacacagaacatgaggaggaccagaaagcaatgtgaaaaagagttgaaaggagtcactgctgagctattttagattctacaccctctatccagccatgaacctatcagcgatcatgcctaactattgcataccccattagacaacctaatgtgaatgtaggaagcctattcatctaa

SEQ ID NO: 15398 - DNA, 431 bp, Homo sapiens
  misc_feature 394,401: n=a, g, c or t
actccgctcccagggtagcttgcagttctaaaggctagtctcactcccaccgtggctccctcaacagcaccgagtctatttctaggcagctggtgaccagggctgagaatttgccccagaccatgagcctcccccgttgagaaagcaagcagactcacagtttttcagcatctcagggaaacttcaggggtgatccagtttcttcaaagggtctgtggatcctctcagctttccctatttgctccaagaactaccacaggaacataagttcatgattggaaagctcaccagagatcctaaagaatgaagatttttctagcagccgtgctattacattgtacaaagacaagcgtcaagaatctgtagaccagctgtctttgattttgtcttatgnrttccanatttctcagaagctctacattcctcgaagt

SEQ ID NO: 15399 - DNA, 486 bp, Homo sapiens
agtagcggctgtattgcagcssytgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacg

SEQ ID NO: 15400 - DNA, 575 bp, Homo sapiens
gcccagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtaktttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagcwgggattacaggcgcccgccaccacgtccggctaatttttgtattt

SEQ ID NO: 15401 - DNA, 490 bp, Homo sapiens
gtaataaacttaacccaagaggcagaagacgcctacactaaaatctataaaatgtttccaaaggaaattaaagaagacaccaataaatagcaatatatcttttgttaatgaatcaaaagatttaatgctgaagtgccagtactttgcacagagatctacagatttcatgcaatccctattaaaacatcaacaatattttttgaaggaatagaaaaagaaatccaaaagtttatgtggaatctcaagggattttgaatagcaaaaggagtcttgaaatagaacaaaattggaggactcacacttcccaatttcaaaacttactgcaaagctacagtgataaaaacagtgtggtactggcataaaaacagacatttagaccaatgcagagtctagacataaaccctcacatatatggtcaaatgattttcaataagaatgccaagatcattcaatagtaaaggtattctttttaatgaatggtgctcagaga

SEQ ID NO: 15402 - DNA, 483 bp, Homo sapiens
ttatgrtttcaaggattagaaagacattttgaaaatctatgggctagattataaagcatttgaaagtaaactgtagtttttgctttgccaactgattgtttttcagtttttaaaactctttgttttttttgtaacattattctcttctgggtctcctaattttctgatcacgattatagattttaatgtgtaatggctccaaattcggctgggtgcggtggctcacgcctgtatcccagcacttttggaggctgaggcaggtggatcatgaggtcgggagatcgagactttcctggctaacgcggtgaaaccgtctctactaaaaatacaaaaaattggccggcatggtggtgggcacctgtggtccaagctactcgggtggctgaggcaggagaatgatgtgaacctgggargcggasttccagtgagccaagatggtgccactgcactccagcctgggtgacagagcaagactccgtcgca

SEQ ID NO: 15403 - DNA, 486 bp, Homo sapiens
ccattttaaaccggtcttttggggctgcagtaaaaaataagaaatggagttttcttgctttttactctaaaattcaatgtaattaaatttcatatatatataatatattacatatwttcatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaagacagacgctgcaatcacagattttaaaaaattgtttgcacttaaaaatagttgaatgctggtggaaagttactttgcagatgggtgtaaggactcatggccctctgaggtgcggcgtgaagatgccctttttacccgttgacgtttattttacgtaaaataaactgttgtttccaatgcaatcaactctgtattatatg

SEQ ID NO: 15404 - DNA, 275 bp, Homo sapiens
caggggcagaacttccggccagcgcgccattttggcttcctgaccttgggctacggctgaccgttttttgtggtgtactccgtgccatcatgtccgtcctgacgccgctgctgctgcggggcttgacagtgtcagcactcatctcctcctcccacatttctggagcttttttttttccttccccattgacctttgtggtcttctgtwatwatttatgctgcctcccaaggatagaattgaaataaaatgttttcaacttaaaaaaaaaaaaaaaa

SEQ ID NO: 15405 - DNA, 361 bp, Homo sapiens
caggggcagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggagggaagcttgggatcatggaattggccgttgggcttacctcctgcttcgtgaccttcctcctgccagcgggctggatcctgtcacacctggagacctacaggaggccagagtgaaggggtccgttctgtcccccttgtaacaataaaatctatttaaactttaaaaaaaaaaaaaa

SEQ ID NO: 15406 - DNA, 148 bp, Homo sapiens
caggggcagaacttccggccagcgcccattttggcttcctgaccttgggctacggctgaccgttttttgtggtgtactccgtgccatcatgtccgtcctgacgccgctgctgctgcggggcttgacaggctcggagtacaccacaaaa

SEQ ID NO: 15407 - DNA, 295 bp, Homo sapiens
caagattagatttggggatattattttttaagctaatattttggtggacaagttttagtcattcatgctcagcaaaacaacgttttaggatggtgagataagacaaagtaattgatagaagaatgtggacactacttcaaaataactgggaaattatgaggctgggcacagtggctcaggcttgtgatcccagcactttgggaggcggaggtgggaggactgtttgaactcgggagttcgggaccagcctgggcaacatggcgaaataccatctcttaaaaaaaaaaaaaaaaaa

SEQ ID NO: 15408 - DNA, 440 bp, Homo sapiens
agtatcagtgttcggtggctccactggaactacgcagagccagaccagcgggaccacagaatgggctgaggcggcggcggctgtttggataaagtcaacagcgggacgtggggcgtgacgcggtccggcatcctaagacgtgtggtttgagttgcgggcgagaccaggctttttttaggaccttgggcctgataagtgggcgactgcagtagtgcgggaactattatttgacaggaacatgacaggaagtgtagggaccccatgcttgatggatggtgacttatagtgtggtatctcagtgttgatgggcatgaccgagacagcaggagtacccctaagttctggtgagaggtggagcctcagaaggacaccttactcaagctgtctttagttcccaaagacaaaaaggctcagtggaaaagattccttttttttttttt

SEQ ID NO: 15409 - DNA, 166 bp, Homo sapiens
attttggmttcctgaccttgggctacggctgacmgttttttgtggtgtactccgtgccatcatgtccgtcctgasgccgctgctgctgcggggcttgacaggctcggcccggcggctcccartgccgcgcgccaagatccattcgttgccgccggaggggaagctt

SEQ ID NO: 15410 - DNA, 506 bp, Homo sapiens
  misc_feature 15,207: n=a, g, c or t
atcagcgatggcggnctgcgtcggggtcggttctgcagcgctgtatcgtgtcgccggcagggaggcatagcccctctctgatcttcctgcatggctcaggtggatttcaattttacgtcctggttttctacagctcgggaaacatcctcccctcggttaccccagtattgcccaagtggaggtgtcgccgggcccaaatagggccantgggtggctcccccgtcgccagcccaggctgtagatgcacgggcagcgcacctgcccccagcctcccccgttagtcttcctctttctatcgggcggtcactggtccaccaccctcgctttggggccttgtgtcccgccgctcagccagccctccatccccacaacacacctccccattcctcgccccaagtttaaacagagcaagttagtaaggtgattctggacaaggattaagaatgtggatcaagcaggttttaaatcaagatttaacattccaasacataaaaaattatttatcc

SEQ ID NO: 15411 - DNA, 57 bp, Homo sapiens
attttttcggtgatctggaccgccgccasccasacagcgctccagggcagaaaaggc

SEQ ID NO: 15412 - DNA, 348 bp, Homo sapiens
attttttcggtgatctggaccgccgccacccacacagcgctccagggcagaaaaggcgccccatgcccgcgcctgggccggcggggggcggasttgcgtgctgacgcataagagtcgagcgggggaacgtgcgtgtctcgagtcgcacggatggcaaccgtcgacgggcttagcgcctcaactgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtmgtggcctttgtgctat

SEQ ID NO: 15413 - DNA, 144 bp, Homo sapiens
taaataattacatatttatttacctgataaatatgtatctagttctacaaggtcacatttatgtggaagtccaaagtcaagtccttaggggataattttgctttggctcagttgttccctgcttcctttttttttttttttttt

SEQ ID NO: 15414 - DNA, 483 bp, Homo sapiens
attctcactgcgcccagcttccggcctggccacccgccagcaggtctcacccggttcgcatcagtcccgggcccccggcgcccctcagtagtagcaaattatcgcatccctgagcttaggatccccctttagtttcacatatgcccccacccccgtttccactttgatggcggcttccaaggagcatcccttagtaagaaccgtcgcaaatatcgtgatttggatccaccaaggcttggggcgagccgtcgaatgtgtgtggtaggggagcgggctgatgttagcacgtggtcttgttaggccttgaatgggggaataggaggcctgtgttcacgattagtttccaccacctaccaacttggaacctttacrtctctccaagcctgagtttccttatctgtgagacagctgcgaataccggtttccagagagtagttaagaacccttgtgaacaccttcttcagcttccttcgacgcaaaaca

SEQ ID NO: 15415 - DNA, 362 bp, Homo sapiens
cattcaacactgaggaggaaattcttggcttggtcaggaatggtgggacctgtgagttgggatttgtaaatggcccttgaggcgggcgcagtggctcacgcttgtaatcccagcactttgggaggccgaggcaggtggattacgaggtcaggagatcgagaccatcctggctaacacggtgaaaccctgtctctactaaaaatacaaaaattagccgggtgtggtggcaggcgcctgtagtcccagctactcaggaggctgaagtaggagaatggcgtgaacccaggaggcagagcttgcagtgagctgagatcgcaccactgcactccagcctgggccacagagtgagactctgtctcaaa

SEQ ID NO: 15416 - DNA, 221 bp, Homo sapiens
catacctaaattttctggaaggggacagtgaaaagaggagtgacaggagggaaagggggagacaaaactcctactctcaacctcacaccaacacctcccattatcactctctctgcccccattccttcaagacgagaccctttggggacaaggccgtttctttgtttctgagcataaagaagaaaataaatcttttactaagcaaaaaaaaaaaaaaaaag

SEQ ID NO: 15417 - DNA, 471 bp, Homo sapiens
accagtctagaatcaggatgtagcttccagtttgtgaagagtccttaggtcaaagaactggatggtggcaaaaagatccatgaaaaaaccccaggatgggccaggaccagtgagggcctgggacaccctccactcacctttgtgaggtccatatgtgtttctggagacacagtaacctgtggaaagccaaagatcatgaaagtctaactccatgaggtttttggaaaacttcgaaagacctaactcagaccatatgccgcttctgtacacaaccctccacggctcctagcatcctaagaattgagggaaaactcctcaccttggcactccaggagccgttcctgcgttttctgacgccctctccaccgcccctcggctgagaactgggtccagatgagccttggaccccgttgaagacgtctcctacctcatctcccacacctgctgggaccatctccaaccgccctcagg

SEQ ID NO: 15418 - DNA, 472 bp, Homo sapiens
agagagggagcccgagccaggccatctccaaccatgtccgacgaggcctcggccatcacttcctacgagaagtttctaacccccgaggagcccttcccactcctgggacctcctcgcggggtgggcacctgccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttascaggmagtggamatttgcagg

SEQ ID NO: 15419 - DNA, 593 bp, Homo sapiens
aagaaagttgtctgcgtctcgaggcgagttggcggacgtgtgcgcgcggcgggggcgatggggggctcgggcagtcgcctgttccaaggagctgctggccgagtaccaggacttgacgttcctgacgaagcagggagatycctcctagcccacaggcggtttttgtgagctgcttyccccaggagcagcggabtgggggagtcgtcacttcgggcacaagtgcccttcgagcagattctcagcctttccagagctcaaggccaaccccttcaaggagcggaatctgcagggtcttctycaaatycccagccmaaagacagccttagctttgagggacttcctggatctcctcagtgtggttcagtgacacaggccacgccagacatcaagtccccattatgccttccgcatcttttgactttgatgatgacggaaccttgaacaggagaagacctgagccgggctggtgaactgccctcacgggatagggcgaaggacacacgggcttagtgcgtctgagatgaagcagctcatcgacaacatctggaggagtctgacattgacagggatggamcatcamctctctgagttcc

SEQ ID NO: 15420 - DNA, 391 bp, Homo sapiens
cttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaagaatttgccattttcagtggaaaacaagtggtcgttactagctaagatgtgtttgtactttggatctgcatttgctacacccttccttgtaatatgaagagcattttaagaggtgcagcctctggaagtggatcaaactagaactcatatgccatactagatatgtttgtcaataaacttatgacgtcaaaaaaaaaaaaaaa

SEQ ID NO: 15421 - DNA, 515 bp, Homo sapiens
attctgagtcatgaagccctcatccccgctgtaccgcttcagacagtgaagaacgtggcaggtgttggataacaggaatgacgtcatctcaaagtcatcactgtgcttcttcaggactttcttaatgccgttggtggtggaggtcatcagggagtgcaccttgagatcatcgttggtttggtccgcgagccgaatgcacatgtagagcatgtaggcggagagacagggcactgtgtccaacagcatctggggcttcaagtctgtcaccaggttgaggatgaggagggcctcgcctctttrcggcactccaacatkccctggaaatccttttctttccactgaactgggacctgcctgttgaactcatggcgcttcctctcactctgggccaacgcctgggcagcttcttcatgtaaatcttcagttgcttttagagcttcctctcattcttttcctcttactttatttttcaccacagagcttcctatcaactagtatgttgaatattttgctta

SEQ ID NO: 15422 - DNA, 416 bp, Homo sapiens
atctggtacttccatccggggtcagggcagcggtgtcccgaagcctcactgttcctgtcgcgtggcccgctccgccgggcttggcaggactcggctctccccttctgccgttaccaggacgaccgtctccccgcagcccaggctgcccagactggcgccatgagctcccccgacaagtgcatccggctgcagagggaaattgaggaccttacacagcagctagcggccatgcagttcttcaacgacaagttccagggcctttgaagttggagccagcgtccggagctgcagccaagcgagtttccttcttatcctccttagccagggctttttctcttccgctgcatttgcccccttcccaacgcagttcaaagcagtgtgaaataaagtcgttctcatattcgaaaaaaaaaaaa

SEQ ID NO: 15423 - DNA, 479 bp, Homo sapiens
attcattgcctggggatgagagggagagacaacgtgtgtcttacacatctcccaacagccgacttagatgtgatccgttctcccagagggascaggtttctttgaacttttcctttttatgtacagcatagtgctgagcagatcactgcactgtgcaggagttttaacgacagtcaggccaacggcatggaaggaccgcgggagaatcaggatcctcctccgaggcctctggccgccacctgtctgatgcagaccgcctccgcaaagtcatccaggagcttgtggacacagagaagtcctacgtgaaggatttgagctgcctctttgaattatacttkggagccacttcagaatgagacctttcttacccaagatgagatggagtcactttttggaagtttgccagagatgcttgagtttcagaaggtgtttctggagaccctggaggatgggatttcagcatcatctgacttttttaa

SEQ ID NO: 15424 - DNA, 462 bp, Homo sapiens
ctttaatactgtcaacttcagctgtgtacattttgctcttcaactttcttttgaggctttaaattaggcaaatatatttttcttagaatttctgaaaactccttttcactggagcttattttaattatatggatgcattatcctcttaaacttctgtgaaaacaataattggagttttcatttgcattggctgtttcatgagaggtcaagctttttgcttatttattttgatgtttccttttcatgatatctgtgtcttgggatttggttgtatattcacatttttaattagctacttgatttaaataaagtatcagtagttactttcagggttcttggtgattataataattactcacctaccaggcttcttccttgcatgcagctcactacaggaatctgttgtgcctagaagatttcgggataagtggagaaaccccactccgttaactgcatacacag

SEQ ID NO: 15425 - DNA, 490 bp, Homo sapiens
tagatttatttatttatttagagacagggtctcactctagcccaggctggagtgctgtggcgtagtcttggctcactgcaacctccgcctcccgggcccaagtgatcctcccgtctcagcctcctgagtagctgggattacaggcgcacaccaccaatgcccagctagtttttgtgtttttcatagagacagggtctcaccatgtcattcaggttggtcttgaactcctgagctcaagcagtctgcctgccttggcttcccagtgctgggattacaggcgtgacaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttakggaacaatgtgggatg

SEQ ID NO: 15426 - DNA, 801 bp, Homo sapiens
tattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactttctggcagacatacagaaagctctgtgtgatcaataagggagtgtctcatttttctacttccctctttctgtgggtgacatgatctgaggttctatttgattactaagcaaaatctgttacccctacagggtttagaacctaagtattagagaggaaggctatttaatggaagttagtgtaagctgataaaaacgtagctaccgtacacacacatcaatcactcaatttcctgtccttttaaattgcccaccctttaattttgaagcaatttcccaagtgtgtgtttgttttatatttgtcatccagtccattgcatttccataagaagacattttgactggctgggtgcggtggctcacgcttgtaatcccagcactttgggaggctgaggcaggcggatcacgaggtcaggagatggagaccatcctggctaacatggtgaaacccgtctctactaaaaatacaaaaaattagccaggcgtggtggcacgtgcctgtagtcccagctactccggagctgaggcaggagaatggcgtgaacccgggaggcggasttgcagtgagctgagatggcgccactgcactccagcctaggcaacagagcaagactccgtctctaaaa

SEQ ID NO: 15427 - DNA, 216 bp, Homo sapiens
tatattgctgcagattctgaaaaagtgcaagakkgcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaag

SEQ ID NO: 15428 - DNA, 495 bp, Homo sapiens
ccctgttttatacaagagcctaggggagtgaggctttggggagcttctcctcctggcttctcctcatggctttcttcctcctgcccctcctccacgtccccagccccccatttctgccttccttgctgctccacttggcctagccatgacctctgtgtggtcgtcactgtcttgtgttcttgcttctgtcgtggccgccagagtgaccgcactgcagctttttaaagctctgaccttgtctttcgtcttctcagagcctgtctgaggctccccaaagacattgcccagcggcctggcattcaggaccccagctgggcagccctgccgaccttcggcctcctcagggacagctgctcccctcactctgccgggccttggactcgtctcccagaatagccaggcacactggcgccctaaccttccctggctcaagcttgtcctactgccgggaaggcctccccctcccctgcatttggcaaactcatgtgtaccttc

SEQ ID NO: 15429 - DNA, 291 bp, Homo sapiens
cacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaaccataaaaaaaaaaaaaaaa

SEQ ID NO: 15430 - DNA, 508 bp, Homo sapiens
cttctcctggaacttacatcttcaagtcttggatgctctgatagccctcaactccaagatttatcttcctggtcccttgcgacttccaggagttctgattagctgtcactttctgcttggctttttcttggcttctcagcctgttggaacagctacctacaaattggcagatgtcttgacaggaatagaagggtagaatatcagcctcaccttaatgagttttccttctctctgggatcttggccctcaagtccaggctgccttcatagctctcctgtgtttttgaactgatattgcctgtattttatatcacttttctcctttcttggagatcaggatagagggcaggtaggaggcaatgctggcctcaacttggcagttacagtggaggtggtagcaataggtgggttgagagagatacagtcacagcgattaattagatgggagaggaggaaccaataatgaatgtagatggattgtctctctgagatgctgggcacatgctcac

SEQ ID NO: 15431 - DNA, 361 bp, Homo sapiens
ctgaacagggcgggagattcggtgtgccgcacgcaggcttcccatcccccagctggcctcccgtgctccttacstccccggtggtcgggcgcgaattactggaaattggcttttcccgttggggccgaagtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagaga

SEQ ID NO: 15432 - DNA, 314 bp, Homo sapiens
atttacatagggtgtacaccaagtaaccaatgggaaaactctaattctgtactggggctcttggatcctattcttggacccgctcccaccctgcggagtgtacttttgttttttgttgcttcaaatttttttttttttttttttcttttttaagagggaktctcactctgtcgcccaggctggagtgcagtggcatgatctcasctgagtgcaagctctgcctcccgggttcacgtcattctcctgcctcagcctcccgagtagctgggactacattggcccgcmaccaggcccggcwaatttttttttttttt

SEQ ID NO: 15433 - DNA, 488 bp, Homo sapiens
tacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccacagcaggcactggggttcgcatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggtgcagtgaccggacccctggatccttgagtattcggggattttggcggggtgctcaaagatgggactgcagttcccagaatgcactaaggcgggaaccaggcctcggggaattgaggttaatgggcttcaagtttgctaagaawatgggagtgggggggc

SEQ ID NO: 15434 - DNA, 241 bp, Homo sapiens
aaaacttttcggtccaggcggcggcagggctgagccagcgacgccctccattcactctccgcgcccgttctccggctgtcttcccgttccgctgcccgccctgccaccatgacggaacaggcsatctccttcgccaaagacttcttggccggasatcgccgccgccatctccaagacggccgtggctccgatcgagcgggtcaagctgctgctgcaggtccagcacgchagcaagcagatc

SEQ ID NO: 15435 - DNA, 410 bp, Homo sapiens
tgcactatagaacaactggacctaatagatatttacagaacatttcatccaacagctgcagaatacatattcttctcctctgcacatggattattctcaaagatagaccatgtgttaggtaacaaaacaagtcataaaatatccaaaaattggaaataatgtcaagaatattctctgaccacagtgaaataaaactataaatcagtaacaagagaaattttggaaaacacatgtaaattaaacagtattctcccaaatgaccagtgtatcaatgtataaattaagaaggaaatggaaaaatttcttgaaacaaatgataatgtaaataccatataccaaaacctataggatacaatgaaagcagtaggagagaaattgtagcaatatgtgcctacatgaaataaaaacaa

SEQ ID NO: 15436 - DNA, 179 bp, Homo sapiens
  misc_feature 108: n=a, g, c or t
akatctgggcagatgaaccaaagggaaaakccacctccccagccctkcaccaagccctgtcctcctaaatgcccttcatcctgsccacatgcttgcscacctccctgncctcccccagaktgaggcactgtgggcactacccaaccccascaccactgscacctccaccatgtacaagc

SEQ ID NO: 15437 - DNA, 150 bp, Homo sapiens
aaacaggattctcactgaagacaggccagggtggtcggatatcacttgggggatggtggaggatgagatattgagggtccagccgtccattccggtggaggcagaggcagtcctggggctctggggctcaaaaaraaaaaaaaaaaaaar

SEQ ID NO: 15438 - DNA, 145 bp, Homo sapiens
aaacaggattctcactgaagacaggccagggtggtcggatatcacttgggggatggtggaggatgagatattgagggtccagccgtccattccggtggaggcagaggcagtcctggggctctggggctcaaaaaaaaaaaaaaaa

SEQ ID NO: 15439 - DNA, 164 bp, Homo sapiens
aaacaggattctcactgaagacaggccagggtggtcggatatcacttgggggatggtggaggatgagatattgagggtccagccgtccattccggtggaggcagaggcatcctggggctctggggctcaaaaaaaaaaaaaaaaaaaaaaaaaaabaaaaaaaa

SEQ ID NO: 15440 - DNA, 163 bp, Homo sapiens
aaacaggattctcactgaagacaggccagggtggtcggatatcacttgggggatggtggaggatgagatattgagggtccagccgtccattccggtggaggcagaggcagtcctggggctctggggctcaaaaaaaaaaaaaaaaaaaaaaaaaaaaaaaaaa

SEQ ID NO: 15441 - DNA, 126 bp, Homo sapiens
aaacaggattctcactgaagacaggccagggtggtcggatatcacttgggggatggtggaggatgagatattgagggtccagccgtccattccggtggaggcagaggcagtcctggggctctgggg

SEQ ID NO: 15442 - DNA, 384 bp, Homo sapiens
tgcagttctggtcggtctgaaacttttgcaaagcttcgtatttcctcagaccattttacaagcattatcttgtttcatctttcaacagccaagtgaagtaaataagccagacttagccccattttggcagataaggaaacaggattgaggtggcccagtgacttgttgaggccacacggctagctggagacttcgttggagctgcagtcagacctctgaactgggtacagagttcttacccagcatctgccacccttgtggcacctggggccagtcctagactcggatccaataaaaaagagtcaccctgggattcctcagagcaagtgctccggtcgcattccagatcatccactggcaaaagcatcacttcttacacgtggt

SEQ ID NO: 15443 - DNA, 200 bp, Homo sapiens; identical to SEQ ID NO: 11569

SEQ ID NO: 15444 - DNA, 498 bp, Homo sapiens
acagttgctcaatttagagcaaattaatttaacacctgccaaaaaaaggctgctgttggcttatcagttgtctttaaattcaaatgctcatgtgacttttatcacatcaaaaaatatttcattaatgattcacctttagctctgaaaattaccgcgtttagtaattatagtgggcttataaaaacatgcaactctttttgatagttatttgagaattttggtgaaaaatatttagctgagggcagtatagaacttataaaccaatatattgatatttttaaaacatttttacatataagtaaactgccatctttgagcataactacatttaaaaataaagctgcatatttttaaatcaagtgtttaacaagaatttatattttttattttttaaaattaaaaataatttatatttsctctgttgcatgaggattctcatctgtgcttataatggttagagattttatttgtgtggaatgaagtgaggcttgtagtcat

SEQ ID NO: 15445 - DNA, 568 bp, Homo sapiens
acaaggatgtccctcttaatcccctcctgttctttatgaaaggtgatcttgcaatcacccaatcaaacatggatcagggaatgaaaaagacctctagaaaaaaagagaagaaagccagcccttcttccattcagccacaatgacagacaatagtggggtactgctttctaacaagaatactcctaagatgcaccagctctagagatacytgtcaaggctgccatgttcacctcgcagtttagtaaggggaagaatggaaaatagtttagaatgtcttatgctataaaaacatcttcgattaatcatgatctgtaacaacagcacataaagattgatggtgttgctctcattttcagatgagaacaacagactcagaaaggttaagaaacttatccgaggtaaccaaactgcaagaaaaaaaggcttacagaagagtttggaaaaaaggcctcagtttcatctgttttcaatctctgtttaaggagatgctaaggatgtgtttcataataagaatccaagtgacaaggagtcaagtctgtaacaactgtgtttagctgtgagaaaaaat

SEQ ID NO: 15446 - DNA, 477 bp, Homo sapiens
  misc_feature 275,379,435,464: n=a, g, c or t
aatcaaacatggatcagggaatgaaaaagacctctagaaaaaaagagaagaaagccagcccttcttccattcagccacaatgacagacaatagtggggtactgctttctaacaagaatactcctaagatgcaccagctctagagatacttgtcaaggctgccatgttcacctcgcagtttagtaaggggaagaatggaaaatagtttagaatgtcttatgctataaaaacatcttcgattaatcatgatctgtaacaacagcacataaagcaagnaaaaaaggcttacagaagagtttggaaaadaggcctcagtttcatctgttttcaatctctgtttaaggagatgctaaggatgtgtttcataataagaatccaangtgacaaggagtcaagtctgtaaacaactgtgtttagctgtgagaaamaatccagnagaaatgcccatttcccattcttcagganattgtatgggagt

SEQ ID NO: 15447 - DNA, 148 bp, Homo sapiens
actgtccatcttgccttcaggataatgtgaaatatggcctaatttttgaagtttttttcttagaaattttactgaatccaaaataaaacaagaagatcatggtggatatagcttccaaatttattctgcaataaaacaggtttgaagc

SEQ ID NO: 15448 - DNA, 504 bp, Homo sapiens
atgtgatgtagcaagatgagcaacaaaagaagaatcccamgataatcacgtaattatgttaggagagattctcagttcaatctaatcctgtctaaacaggctgaaagaaattagtcactcagaattatataaaaggctctattgaggacacagaaagaagaggcccatctgtaaaccaggaaaaggaccctcatcaaactgagctctgccaacacactgatcttggacttcccagcctccagaattggaatgataccagcttgttgtgcaagccagaaatctgaatgtattctttgacatctaccactctttttcactctctccttatgtggaaagtactatgaatttattctccaatcatctttttaatctggacacctctggccatttctattgccacaaccatagttcaatttattgtcatctcctaactgaactactgtaatcgtttcctaatactcactcagatgatcttactttatgtaatatctacttcacatacgc

SEQ ID NO: 15449 - DNA, 402 bp, Homo sapiens
tttaaagtggaaaagccagaatattgagttatttcttaacaagtttcgagagagaagggagcaagacaagagcaagcaacggctattaaatgtcacaatcctttaattagaaaccatttattggccggacgcggtggctcacgcctgtaatcgcagcactttgggaggccgaggcgggcggctcacgacgtcaggagatccagaccatcttggctaacagggtgaaacccgtctctactaaaaatacaaaaaattagccgggcgtggtggcgggcgcctgtagtcccagctactctggaggctgaggcaggagaatcaattgaacccgggaggcggasttacagtgagctgagattgcgccactgtactcctgggcaacagcgagactccgtctcaaaaaaa

SEQ ID NO: 15450 - DNA, 519 bp, Homo sapiens
cctatagtcgcaggctcagtctcagtgattgtatgctgtggtcagctgtttttgtttttgtgacaccttgttttcttgtttactgtcctgggacagatgtctgtagtcacttgtttccttgggaggcaaatttcagtctctgtgggggaggtctcccatgttagctgtggtggtacttggcaggcagagctcagggatctaggcttccctgctttgtagattgctcaatggtccccaaggcctactggcttttaacaccacttgaaaaccttagtgtttttccgctgtccccagaatcacctcttacacagcctctttttttgtttgtttgactttttccctgagacagagtctcactgtatctggtggcatcttggttcaagtgatcctcctaccacagcctctggagtagcagaggcacgagtcaccacagccagctaatttctgttgtttttgttgttgtggtggttgttttgttttttaagagttgaagtttctccatgttgcccaggttggtct

SEQ ID NO: 15451 - DNA, 511 bp, Homo sapiens
atataggcgtggctgaatacgggcctcctgcgtacgtgcgtggtgtacgtacgtgcgtgattacgcgcacacgtacgttcctcatgaaagggacgacgggagctgcatgaaagccgaagttatggaccgctagcatctgtcactggccaccggtttccgggagtaagcggcactaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcaggtactctctgcagcaccagctgtccccgccctactccggaccgccccaaagactccatgggatggacctgagtcagccgaatcctagccccttcccttg

SEQ ID NO: 15452 - DNA, 377 bp, Homo sapiens
ttattctcttttcgttttgtgtatttgtggtagaaatttcattcactccgatgacttcacttattatctatacataatgctgatgactccagatccagaagccaggagtttgagaccagcctggtcaacatagtgacacgtctctacaaaaaaaaaaaagaaaaaaattagccaggtatggtggcatgtgcctgtagctccatacctgtataatcaacagctattaaatatctgctargcaaactaaactaagcwttttcaaaagtaaacttgtgaaacctgatggatttcagtagttgacatcagcatctacttttgctgaagtcagtagcctggacattatttatgacacttattttttttycccatctkgccct

SEQ ID NO: 15453 - DNA, 114 bp, Homo sapiens
agagctgagctgaagcggggacccggagcccgagcagccgccgccatggcaatcaaatttctgggaagtcatcaagcccttctgtgtcatcctgcaactaacatctgtgaagct

SEQ ID NO: 15454 - DNA, 411 bp, Homo sapiens
aggattggkgtggggttcatcccaccagaccacagagactgaaaataagaaaggggtgaggcctaagggacaatcaggatgtttttcagagagaagtgtggatgctggacaggaagaaccacagataccagatacggaaaaggaagaatcaacactttcagagatggagcctgttgagccacagtaccaactagtcaatgctgaatcgacttctccctttctacattgcctgagagaagtcattggggaatactctgtacacgaattttcactgttggggaaaacakagagtcaagggattggattgtggattgcattggtggttttcctcagtttcctcatcttctccacaagtttctrcatatcgaatgcagagcagcccttcttcaaaggacctcctacggaagctgc

SEQ ID NO: 15455 - DNA, 540 bp, Homo sapiens
tacagtggcgcaaggtcctcttgaaatgttaatgttaatgttcccaaaccagagaatgctttgaaaatgtatcattcagtgtaaattaattacatacatatttttctatatatttgtttcaaactgtaaaaataacataatatgtaatttgtgtattagtgagaggtgaagccagctggacttcctgggtcgagtggggccttggagaacttttctgtcttacaagaggattgtaaaatgcacccatcagtgctctgtaaaacacaccaatcagcgctctgtagctagcaataggtttgtaaaatgcacccatcagcactctgtaaaacgcaccaatcagcactctgtaaaatgcaccaatcagcaggattctaaaagtagacaatcacagggaggattgaaaaaaagggcactctgatagggcaaaaacggaacatgrgaggggacaaataagggaataaaatctggccaccccagccagcagcrgcaacctgttcaggtcgcctgcygctgtggaagctttgtccttttgctcttcat

SEQ ID NO: 15456 - DNA, 390 bp, Homo sapiens
agttttaggcgaatcccaggcgcgccaaggaaagtgctacaaaagccatccatcttgcaagcgttggtgccgaggcgcaacgctgagaacgcaaatactaaagggcgctgttctttcctcgtggagctcacagtccgctggggagaccgtgagatgacagcagagaaactagcgcgatcagtagtactcagcgcaaggacagcgagcagagaaggcaaacctagtgcttgctaaggaagacttcacagaggaggtagtgtcagggccgagactaggagaaggattctagttaagtgaccttcagttcactgaacacctttgaagaacaacttttcattacagcagacagccctgattgctattccaatgtcatcacaaacccccaggatg

SEQ ID NO: 15457 - DNA, 457 bp, Homo sapiens
acccccttgacctcttcctccaggagccgggaccaaaataaccgggcgggaggggacacctcgcagggctctgacaccaagtgagtcctctcgtttctctgtttttgctgagaagctggagtctcctaaggcttcagaatcactaagatggatctcgaactcctgggctcaagcgatcctttcaccttggcctctcaagtagctgggaccacatttgctcaccagctggcccaagaccagactgggcaacatgggtcatcctcctctaagattccaggaccatgatcatccctctattgctacttcttagatcagcttgtaatgtccatctcccccaccagactgcgtctccagcatctctgagtccccagggcctggcctggggcttgctacatggtgggtgctcagtaactgtgaggtaaataaatgaatgaattaaccaaaaaaaaaaaaaaaa

SEQ ID NO: 15458 - DNA, 449 bp, Homo sapiens
agacttgtgagtccctgctggagtcagaagttttaggcaatcccaggcgcgccaaggaaagtgctacaaaagccatccatcttgcaagcgttggtgccgaggcgcaacgctgagarcgcaaatactaaagggcgctgttctttcctcgtggagctcacagtccgctggggagaccgtgagatgacagcagagaaactagcgcgatcagtagtactcagcgcaaggacagcgagcagagaaggcaaacctagtgcttgctaaggaagacttcacagaggaggtagtgtcagggccgagactaggagaaggattctccaggcttcatacggtaaaactctctgggaaggaaaggaactcagagtcccatgcagaaaattgttcagctggaggggtatcagaaagatggatttccaaagccaactgtttcctgtagtgtgtggatctctgca

SEQ ID NO: 15459 - DNA, 492 bp, Homo sapiens
atctcagggctccaaccccaggctggactgggagcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagttttcctccagctctgctgaagsccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccattagggagaaagagcaggttgagaagagtcctaagctaacagccccaaacaggtgggtgttgctcagctccctgaggcatgtggttgtaaggcagaacccacagac

SEQ ID NO: 15460 - DNA, 410 bp, Homo sapiens
aatagaatcatggagcccttgagttagagagaccagagagccagtccaacccagtccatcacctggaggctggagaaccacgaggctgttgcctgttcgtccccctcttctgagaggtccaggtcacctgctctgggagaagccagttgccatgtygtaaggacactcaagcagcccatggaatgactcacatgctgaagaactgagccctccctccttccaacagccagggaggaactagggcttcttgccaataaccatgtgaagaagcttggaaatggattctcccccaaatgagtcttcagattactttagactaacatcttgactgcaacctctasaaagaccctgagcyaggatcaccaagctcacagaagctaagagttaataaatgtttgaattaagctgca

SEQ ID NO: 15461 - DNA, 378 bp, Homo sapiens
agtccaacccagtccatcacctggaggctggagaaccacgaggstgttgctgttcgtccccctcttctgagaggtccaggtcacctgctctgggagaaccagttgccatgtcgtaaggacactcaagcagcccatggaatgactcacatgctgaagaactgagccctccctccttccaacagccagggaggaactagggcttcttgccaataaccatgtgaagaagcttggaaatggattctcccccaaatgagtcttcagattactttagactaacatcttgactgcaacctctagaaagaccctgagctaggatcaccaagctcacagaagctaagagttaataaatgtttgaattaaaaaaaaaaaaaaaaaaaa

SEQ ID NO: 15462 - DNA, 468 bp, Homo sapiens
tgtgtttgttcaactctcagtgactcttaggtactcagtgagtgcgtggtgcccttagagcaattctgatggaaccatttgcatttaatatgagtatctgacatgcattgcagtgcactgcagtgatgaacagctatagctcaggggtcttagaggcctagctttagagcctgaccttgctgtgtgaccttgggcaggttatttaatctctctgtgcatcagccttctttgaggcatctgtagaatggatgtaatagtacttgacttgatagagttgtggtaaggattaaatgaaatgatacctgtaaataggccagtgcctggtacatagtaaatgtccaatgctttccagtatattattatcaacttacagcagcattttgaagagagtgggctggtgtctctcaaacaggttgatgttactacgctgggaacaaaccagattcttcttttagaagtagctgctgg

SEQ ID NO: 15463 - DNA, 569 bp, Homo sapiens
attgaacctgttaatcctgattcctgcctaagtagtccagtgagatttctatgctcaggttgtttaaaagacttgtttacttcgaaggctgtcttcatcttaaaatgaaaacagagtaatcatttccagttgaaaagttaggtggcagtgagggtggagccaagatggccgaataggagcagctccagtctacagctcccagcgtgassaacggagaagacgggtgatttctgcatttccgactgaggtaccaggttcatctcactggggagtgtcagacagtgggtgcaggacagtgggtgcagtgcacgagtgtgagccaaaggagggtgaggcatcacctcacctgggaattgcagggggtcagggaattccctttcctagtcaaagaaaggggtgacagacggcacttgaaaaatcgggtcactcccaccctaatactgtgcttttgcaatggtcttagcaaatggcacaccaggagatatatccggtgcctggctcagagggtctagccacgagccttgctcattgctagcacagcagactgagatcaactgcargtggcagca

SEQ ID NO: 15464 - DNA, 410 bp, Homo sapiens
attttgagttgaaggcagctgagaaacagtagatgcaggagcagctctctgcttccttcctgcctcgaagccgggcgtgaattccctctgtgaaggtgtcctctcccctctccacaccaggaggagagactgcagattgaggctgcataaccaacctcactgaagttgctcttaccttcctagaagcccaaccccctcttcccccctctttttttgtttgagatggggtctcattctgtcacccagactgaagtgaaatgacgggacctcacctcaccacaacctccgtctcctgaggcgggagaattgcttgaacctggcaggcggaggttgcagtgagctgagattgtgccactgcactccagcctgggtgacagagcgagactccatctcaaaaaaaaaaaaaaaaa

SEQ ID NO: 15465 - DNA, 405 bp, Homo sapiens
agagtacaggtcgtgctgcagttagttcattgaaaactcatttgctcttggagcagtcaggcagtgactgccttcggctttttttctgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagcaaaaaaaaaaaaaaaa

SEQ ID NO: 15466 - DNA, 375 bp, Homo sapiens
acttttcagtccttgcgcaccggggaacaaggtcgtgaaaaaaaaggtcttggtgaggtgccgccatttcatctgtcctcattctctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctcttggaagtggatcaaactagaactcatatgccatactagatatgtttgtcaataaacttatgacgtcaaaaaaaaaaaaaaaaagg

SEQ ID NO: 15467 - DNA, 392 bp, Homo sapiens
agagtacaggtcgtgctgcagttagttcattgaaaactcatttgctcttggagcagtcaggcagtgactgccttcgggctttktttctgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagcaa

SEQ ID NO: 15468 - DNA, 393 bp, Homo sapiens
atagtacaggtcgtgctgcagttagttcattgawaactcatttgctcttggagcagtcaggcagtgactgccttcggctwtttttctgctgactaagatctcctatagagwgctacaacaatgcccaaaagawagccaaagagaagatctgccaggttgtctgctatgcwtgtgccagttacaccagaggtgaagcctaaaagaacatcaagttcaaggaaaatgaagacaaaaagtgatatgatggaagawaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagcaaaa

SEQ ID NO: 15469 - DNA, 406 bp, Homo sapiens
  misc_feature 273: n=a, g, c or t
agagtacaggtcgtgctgcagttagttcattgaaaactcatttgctcttggagcagtcaggcagtgactgccttcggctttttttsckgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccnagcagttgctgaaaccaagcaagaagcagttgttgaagaagactacaatgaaaatgctaaaaatggagaagccaaaattacagaggcaccagcttctgaaaaagaaattgtggaagcaaaaaaaaaaaaaaaa

SEQ ID NO: 15470 - DNA, 405 bp, Homo sapiens; identical to SEQ ID NO: 15465

SEQ ID NO: 15471 - DNA, 376 bp, Homo sapiens
attccaatctcatgagagaagagcccctagttctcaggactttaaccctcttcctgccagcacccccaggccagtgctgaggctgacaagttgtctaaaagggcaggaggacttactcctgacatgcatctgccacccaaaccatcacaatagccttccgccttctcagtgggagtacgagtgaccctgcagcagaaggcagcaggaggtggtgacaagaatacacgtctggccctaaaacctgggtcagtcacatcctggctgccattcaccagctatatgattttaggaaagtggattcacctctgagctgcagattcctcatcaataaaatgaagacaagaacacccacccttagtatttgggtatttaaaaa

SEQ ID NO: 15472 - DNA, 446 bp, Homo sapiens
acggctagataggccgccggcagatgtggcgggggagagccggggctttgctccgggtgtgggggttttggccgacagggttcccagaaggagaccgctaagctgcgatgctccgtcgcaggcgggaagcaattatccccgctgttggaactgcggcggcccatggggcccgggcgggaggacaggttcttctgcccacagtgccgagcgctgcaggcacctgaccccactcgagactacttcagccttatgggactgcaaccgttccttcagagttgatacagcgaaskccagcacaggtaccagcaactgcagcgtcttgtccacccagatttcttcagccagaggtctcagactgaaaaggacttctcagagaagcattcgaccctggtgaatgatgcctataagacccttcctggcccccctgagcagagggactgtacctt

SEQ ID NO: 15473 - DNA, 461 bp, Homo sapiens
taacaaggaagactatatctaaaaagaaatttaatatatgtttttgattatatatgctcttttgtcctagctagcagtgtcatttatataattaataaatttgtttttaacagaggtgctcattaaggtgcttgtgatttgatttctaagaaagtaagttgagggccgggcgtggtggcttgcgcctgtagtccagcactttgggaggccgaggtgggtggatcacttggtcaggagttcgagaccagcctggccaacatgatgaaaaaccccatctctactaaaaatacaaaaaattggccgggtgtggtggtgtgcacctgtactcccacttacttgggaggctgaggcaggagaatcacttgaacccgggaggtggaggttgcggtgggccgagatcgcaccactgcactctagcctgggtgacatggctagactccatctcaaaaaaaaaaaaaaaa

SEQ ID NO: 15474 - DNA, 466 bp, Homo sapiens
ttggaaattttgtattttagttagagggcaaaataaaggcatttttaaatatgtgaggattcaaagtttactctttacccatcctgtatttatttttatttatatttttgatatatagtctcgctttgttgcccggggtggggtgcagtggtgcaatctctgctcgctgcagcctctgcctcccgggttcaagcaattctcatgcctgtaatttcagtactttgggaggccaaggcaggcagattgcttgagcccagtagtttgagaccagcatgggcaacataatgaaaccccatctctacaaaaaataaaaaaacattgaccgggtgtggtggcttgtgcctatggccccagctacttgggggtactgaggtgggaagattgcttgggcccagggggtcaaggctgcagtgagctatgatcctgccactgcactccaggctgggtgacggagtgaaaccctgtg

SEQ ID NO: 15475 - DNA, 447 bp, Homo sapiens
  misc_feature 420: n=a, g, c or t
acagccgagggcactatggtaagacgagcgcgctggccgggasgccggcgaggcgagaaaagccccccgcacggccccgggagtgaggccgccattttaacctgattttggcctccaaggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggggggtttctttcttctgataattctagarcctgttaccatagaaaggcatttcttcaatrgctggttgtagttagttcatgtttttcaatcaaatttgcaaatgtatttgttgctgtatagtgattgtwttgctnaataaaattgcttgtcacctaaaaaaa

SEQ ID NO: 15476 - DNA, 478 bp, Homo sapiens
actcggcagccgcctgtcgccgcgggagcagccgctatctctgtgtgtccgcgtgtgcgcccggtccccgcctgccgcaccatggagagctaccacaagcctgaccagcagaarccygyaaggccttgaaggacacggccaaccgcctacgtatcagctccatccaggsccaccactgcggcgggctctggccaccccacgtaatgctgcagcgccgcagagrtcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggastgctgaaacctgaggaagatcagctccgacttggacggggcaccggttcccgaaacaagctttcaccgacgtggccactggctccctgggccagggcctcggggcg

SEQ ID NO: 15477 - DNA, 403 bp, Homo sapiens
attagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacaaaaaaaaaaaaaa

SEQ ID NO: 15478 - DNA, 453 bp, Homo sapiens
attcgggccgcggcggcgctgggtgcagccgagcggtgtggagcggagagaatactcgaagggctctcctgatactaacagttttacgatttaaaacttcgccagaatttcgacagggtctcactgtattgcccrggttggtctcgaactcctggcttcrggcgattctcccrcctcrgcctcccaaggtgctgggattrcaggcgtgacaccacgcctggcctcactcaaacagtaaacgaggtaggttgggggtatatttttgttttgggataaaaagaaactgaatcttataaatattaaatgggttaagatgtgagtaaatttttgggtttagactttaaggtgagaagccgaattattttagggttcgaaatgtgagtgggaaatttgcctactagtgtaggcggcgattactccattcccaacatgcctaggttctcgacattcata

SEQ ID NO: 15479 - DNA, 478 bp, Homo sapiens
caagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaaaaaaaaa

SEQ ID NO: 15480 - DNA, 297 bp, Homo sapiens
catcaaggccatcaacaacaactggcacccgggctgcttccgctgcgagctgtgtgatgtggagctggctgacctgggctttgtgaagaatgccggcagatctctgccggccttgccacaaccgtgagaaggccaagggctgggcaagtacatctgccagcggtgccacctggtcatcgacgagcagcccctcatgttcaggagcgacgcctaccaccctgaccacttcaactgcacccactgtgggaargagctgacagccgaggcccgcgagctgaagggtgagctctactgcct

SEQ ID NO: 15481 - DNA, 340 bp, Homo sapiens
atttttgcattttgcaatcaattttgtatttttctttttgtattgggggcattctctggtgactatttcctaagatgactttcaaagaggcttaacaaaggagctatggaaactcatctgattccaggtatgatgatggaagagggacaccaggaaaccctccccaaagaatggatcaaatcagtcatttgcccatggcttgtggacaaggaaggtaaatgtctactctaagaagcagacaactggacatacacattcatagcagaaggaaaccatcaagaagtggagggctgaccatgctggagtagtagatgaaaatatgtgtctaaacggggactta

SEQ ID NO: 15482 - DNA, 476 bp, Homo sapiens
ataaaaaatttaaattaaaaaaaaaaagtgaaagaggattcgggatgaccccaggtttttcggtccaagtaaaaagaacaatgagagttgccattagctgagatgagcagcttttgagggagagatgggaattccattttggacatgttaaggttgagatgtcttactggacatccaggtggtaatggcaagtgggtagttggtcgtatgagtctggaggtcagcagggaggtctaagttggagatacagtttgggcagttgtgagtatatagatggtaattaaaaccatgcaacttgtgaaatcaccaaggagagtgagtgcaggaaggaggaagggcacccggctctactcgtttgtagtctttatgtattgtacatttgagttgtgtgcacctcaaaactgatgtaccaccgggcgtggtggctcacgcctgtaatcccagcactctgcgaggccgaggtgggcggatcactt

SEQ ID NO: 15483 - DNA, 506 bp, Homo sapiens
tctttcagtttcatattactctaaatccattacaaatatgcttaacctctaaatatttcatcactgaagaaatcccagccctacaacgttggaacagtaaaatattagtccaaggatccagtgagagacacagaagtgctagaagccactcctcatgaactaaggagaaaaagaacagacaagggaacaccccagacatggtatcagagatccacatgacaggcccaatgtgcctcattgagaacactaatgggcgactgatggcgaatccagaagctctgaagatcctttctgccattacgcagcctgtggtggtggtggcgactgtgggccgctagcgcacaggaaaatcctacctgattaacaagctggctcagaagaaaaagggtgagtggcatgagcaaagctctgccaagtcccttctgtccatctacacagtcagsctccatcacgaggatgtgaagagagaaagagatgaggatgaatatggaaagctaactttccat

SEQ ID NO: 15484 - DNA, 500 bp, Homo sapiens
aaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataa

SEQ ID NO: 15485 - DNA, 470 bp, Homo sapiens
atgcatggctgcatggagcccggccgcggcagcctctcctccgcgggatcctcgggcttccacttcaccatcggatctttgccactcagactgagggggagctcagagtgacccaaattctcaaagaaaagtttccacgagctacagctataaaagtcactgacatttcaggaggttgtggggcgatgtatgaaattaaaattgaatcagaagaatttaaggagaagagaactgtccagcagcaccagatggttaatcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatcta

SEQ ID NO: 15486 - DNA, 512 bp, Homo sapiens
aaaattcgctaacttccatcccgcaattccgctgaactcggcccgaaaagccccctcttgcctcaattccccgaagtaaatctgagctttgtgcagctccggagccagagcgtccagatgcggtccgggagattagcaaagtcggtggaagccaagctggagaaagcgcgggcgcagggagaaaagtagccccaagtgccctgcatttgctcttctaacaaagttctgtttgttgacggactgaccggcttaccgacacaaagatgggaagcaaatggagagacggatcaaggcccttcctcggcatctggaagcttgggcgagtgtcttggtcgccagagatggggtttcatgatgttgcccagttcttgaactcctgagctccagtgatcagtctgcctcggctgcccaaagtgctgcgattacaagtgtgagccaccgcgctggcctataatgtgttctttactcatgtatatgttttttaatttcsataataaattttttacaactaa

SEQ ID NO: 15487 - DNA, 444 bp, Homo sapiens
cttgaatttctatttcttatctgtgtcattctgcctctaccatgtctaatgtactgaatggtaaaatgtttgagaacagacatggtgtattagatttctttgtgttttccaactatctagcctcagatagggtaaacgtccaataaaaatttgaataatgtttgtgaaatacagtcactctttaggcatcagatttaaaaaatttcagccacgtacattggaagtctcttaaaaatgtctttcttgcctttttactttggaggtcatcattgtgaatattaattatttcagctaatcctagtacattaatgccttcaggggttgctgaaggcaacttagggtaggatggctggctgctctctgaaatgtccctagactgctgtgcgttaagtttcattttgtatgcttattatatcttctgcctcttccacatttagattactt

SEQ ID NO: 15488 - DNA, 355 bp, Homo sapiens
tattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttccaaaaaaaaaaaaaaaag

SEQ ID NO: 15489 - DNA, 352 bp, Homo sapiens
acattctactaaaagccctataggcagcttacttgacagcaaatgctcaagagagcaaaatgtcctcctgctggatcctgactttccaaggctctcacttcaggtcttcctgagggatgccaaggatgccaacatgggcttatttctcacctcagatgcctctggccaattggcaaggggaaccacagtatccatgatctacacaccaggaattgttttctcctcctgatatcaggagtgctttactccttgattctgcacatgatgtaagttgtccctgtctgcctgagagtttctttcttatcttgcttatccaataaatatattttattggcacaaaaaaaaaaaaaat

SEQ ID NO: 15490 - DNA, 607 bp, Homo sapiens
attttttgtctaatcgcggcctgtgacgctcgaagggcggggagcagagggagatacagaaaccgacagggccaggcacccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagtycataaatgcagatgt

SEQ ID NO: 15491 - DNA, 553 bp, Homo sapiens
  misc_feature 48,85,93,115,124,143,149,160,193,195,204,208,234,276,293,304..305330,364: n=a, g, c or t
gttccgwsyysgggmmgrcggcmgssggscgcsgygkkcktygtyasnkgkysggggkgcgggrcgccsgcstsmmgggsccctnctctcssncmccgsgggtkctgratcgsgncacscrccnccgacttcgrawtcmggrnkgcggnrgggcggccgnamgmctsgyggktcgrgaaawkgwraaatccmngntascsgkynrcanccagaatcggracttkaggmamtkcnacawaaaccgaatcccgraagmwaaagaaaaagagsaccwgnagcmtcargcgawtwcnrrttaywgccnnkarccaggrryggagatyammrgrnccrtcgyggattakgtattyakytaagtgccarntrcagctmaaymkkwrrstscywksgsmwstrgsmrkctacragmmwwakwykytsmwrycttkggskryskkrrssarymkgargssaywykwwssakwkkskksyrsywysrskgakgrswrgkracctgwwggcattttttccagagtggtgcagtaccactgaggactgttgctgtatttgatta

SEQ ID NO: 15492 - DNA, 465 bp, Homo sapiens
cttaccttaaataatttacctttccttcttactttcagccagttaaatcatcatttgaatgttatatttaaatattactttatagaagagaagcatttaagactaaaaaatttcaggacagataacttgagctggtagcattaacatagaatacatctgcttcttatggttctgataatgttctaaactgtgataaatcctacagacacctaggtatataaacatatacattttcaggaatttggaattttgtagaaatttcaaaaagtctcaaggtgagagaaactgccaagtacagtcctcaactgaactatgcccacggggcccttgctttggatgaagaagatagaaccagagggcaagtgctccaattccttagcttcttaactactttagtttgagtataagaaaagaagctacttctctttttctgtttgtttttgttttgttttgttttgagacgga

SEQ ID NO: 15493 - DNA, 497 bp, Homo sapiens
ttatgagcctgtttctctttttcttttcttcttctcattattttaaagagatggagtctcagtatgttgcttaggctggtctcagactcctgggctgaagccattctcccgcctcagccttccaagtagctgggattacaggcaggagccaccaccccagacatgaacccacttctaatgcaaaacacatattgacctgacaacagggccctcagttgtggtggaaagagcagtgaccttggaattaaaagccctgttgtgactcgtggctttgcatgtttaaccaacsctacttttatktacctataatgtgcaggtatctgtctcactctttagggatgccaaaggtgaaatgaggtgtgctgtctatgtgacagtgccttgtgagcacttttctgacttctccctgaggaggtttgggtcaggcctagcagaaactgcagccatagagcatggagggaagtaggacttgactagcataaagtgagtctatgaga

SEQ ID NO: 15494 - DNA, 488 bp, Homo sapiens
ttatgttttgaaagcaataaaaatcacccagtttcaaaactgcacaaagggcttgaatagagatttttccagagaggacatacagatggccagtagcacatcaacatgattggtcattaggaaatgcaagtcaaaaccaaaataagataccacttcataccaggtatcttattttacctagtatggctataatagtttaaagaaaaaagggaaataactgttggcaaggatgtggagaaatgggaacattgctgatgaaaatgtaaagtggtgtagccactgtggaaaagggtttggcagttcctcccaaaggtgaacacagaaaccatatgatccagcaattccactcctacatatatatccaaaacaattgaaaacagggactgtggccaggtgcagtggctcatgcctgtaatcctagtactttgggaggcgggcagatcacctgaggtcagtagttcaggaccagcctggctaacatggcaaaa

SEQ ID NO: 15495 - DNA, 485 bp, Homo sapiens
  misc_feature 23: n=a, g, c or t
ctaaaaacagaaaccgacagggnccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaaggactgctctgtgtcctcacag

SEQ ID NO: 15496 - DNA, 352 bp, Homo sapiens
agtttctgtggcgttcgagttccatcggctcccatccgtgctatcctgccgccttagcgtgcttctccccaggatgcgggcagggggcctctctcccactccccacacaccgatttctgagtagcgataggggctggaggcttattttatggggtagggggccgctggtagrcgaagattgtccgagggagagggggaggatgaagccaktgcgtggcgaagacttgccagatgttgatgcctaagaagaaccggattgccatttatgaactcctttttaaggagggagtcatggtggccaagaaggatgtccacatgcctaagcacccggagctggcagacaagaatgtgc

SEQ ID NO: 15497 - DNA, 493 bp, Homo sapiens
aattcttatctgtaggacaagtgttggacagccggagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgt

SEQ ID NO: 15498 - DNA, 489 bp, Homo sapiens
aataaaaaatttgggctgttccagtgcctttatttttccttataattcttagtatcagcttgtctttcttcaagaaccctttctgagaggttagctgtgatcacactgactgtagatgagttagatagtaatagccaatcttccagccccatcacaagaccagctctctctcagatcttctgtggtcttcctttgcaagatgttacagtccatggataggtcttgtacatctgttaacttattcctccgttttttaatatttttacgctgttgctgatggagcagcttttaaattttataattttgcattgcattttcggtggcgtgtaccctgacggacggacagttggtaaagtcgttaattttgcattgcattttcggtagcgcgtaccatgatggatggacagttggtaaagttgttcagcagatgtcttgattatgaggaggtctcatgcgaggtagctttgcttagccctctcatactcttta

SEQ ID NO: 15499 - DNA, 477 bp, Homo sapiens
tgaagggaatggagtcaagaagtttatttaagacaggagaaataagatttacatgctgaaggggaaaattcattagaaaaaatttgtcagtttcttatttaataaatagcatttgttatgtgccagcactattcgaaatgtcactgaaacacagactcagccactcaccacttgtagagtccgataacaatagtgaggtctggtataaagagagtgactttttattccaaagctagctttggggaagaaatacaggcctcctgccttaagggtaccacttcagctttggagcagaaagcagctgcttttaaaagggagcttggcatgaatggcacgcagtgagaaagcaaacaggtgagggtgctttatctgccgggcagttgaggtggcaatcactggcaccttcatgggcagaactaggttgtaaaagtggctgaggccaggcacagtggctcatgcctgtaatcccagcacttt

SEQ ID NO: 15500 - DNA, 436 bp, Homo sapiens
agttgcccgggtaaccgagcagagtcggcggggtgcgttccttagtctttcattcatcagcgtaaaaagaactgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgaggtccgatgctcgcctggctggcctatggctgcgggagcggtgtgtgtcggaccgtagacggcctcacggctagagtttgaggactatgggggcggggacggtgcctgtgtctgtggcggtcaccgggcttcacgtggtcctcagcagggtgatggtggacagctcgcgcgagggcccgggagtcttggggacacttccccggcgcggtctgtggactgagcgctgggac

SEQ ID NO: 15501 - DNA, 432 bp, Homo sapiens
attcatcagcgtaaaaagaactgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgaggtccgatgctcgcctggctggcctatggctgcgggagsgattgagaatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaastaggaagtttcaagattcaaacttagcg

SEQ ID NO: 15502 - DNA, 367 bp, Homo sapiens
agacccataataacaatgacaacactttcataacagttcatctgtgttaacatacaaattctcgcagcaacactccagaatgcaaaactctctgaggagctgagaatatgtctactgctaccaaaattgtaacccccatcatctagtaaagagttggtacacggtgaacatttgctgtgggaatgtattctgcttcattccagaggcctgccaattcttaatctcactataggctgaagagctgctcacatagaatacttgtagtgacttccattttcaccagtttagatcagtggacagagagatgctgaattactgctaagaagatagatccacatgccttcaacttcagaatcttaaattagag

SEQ ID NO: 15503 - DNA, 516 bp, Homo sapiens
atttttaaccaaagaccgaagaagggatagagtccacctcagtgtcccaagctcaaatcatgctcagaacatgttcagaccagttctaagtctgtttggccttctggatctgtggtccagaatacttgcagaattttccttatttctagccttttgtgccatatgtrggataattcrctgaayatcatcygwgccatggataactcatacaaaggcacaaacccaagccatgtgaatggcctatttgaaaacttttttttttactgaggcaactgggacagtagctgtkgaatgaactcctcttctaccaacgccagaatccagtgacgtttcaccagtatgaagatgggaascacatgctatacttatagactacagataaacttcatatccttcttatttttattgttaacattactgttttgattctatcattcactcctatttgctgagcatctattatgggcttagtattttgcagctataatgagaagaggaattattttttaaaaaacg

SEQ ID NO: 15504 - DNA, 208 bp, Homo sapiens
aaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaatggaaaaaaaaaaaaraaaaaaaaaaaaaaaaaaaaaaaaaaaaaaaaaar

SEQ ID NO: 15505 - DNA, 165 bp, Homo sapiens
aaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaatggaaaaa

SEQ ID NO: 15506 - DNA, 401 bp, Homo sapiens
  misc_feature 86,316,359,366: n=a, g, c or t
gctactacgatggcgatgagtttcgagtggccgtggcagtatcgcttcccacccttctttacgttacaaccgaatgtggacactsngcagaagcagctggccgcctggtgctcgctggtcctgtccttctgccgcstgcacaaacagtccagcatgacggtgatggaagctcaggagagcccgctcttcaacaacgtcaagctacagcgaaasttcctgtggagtcgatccagattgtattagaggaactgaggaagaaagggaacctcgagtggttggataagagcaagtccagcttcctgatcatgtggcggangccaaagaatgggggaaactcatctatcagtgggtttccagantkgccanaacaactccgtctttaccctgtatgaactkactaa

SEQ ID NO: 15507 - DNA, 417 bp, Homo sapiens
  misc_feature 261,327,360: n=a, g, c or t
gctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaasttcctgtggagtcgatccagattgtattagaggaactgaggaagaaanggaacctcgagtggttggataagagcaagtccagcttcctgatcatgtggcggaggcataagaatnggggaaactcatctatcagtgggtttccaggantggccagaacaactccgtctttacsctgtatgaactgactaatggggaagacacaga

SEQ ID NO: 15508 - DNA, 383 bp, Homo sapiens
  misc_feature 183..184: n=a, g, c or t
agcttccgggtttcctgggctactacgatggcgatgagtttcgagtggccgtggcagtatcgcttcccacccttctttamgktaacaacsgaatgtggacactcggcagaagcagctggccgcctggtgctcgctggtcctgtccttctgccgcctgcacaaacagtccagcatgacggtvhnngaagctcaggagagcccgctcttcaacaacgtcaagctacagcgaaasttcctgtggagtcgatccagattgtattagaggaactgaggaagaaagagaacctcgagtggttggataagagcaagtccagcttcctgatcatgtggcggaggcagaagaatgggggaaactcatctatcagtgggtttccaggagtggc

SEQ ID NO: 15509 - DNA, 360 bp, Homo sapiens
cttagccgrttagcttccgggtttcctgggctactacgatggcgatgagtttcgagtggccgtggcagtatcgcttcccacccttctttacgttacaaccgaatgtggacactcggcakmagsagctggccgcctggtgctcgctggtcctgtccttctgccgcctkcacaaacagtccagcatgacggtgatggaagctcaggagagcccgctcttcaacaacgtcaagctacagcgaaasttcctgtggagtcgatccagattgtattaraggaactgaggaasaaagggaacctcgartggytggataagagcaagtccagcttcctgatcatgtggcggargcagaagaatggggg

SEQ ID NO: 15510 - DNA, 261 bp, Homo sapiens
  misc_feature 104,114,203: n=a, g, c or t
cttagccggtagcttccgggtttcctgggctactacgatggcgatgagtttcgagtggccgtggcagtatcgcttcccacccttctttacgttacaaccgaatntggacactsngcagaagcagctggccscctggtgctcgctggtcctgtccttctgccgcctgcacaaaacagtccagcatgacggtgatggaagctcangarascccgctcttcaacaacgtcaagctacagcgaaasttcctgtggagtcgatcca

SEQ ID NO: 15511 - DNA, 400 bp, Homo sapiens
  misc_feature 284: n=a, g, c or t
actacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagcgaacctcgagtggttggataagancaagtccagcttcctgatcatgtggcggaggcagaagaatgggggaaactcatctatcagtgggtttccaggagtggccagaacaactccgtctttaccctgtatgaactgactaa

SEQ ID NO: 15512 - DNA, 416 bp, Homo sapiens
agtaactagcacgtggctcccgcccccagactgcttctttattcattcctaacctttaccttggcagatgaaatataagattcatcaaccacatttgacagcccatggcaggtttcctgttttccatcgtccctctgcaggtcacagacacacagagcccagccgtggcaggctcagccggggtccggggctgctaacaacggctacattcctcccccagggccaagggaaatcctgagcgcaggccagggttgtttggttttgaggtgtgctgggatgaaaggcaccctggaagtggaagtgactgccacaaaggcatcagatattcaccaccttctcggctgcctcagcacagcaagctttattctgggacctgagatcctgttctgagctggctttcccttctccaggctcgc

SEQ ID NO: 15513 - DNA, 444 bp, Homo sapiens
attcattttttctgctaccgtgactaagatggaagcgtttttggggtcgcggtccggactttgggcggggggtccggccccaggacagttttaccgcattccatccactcccgattccttcatggatccggcgtctgcactttacagaggtccaatcaccggacccagattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttaatggtgcatacttggctcagctctgctgcgagaagttctsgagaagcagccagtgctaagccagacc

SEQ ID NO: 15514 - DNA, 93 bp, Homo sapiens
tttttttctgctaccgtgactaagatggaagcstttttggggtctggggccggaccccccgcccaaagtccggaccgcgaccccaaaaaaaaa

SEQ ID NO: 15515 - DNA, 479 bp, Homo sapiens
gaaggcggtgcgacasrgctggagggcagaggaggcggcgcggggtgtcctgtccttgccatgaggccgcagcaggcgccggtgtccggaaaggtgttcattcagcgagactacagcagtggcacacgctgccagttccagaccaagttccctgcggastggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacggcctcctcctgacagaccctattgagcgaggactgcgagttattgaaattaccatttatgaagacagaggcatgagcagtggaagataaaccgaaga

SEQ ID NO: 15516 - DNA, 343 bp, Homo sapiens
taaaaaacacaagtaagctactaaaacagtactccaaaagcaagtgtgagagatgcctatctagagattattgttgcacaggttagatwagggttttcatgctggtgggaagttcagagatgggctagctcttgaaactttggattaggttcaggaacaacatagtgctctgcagtggcccaattctacagatgatacacacttggaattatattttgaacagctgggaatacacagaaaatttttaaaggaaaaaaaacaaacatagagcatcgtaaatgagaccttatgatgcaggtgtgcatatattggcagcatgcaaattcacaaagtcaggtatttg

SEQ ID NO: 15517 - DNA, 180 bp, Homo sapiens
aacaatggctgaggaatgccccagagcgtgcgcggasctgtggcgcccaaggccacggccccgccggagaggaccagcgactactaccgcgtgasccggacctgccgggcaggttcaacaacccggggtggttccggggctacaggacccagaaggctgtctccgtgtacaggaccaggc

SEQ ID NO: 15518 - DNA, 198 bp, Homo sapiens
caagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaaaaaaaaaaaaaaaaa

SEQ ID NO: 15519 - DNA, 457 bp, Homo sapiens
  misc_feature 197: n=a, g, c or t
aactgcaggaatcgacgctaggtcggcttccctggagcgccctccccagccctgtccagcctctcgatctttgtcctaacctcagacggcgatgggcggggcaagacgctggtccttcaggcccgagttgatgggcacctcgggctcatcaccgtgaagtcccctgcggccgaaggcggtggatttttagggtctcnmccgcccacccctaatgccagtccccaccactgcgtactctgttgcggatcacaccatccaatacaaactttattggtaatggaagccagcttcaatctggtttcctgttagaaacttgaaagagtttaatttaccgatttatttttaacaaccctagaaacctattaamcccartcacacagatttagcttttggttataacatggcctggcacgctttctgatattgtcgagtgtaaacataggtcttctttctccaa

SEQ ID NO: 15520 - DNA, 463 bp, Homo sapiens
aaggtcgtgaaaaaaattttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtraaaaaaaaaaaaaaaaaaa

SEQ ID NO: 15521 - DNA, 442 bp, Homo sapiens
agaaccacgcgaggcagggtgaggggcgccaccgaggaagcgcccaccgggctcccggggctgccaggccccaaattgaggaagttgactgccagatcacactctgttggcccacgcagatagattccattcatcctttctaatgtctacaccatattttggataacatgccatcatctcacattgtgttgaaagaagaaaccagaatgttggggttgatgtatgccatatggatgaatttaaacagtttcggccttgcaataattggtatacttctaattgcatgtgaaattatactctttttaacgaaagatgaaactattcagtggccacatgcacttcgccctcggaaatctcactgtcggaatccttggaaatcacaccacgcacaacttctatttcttcataatttgcaaagaaccagtgtgactccagtcaagaa

SEQ ID NO: 15522 - DNA, 415 bp, Homo sapiens
gacgccaccgaggaagagaccccaccggctcccgaggctgccaggcccccgctcaggcgctgcctgcagaaccacgcccccctgtccctgtgctaagagggtgacgcgaktgcccgaagccctggcctggttaccattcgcgactccctcgtcctgggttctcccattgccaggaatgttttactagtaaccatggtatagttgagacgatccactcttgtcctacgcatttcggcacaatacaggcgtctaggaggcttacctggcattgcctgagagaatcttccatccatttaagtacccagtaacagagggagcaaagcaaatcttatcctcaaagaactgcagctgcttgttagatctacctggtggttccatagagaaactgctcagagaacctgcctttaactcgcct

SEQ ID NO: 15523 - DNA, 497 bp, Homo sapiens
tggtctcaccgtggcctcctctcttccttgaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggagagttcaagacggccccaatgaagatggggagatgttcatgcggccagggaagctgttcgactatttcccaaaaccataccccaacagtgaggctgctcgagctgccaacaacggagcattgccccctgaacctcagctacatcgtgcgagctaggcatggtggtgaggactacgtcttctccctgctcacgggctactgcgagccacccaccggggtgtcactgcgggaaggtctctacttcaacccctactttcctgggccaggcccattgccatggcccctcccatctacacagatgtcttagagtttgacgatggcacccc

SEQ ID NO: 15524 - DNA, 510 bp, Homo sapiens
attagcagagcttaggccggcagcagtcagaaatgtctgctggagaagacactgcaaagtgtcagtgagggcgtttgagaattaattttaccctagagtagctgckcaggtctgtttagcactcacctctacagttttgaacattcgataacaccagaatcagtctgatgccttgaacactttacatgaagggtttttcaaaatctagccacaaacagatatgaccagatttcaaaaaattttgagaaactaggaggaatctattttgacaaagccaagccacacataggatagaggcagacatgcgtgccctggaaagaagaaagtagaaggatcaactaaaagagctctcccactaaatggctgtgggctcctctaagaaactgaaacatggaagaaggaaggaccagccagccagaacagcagtgggtatcaaggaatgatataaaagcaagctcaagacagtcaagattcaaggagctatataccttgmttcctttcagagcttga

SEQ ID NO: 15525 - DNA, 542 bp, Homo sapiens
ataggaattgtgaaggcctttataaacctccattagcagagcttaggccggcagcagtcagaaatgtctgctggagaagacactgcaaagtgymagtgagggcgtttgagaattaattttaccctagagtagctgcgcaggtctgtttagcactcacctctacagttttgaacattcgataacaccagaatcagtctgatgccttgaacactttacatgaagggtttttcaaaatctagccacaaacagatatgaccagatttcaaaaaattttgagaaactaggaggaatctattttgacaaagccaagccacacataggatagaggcagacatgcgtgccctggaaagaagaaagtagaaggatcaactaaaagagctctcccactaaatggctgtgggctcctctaagaaactgaaacatggaagaaggaaggaccagccagccagaacagcagtgggtatcaaggaatgatataaaagcaagctcaagacagtcaagattcaaaggagctatataccttgcttcctttccagagctga

SEQ ID NO: 15526 - DNA, 287 bp, Homo sapiens
attcatctaacagtgattggatatggggagctgtctataggaagcgggggtgatcttgggtgagaatgctctcttctgctgagaacaactgccagaggactcaactgagcacctttaaccattagctgaggcttcttagcagtctgccatagcaactcaagtaatgcaactttactcagcatggaccgtcactttctccagacttctaagagatgccatagcagaaaatttatgcctttccctgcagtccttgtcaagtgttaaatcccatggccttatatcctgag

SEQ ID NO: 15527 - DNA, 406 bp, Homo sapiens
agacctttcttcctattcatctaacagtgattggatatggggagctgtctataggaagcgggggtgatcttgggtgagaatgctctcttctgctgagaacaactgccagaggactcaactgagcacctttaaccattagctgaggcttcttagcagctcctccggcattcggattgatctcttttactgaggaagagttgcctgagaatggttagtgggatgcaacacagcaccgtctctgcaattggtctcaagactggaactgactgtttacgcttatctggatgtaagaatgaaaattgacttagtggaaacacttgcatatgtgtaaagacctaaatggtggttcattcaagaaaattaatctgtgtaataaatggattaaaacagccataagtttttttta

SEQ ID NO: 15528 - DNA, 434 bp, Homo sapiens
tgtggcttgtgcttaacttactgaggggacacctagatttgttagccatttttttatggcagagtacaaaagaggccatataacatatctcagtatttggtaacattaaatggatttcactgatataatcaaatttctaaacatgaagccgggaaatcatgtcacatgaggaatggttgaaacaaccatgagtactgaacctgaagaagcaaggactactgggtagactctacacctgtcttgaaagatacagggaagcaaatttcagcttaactttaccatcaagcagtggaaactctgctggggactagtgtgtgaacaccactgcatgaggtgaccctgaatgatgctggtctttcaagaaaagttctacatgggaaaccttcatattctgtgggcatacactaaaagtgtactatcagctttgcacttcc

SEQ ID NO: 15529 - DNA, 447 bp, Homo sapiens
atttcctgagtgagggcaacaagaccagaggagccactttatcgatctgggtggtgccaactgatccatcaagtgccaggtctgcaaaatatctcagacactgatcttaggttttacaatagtgatgttatcaccaggagtaatttgaagaggtttagaatctcgcaggcagcctccagctgcatgactcctaaaccacaatttttaatcttgtggataatttgttagtcctgcaaagctgttattgtctttgtttcaaactataaactaaattcctcccaaagttaatttggcctacacccaggagtgaacaagaacagcttggggattacaagcaagatggagttggttaagtcagatctttttcactgtaataattttctcatttataattttgaatggagtttcaaccttgtctcaraaataattttttttaactaaatttga

SEQ ID NO: 15530 - DNA, 454 bp, Homo sapiens
  misc_feature 432: n=a, g, c or t
atttttcctgagtgagggcaacaagaccagaggagccactttatcgatctgggtggtgccaactgatccatcaagtgccagcctacacattagcataatgtggattttccaagctacttttatacatgaaataatataagctgtaatgagtgaaagtaagcacggatttttcagcagtactttccagaaattttgatggaagatcagctttttgtagctggagaagttggattaaaaaatgaccacagagaaactgaaagatgtccagtagaaggtctgtagacttcattccaattcagcatatccatgaggtcaccaagaaattaagtcaccaagaagttaatttcctcaagaaaggacccttgaagaaagttsctattattaagtcgattagggtgtagtggcaggaaaaaagtaaggctgatttctaangaacataaaaatgaaacattaa

SEQ ID NO: 15531 - DNA, 290 bp, Homo sapiens
tttacgatggcaacaagtatggcggctgctagtggtagatttgaaagtgcgaagagtatcgaagagcggaaagaacagacccggaatgccagggccgaggtgttgcgccaggctaaagccaattttgaaaaagaagaaaggcgtaaagaacttaagcgacttcggggtgaggatacatggatgctacctgatgtgaatgagagaattgaacatttctcacaggaacactctgtgaagaaaaagaagaaaaaagacaagcattcaaaaaaagctaaaaaaaaaaaaaaaaa

SEQ ID NO: 15532 - DNA, 507 bp, Homo sapiens
gtttgttttcagctgtggttctgaattagatggacttctaggaatactgtggtaacaatgaaacataactctggcctaaacccaactgaacatgttctttcataataggtattggggggtaaggggtgaatcttaactttagtgatgactttggtgaaatgaacttgattaataattggaatttgatcacttcctggcttgaatgaagctggtaaattaatctgaggccaagcaataaatggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgkctaattccagcgcttcaatttccaac

SEQ ID NO: 15533 - DNA, 395 bp, Homo sapiens
agatggacttctaggaatactgtggtaacaatgaaacataactctggcctaaacccaactgaacatgttctttcataatagctggtaaattaatctgaggccaagcaataaatggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattg

SEQ ID NO: 15534 - DNA, 463 bp, Homo sapiens
cccacacaattcttatcaaaatctcagctgtctttgttgttgttgcagaaattagcaagctggtcctaaaaataatatggaaatgtaaagaacccagaatacctcagataatcttgaaaaagaaaagcaaacctggaagacttacacttttcaatttcaaaacttaaaactacaaaagtggccaggtgcggtggctcacacctgtaatcccagcactttgagaggccgaggcagacagatcacttgaggtcaggagttcaggaccagcgtggccaacatggtgaaacccatctctactaaaaatacaaaaattagccgggtgtggtggcgcacgctgtgatcccagctgctcaggaggctgaggcaggagagttgctggaacccaggagagaggttgcagtgagctgagattgcaccactgccctccagcctgggcgacagagcaagactctctccaaaaaaa

SEQ ID NO: 15535 - DNA, 435 bp, Homo sapiens
tgtggcttgtgcttaacttactgaggggacacctagatttgttagccatttttttatggcagagtacaaaagaggccatataacatatctcagtatttggtaacattaaatggatttcactgatataatcaaatttctaaacatgaagccgggaaatcatgtcacatgaggaatggttgaaacaaccatgagtactgaacctgaagaagcaaggactactgggtagactctacacctgtcttgaaagatacagggaagcaaatttcagcttaactttaccatcaagcagtggaaactctgctggggactagtgtgtgaacaccactgcatgaggtgaccctgaatgatgctggtctttcaagaaaagttctacatgggaaaccttcatattctgtgggcatacactaaaagtgtactatcagctttgccacttcc

SEQ ID NO: 15536 - DNA, 585 bp, Homo sapiens
aaacttcattttctagaggtaaaagaaatgatgagccttactcttcctcaaactcaggagtaacttaagtagtatttgtatcaagaaaaaatttttattttgtgctaaaagtccaataaggaataatacagtgtaatacaaaaaagactgcccctgagttgcctgctcctcatcttacacaaattcttcacctctctagaccttccccctctttgctgtaaaatgagtgctgcagtatcagtgttaccagggaataactggaataatacattcatgtagatcacatgccccaaaatgctaaatgaatgtcaagaagatgtgctttaattggaattgtatcaactgagaggaaataatcgactccaaatgttaatatttagttggtagattagccctttcaaacatggtagtcctgaaatttatatttccagttctaagagccttgaatgttaagagtcaacatgtgttgatactcagttaaccatgtctttgggcaaatgktttcacctmtctaagcctattacttcatctaccacttcagagaagtttgagaattaaacccagatatatgtgaaaatgcatgct

SEQ ID NO: 15537 - DNA, 515 bp, Homo sapiens
acaaagggtacaaaatctccgacaggaagaatccattttataatttttttgaggtctgttgcacagtgtggtgaatatagttagtagagtattatacatttcaaaattgctaagagtaaatttcaaatgttctcactacaaaatgctaagtatttgaagtgatggatatgttaactagctcgatttaattattctacattgtatccacagattatgacatcattttgtaacccataaatttatacaattataaattgtcatttacagtaagaaataatttgtgcatctttttagaaaaataaaataattttttacatctgtgtagttcaggtaaaaaaaaatttttttttaattttaataaaataaaatttaaaataaaataaaaatggtggcacatgcctgtagtcccagctacttgggaggctgaggcaggaggatcacttgagcctggaaggtggaggctgcagtgagccgtgattgtgccactgctctccagcctgggtgacagcgagatc

SEQ ID NO: 15538 - DNA, 50 bp, Homo sapiens
gacttggggctagctgcggcggggstgggtaagaaaatattgttagaact

SEQ ID NO: 15539 - DNA, 424 bp, Homo sapiens
agaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaatattttctcagcagcttttattttcttgaagacaatttcagtaaaaacaattcttgtggcttttcctaaatgaatttttttttaacttctagtgattcttactcttcgtttttaggaactctccaggttttcacttcctacattctttcaagagtatagtgactaaaactggagaataatcatttaagtctgactaataaatttagcctcatgttgtaaaaaaaaaaaaaaat

SEQ ID NO: 15540 - DNA, 499 bp, Homo sapiens
aaaatctcggctgtactgccaggatttaagacactttgaaaatgggcaaagcctcatttttcctaggtcaaaaggagttcaagattggggaaatctgaggattcagaaggatgataaatgttagaacatggaatcaggatgtcaccagcactaacacctgtcctagttccagctctggtgaactccagcagacctgctcaagtggacagcattagggaccttgtcagttttgcagtgctttttgcctgaagccacctcaggtccctcatgctgcagaatgtgaaggagcaagtctctcaattggctaattgaatcaagctctgcaatttccttcttccctggagcctgatcctgcaggacaaggatctattttcaagtcaattacaattcctaagggatataattacctacaaaatcagcaaaggaaccctatttctcttatggtaatgtaatagtaatttttaaaataactacaatacatatgatagaaatggaaaaa

SEQ ID NO: 15541 - DNA, 72 bp, Homo sapiens
tttgtcagttagagcaacaagatggccgcggtggcagctccgcacctcagcgcgacggccccgggagccgta

SEQ ID NO: 15542 - DNA, 188 bp, Homo sapiens
atttacaatctcatttgggaatgtccttttcttcttcactgagctgaccaagttccattgtctcctgcagttcaaggcctaatgagtatcacctttttatgaagacacttgcatttttctagacaaaatctctcccactctcattatacttctatagttggttgtgtaaaaaaaaaaaaaaatgcgaa

SEQ ID NO: 15543 - DNA, 184 bp, Homo sapiens
atttammawtcyycatttgggaatgtccttttcttcttcactgagctgaccaagttccattgtctcctgcagttcaaggcctaatgagtatcacctttttatgaagacacttgcatttttctagacaaaatctctcccactctcattatacttctatagttggttgtgtaaaaaaaaaaaaaaa

SEQ ID NO: 15544 - DNA, 499 bp, Homo sapiens
tgttttacttattgttgggtgggatcaacgttctcttatggctttctggattcttaacagaagtaaaactctgattggtctttaagaataaaccttagtgaaaaaaatgagaactataatgacatatataatagcatttaagtaaattaaaatatcttcacattatacaatttgcattttctaaaagaatttcaaataaaattaaatacattataattgttgcctgaggaagaagcaaaggaaagtgatatatattaacataaatgaatgaattaaagataaatgaataaagcaagaaaggaaactttcattaaacaaagttgattatgtgcaatagacagtatgataaactctgtcctttgtacttgaaatccaaaaggtattgataaacaaacaaccaaacacaaaagattggatatatgacattatctttttccacttgtattgcaatgctgtgcatatatatcatcttggatccctcaatatgctgctcataagc

SEQ ID NO: 15545 - DNA, 476 bp, Homo sapiens
agactaggcgcarcacacgggagctactgggtctgtggactacttggtggtcatttcccagtccctgaatatgtaattagaattattctacttagtggtaggtgcaactctactttacgcatgtatttgccactacctgacataagatgttagaagttgagagacagatactaggaggtggaatccagccacctaaattccagaggagctgaaagaaagcaaggatctgcaatttggtgggtgcagatctaaacataccaacagagataccctctgcagttgatgaatatgaaactgaggatgcaatgatattattcaaatatacaggttcagcccaccttcatggagaaggaaatatacagagtatatactgatggttagatatctaccacctcacaggctcagaatcacatcatccctgagaaaagagtgaatttacatctttaggcttggattggaattccattttgatcttc

SEQ ID NO: 15546 - DNA, 358 bp, Homo sapiens
actgcggcgcacttccgtagaggtggacatggcgtgcggctttcgccggctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaa

SEQ ID NO: 15547 - DNA, 501 bp, Homo sapiens
ggaaggggtggggctgagggtggagagaggaagggaaggaagaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggctgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggc

SEQ ID NO: 15548 - DNA, 490 bp, Homo sapiens
taaactttaacttttcctatgaactcttctctaaagcaggtcacagggaaaaaaagggtttaaagagaaataacttctccgggcaaaaactgaggttagcgggcctatcagctgtttcttctcactccaccactgctgctgactggaggagcagcctggaaasgcagccgccctcccgcaaacagcagaatgacgcatcatccataaaaaatgtgaatgtgaggacggtgggaccatcctggcacactgagcagcagggacctccgagccctcagatgtcatccagccaggtgtgtgggggccactcgccatgcacagcttctctcagcagaggctgaccagaatggtggtgatatgaamgagttggggaattcgacttgaatacaaaacataacactgctctcacttaaaaaggttggtgaaccatactccaacagaaaggggacataagactggctctgctgggagtgaggaagctgactgagggaag

SEQ ID NO: 15549 - DNA, 469 bp, Homo sapiens
  misc_feature 123: n=a, g, c or t
taaactttaacttttcctatgaactcttctctaaagcaggtcacagggaaaaaaaggrtttaaagagaaataacttctccgggcaaaaactgaggttagcgggcctatcagctgtttcttctnactccaccactgctgctgactggaggagcagcctggaaagcagccgccctcccgcaaacagcagaatgacgcatcatccataaaaaatgtgaatgtgaggacggtgggaccatcctggcacactgagcagcagggacctccgagccctcagatgtcatccagccaggtgtgtgggggccactcgccatgcacagcttctctcagcagaggctgaccagaatggtggtgatatgaagagttggggaattcgacttgaatacaaaacataacactgctttcacttaaaaaggttggtgaaccatactccaacagaaaggggacataagactggctctgctggagtgag

SEQ ID NO: 15550 - DNA, 508 bp, Homo sapiens
aagatttgaaggaataaaatgtctctacatattgtacaaatgtaaacatggattggttactaaatgatacgaaataatttattgttcatatgttaggcatgactatggcattatgggtatatgtgtgtgagtccttaagtgttagagattcatactgaggtatttaaggctgaaatgttatgcctgtgatttacttttaaatacttaaaaacaaaaggtgggagggatagatgaaacaagattagcaaaatgttggtaaatgtttaatctggatcattaggtacacagggttcattgtgccgttcttactatctttacatatattttaaattttccataataaagttttttaaagtagaaaatcaagtttgggccaggcgtggtggctcatgcctgtaatcgcagtactttgggaggccaaggtgggtggatcatttgaggccaggagatcaagaccatcctggccaacatggtgaaactctgtcttctactaaaaatacaaaaattt

SEQ ID NO: 15551 - DNA, 427 bp, Homo sapiens
gatatccgccgctgctgggcgcgggcgggttccgggggcttgcggtggggggagcagtgatatcgagcagctggtggagccgcatcccagcagggcgttsctggcagagggttctaagtgggcaagggcgcagagtcccttttccttcacttcccacatctgattrmgctccatcaatgammcggagcatccactgamgctagaggagttgaacgtagtagagcaggtgcggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcag

SEQ ID NO: 15552 - DNA, 456 bp, Homo sapiens
acgtggacgcgtctgggctgctggakgcasaggccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgtgccaacgtctggtcctgtctaccctgagcgggcgccccgtcaaaatccgaaagattcggggccagagacgacaacccgggcctccgagattttgaagccagcttcataaggctattggacaaaataacgaatggttctcgaattgaaataaascaaacagggacaaccttatattatcagcctggcctcctgtaatggtggatctgtggaacatgactgtagcgtccttcgtggcattgggtattacctggagagtcttctttgctt

SEQ ID NO: 15553 - DNA, 162 bp, Homo sapiens
atttccagcctcagtcgtcaaactggggatgccacggctttgatttctaaaactctggagatatgacttttaaataacttcatcatatcagtaagcctgacctaaatatttatggtctaaagggaccatctaggttttattttttattctgtaaattaagct

SEQ ID NO: 15554 - DNA, 242 bp, Homo sapiens
taaacatagtgctgtcggccatgtcccttcagccacagcactgccaacactgactggtgttgagaggagagctgaagcgagatgagtggactagggtgggctgttggaactgactggacagcttacaagccccgtagattaggtgatacatcactggtgagcaagctgagcactgagtggagccacctttgacatggctgactcctggatgcattttttttttttttgasgtcccccttctc

SEQ ID NO: 15555 - DNA, 406 bp, Homo sapiens
aattctgaacagcaatgctcatcacatgaacatgaagtttcctccaaaaggaatgatgactaatgctttgaggaaacaggagacgtcagacagcaagcccagaaaaacctgccagcaccaagagggtgtcctcaacaggcgcctgggggacatattattctaactaaagagaccagagcttccccaggaagggaagaggagagaaatgaagaacgtctgtgttcatgtttgccaaaaacaaaagtctgagaaatctctgagagactctacatgggaggtgaaatttaccttttctaagaccattgttgattttccttttacccttgaagtggactgaaatatcactaatggtgagaggaaagctcagaggttctattaaagaatgtgaaataggttaaaaaaaaaa

SEQ ID NO: 15556 - DNA, 418 bp, Homo sapiens
taagtttcttaaattgtaaagtaaggtgggtacagtttcttctagttcttagatggtgctgtcacgggccagcataattgctaaaacatccatacgtatggtagaccttaagtcatgtgctaatcatgaaagctgggctcaccctgaataccggcagttgcctggtctttataatgattactgaatgcataaccagttacgcttgcatgtgttcatcatcataacttattttctaaatatcttaattttcagaggttggaggtttgcaatgtccactcaagttgcaatgcaaaactctggctcatattcaatttctcagtttcaatccagaatgatcaggtaaatcaactgttttctttttatacttcgttaaaaggaaagtggggaggggggtggtaatttttacaggtttaatgta

SEQ ID NO: 15557 - DNA, 583 bp, Homo sapiens
gtagcaacctcttcattccagagctggcccagggaccggggtgggacaatgggtttatgcgtgtccacagtacaccctccctctcccagcctccaccccagggtctgcaggtcctccggcatgtagtatttatctagcaaggcggggtggtggaggcagcaccctggcaaagcagctcacacactgcagccacactcatcagctgtggtgaggcggctggagcaaagtcaaagtcatgcagcaaaatgaaaactctgggactcttcggcaaaatcctcattaagccgagcagctttggccaagtaatttttgcctccttccctcgcgtggcctgagtttaggagcaagggtggccagagtcccttacccacagataagcctcccctcatgaaatgccactcaccccgggctaccattgacatcagggctgcatttccagccagcctggaagtaaaatttgagaggaagacaatattaatctgtgtccccacctagtgagctgtggacaggtttaagttgggtctccttcttcttcaccacaaaaacaggctctaagaaatcatgttactaaaaaatcagtgta

SEQ ID NO: 15558 - DNA, 276 bp, Homo sapiens
ttctttaggcgtgcgaggagggggcatggcggatactgtgttgtttgagtttcttcacacggagatggtggctgagctgtgggctcacgaccccgaccccggrrgktggagcgccgggctccgtggggaggaagcgggggccaccaaggctgccccgggagacgctggccttcagggaggagctggatgtcctcaagttcttgtgcaaagacctgtgggtggcggtgttccagaagcagatggacagcctgcgcaccaatcaccaggggacctacg

SEQ ID NO: 15559 - DNA, 109 bp, Homo sapiens
ttctttaggcgtgcgaggagggggcatggcggatactgtgttgtttgagtttcttcacacggagatggtggctgagctgtgggcttacgaccccgaccccggagctaga

SEQ ID NO: 15560 - DNA, 501 bp, Homo sapiens
gatcagatcgatctaagatggcgactgtcgaaccggaaaccacccctactcctaatcccccgactacagaagaggagaaaacggaatctaatcaggaggttgctaacccagaacactatattaaacatcccctacagaacaggtaagctttctaacacctaggttttctgagttaggccacaaggtaaattgtgaatggggcaagtttgaagggaaagttagattatgagactagttttagatatgctaaggttgagggttctgttttcacttggatgacccatgaccagcagacagttttatgtgtgagtcttgagttcaaaaggagctatgtgagagattagtttgaaaagtattggtcataatggaagccacattagtaaataagttcccttaaggagaagtgaacttgactcaggacaaagaccggggatactagcatcatataggaggcttttgttgaagaagaatgcctatgaaggatggacatacaaagacagt

SEQ ID NO: 15561 - DNA, 420 bp, Homo sapiens
tcgttacaccgctttgtcctgagccaagcgaaagacgaactttaggaacacagttggaggtcacctctcctgcccagctcccgcaccctgcgtttaggagttcagtcccacagaggccactgggttcccagtgtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatcc

SEQ ID NO: 15562 - DNA, 387 bp, Homo sapiens
tttattttgccttctatgtcatcttggagcttaatgtgcatgcaagatatgggaaatactaaagcaagactactctatgaagccaatcttccagagaactttcgaagaccacagacagatcaagcagtggaawtttttcatcagagataaatatgaaaagaagaaatactacgaaaaaatgccatagctattacaaatatttcctcctctgatgctcctcttcagccttttggtatcctctccttctctgcaagctgctgttgacaaaaataaattggagaaagaaaaggaaaaaaaaaaggaagagaaaaaggagagaaaagggagccagaaaasgccgggcaaaaccacttacaggctgaaaasstgcaggaaggaaaggatcag

SEQ ID NO: 15563 - DNA, 476 bp, Homo sapiens
cttttccaggggagaaatggagaatgatggagggtggcccaggcggtgctgattggagtagacagccatcctcccgaagttggcactgagggtgatagagacctacctgcctggccaagctactccgccctgcctaagcatccccttccagagctccaggctggtggggttttattaagggaggcggtgctccttacacaggcctcttcctgctccccgtaaccctgtcgctggaggtgtctgtgggaaaggccaccgacatctacgctgtcaatggcacggagatcctgctgccctgcaccttctccagctgctttggcttcgaggacctccacttccggtggacctacaacagcagtgacgcattcaagattctcatagaggggactgtgaagaatgagaagtctgaccccaaggtgacgttgaaagacgatgaccgcatcactctggtaggctctactaaggagaagatgaac

SEQ ID NO: 15564 - DNA, 408 bp, Homo sapiens
ataaggaagaaactcccaacattataaggaatgaactccggacacaccgcctttaagaactgtaacactcaccgccagagtccacgtcttcgtcttcatttttgaagtcagtgagaccaagaacccaccacttccggacatcgtatagcctgaaaatagaaaaaaatcataaaaaattactttgtttaaactaatgagaccaaagtacaataaagctaaggaaactttttctcataaaaaataaaataatcactataatactaatattgtatttgtgaagcactgtgtaaaatctcttcggccaacgaagcacaggattaggattaaagagattaaataccatgcataaagactgctggtgttaggtacaaataaacgcaagactcctaatttaaaaaaaaaaaaaaa

SEQ ID NO: 15565 - DNA, 406 bp, Homo sapiens
  misc_feature 149: n=a, g, c or t
acttcctgtcactccaggaaaaccgagcggcggacgsggctcggcccggcttccagcccagagcccaagcgccttagccccgtcccagcgctttctgaaagacgggccacctcgcgcggagcgsamcaaggactccagggtccgcagtnaagctggtcaaatctgccccgcacacggtcaacgctcggtctgtgtcccggaagctttcggaccggacctgtctaaatagcgactttcagtcgtgggttttttgttcttgtgggtttgttttgttttttgttgttgttgttgctctacaaaagatttgtcccgcagtggacgggagcctcctcacggccgcccgcccgtctccgcagttctcctcagtgaccggagctgccgcgcgccccgttctccagagaaacaa

SEQ ID NO: 15566 - DNA, 96 bp, Homo sapiens
aatttttataaacttttgttctttcttgtaactttttatcagtcagctattccaatgaagcaaaatctgataatatattgcttttatactaaaaaa

SEQ ID NO: 15567 - DNA, 476 bp, Homo sapiens
aagatctgagttcatgtagctggtgttggcttagggtctgggaggaaggcttttgggaagatgtaaataagaacaaaatctgcagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggtgggtttgcagtttgcaggcagctgaagtttgtctcttctccaggagggccggggcttcttcccttcctctctgtcccatttcttttttcttgagacagagtctcaactttgtcacccaggctggagtgcaatggtgtgatcgtggctcactacagcccccgcctcccgggttcaagcctcagcctc

SEQ ID NO: 15568 - DNA, 217 bp, Homo sapiens
agttgcagtctggtagttgtcgctggccgtgtgacggctcgctgttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaagaaaaaaaaaaaaaaaacgggaaaaaaa

SEQ ID NO: 15569 - DNA, 407 bp, Homo sapiens
aaagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacaktgaacatctcaagcgggagcattcgctcattaagccctaccaaggggtcggttccagctccccctctgggacttccagggcagcactatgctccagccagtacgtacgtctgacccctgacgagcgcasaaagagggctctatctggaaccaccagccgtgcttcctcaaagactgggaaatgcacgtccacttcaaagtccacggcacagggaagaagaacctccatggagacggcatc

SEQ ID NO: 15570 - DNA, 524 bp, Homo sapiens
aatccgggccgaggctcctggtaagggagcagagcgmgaagctgatcccccacggattcttagggggccgacttcccctgtgttgaagattcatcaaagactgattcgagtctgtgttcagcatgtgtgttttagattagaacagtgttgagaatttttatatggggcccagttttagcaggacatcatttaggatctttacaaacgagttcagggtacttcgttttatctgttgtctttgagccactgagtgaattagtaaatgtttgcaaatgtgattgcatcagtgaagaagaacatwtaccaccagttaaaataaatttcccgtgctgctgaaaaatcagtgccgccatcctctgaccctgctcctcccacgcgccctgcaggctgtctccctctgggtcgagagagcttcacagaccatttgggaaagagccaagcaaacacactctgcaagccatttgcataagtagacataatccatacgggaatgatgcactgttcggttgtagtttcattcgtca

SEQ ID NO: 15571 - DNA, 420 bp, Homo sapiens
aagccgccttgcgccttgggactgggcctgagaagggaggagttattcaggcctccgccagcttctaggccctggggatggtctttcacctccctctttctgatctctttttcatgctcctccttgctccaaagaaaagccggatggaaaagagcccagaacctattggaactgacaaaatcaagtcacggcgcctacaaagatgaggggcagattctggctgccttttaatttcgtccttcacctgatatctgtgccagagaatgataaaaatcataataaaggaaataatggaagaggagacttatgttactggggacatctaacataattattttcctgattcagtggcatggttcagtcttccaggagttctgctacagagaagagagtaacccccatccatcatggccaaagcac

SEQ ID NO: 15572 - DNA, 577 bp, Homo sapiens
gttaagatttcaacatatgaatttgatcagtttggagctattattcagatgtgactttaatgtcacattcagcggtttatgcacagaactgtgggccccagtctcactgtcttgccctatctcttcattcgctctccctcccagatgtggaagctgaatttatactggtgcctccaagctggcactctgagtgcaaataagcagtggctattgcattatttattggacctgaaagaaacctccaatatgatctagttcagccaccaatttatgcgtgagaaaacaaaggaccagaaaggtaaatcaagttacctaatactgcacagctgacctggaggctcaccagaattgaaagccattcttcggattcttcatccactgcccttccagtatagcatagaatctgctctgtattctagaacagaggcttggaatctagtctcatcaggcaattctatctgttaagtcttttaagcagatatccctaatatatgtattattttaaaaatcatacacatgtacaattgttaatctagtcattaaatgttaatgaagcataatatctttattttttgta

SEQ ID NO: 15573 - DNA, 580 bp, Homo sapiens
actttcttttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggagttcacaacctctgtggtccgtagagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaatttttga

SEQ ID NO: 15574 - DNA, 484 bp, Homo sapiens
gctcttgttctgactgcggcaggctacagggcctcctcatgctcccagtcagtcgctgtctgtactggctctgttcctgaggcccgagcttgaactcagctgtgatgtggcctctcagatcacactgtcctatgcttgtccagcctggggtcaaacatacccctgattcatcccctgggtctctctggtgttaacattctgcctccacacattcttttccaggcccgaggccaagtgcccctcttggtgtcttcttacaggccattctgcccttccactgcagtgccatcctggctacagccctggacacagtcactgttccttatcgcctgtgttcctctccagtttccatggttcatctggctgacatgctgagcttctgtgggaaaaagtggtgacagcaggagcaatcatccctttccccttggctccaggccagtcccttcctgattccctgatgcagtttggaggagcacccatggac

SEQ ID NO: 15575 - DNA, 433 bp, Homo sapiens
tacgagaccctggtgatccagcagcgcgtggtgcgaatctacgatggcgaggagaagataaaatttgatgctgggactctccttcttagtacacaccgactgatttggagagatcagaaaaatcatgagtgttgtatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagacgaaatgacacaaagaagatgggagaatatgccagtttcccagtcattacaaacaaatagaggaccccagccaggaagaataagggctgtaggaattgtag

SEQ ID NO: 15576 - DNA, 465 bp, Homo sapiens
aaaaagaagaggggcaggactcgttcccgggaaccgaacctggaatccccggcggcagtgggtctgttgctgttgctgtggctgtcgctgcccgtcagctgccttcttttgtcgtttcccagcgctgcgcaggacttctcctggcggcgctgcggatccagggggtcggctgccaggtacaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaaagaaatgccgcttactgcattactaaggatctaggaaagat

SEQ ID NO: 15577 - DNA, 504 bp, Homo sapiens
aatagaagtatattaatttctaggttccagttccttagaatcctaagcctcaataccacaaagaaaagggaaacaaaaaagtgctgaaatcagctcctttggaagtgcagcaggaattgacactggcaggcatggttcaacagtactatatatcgttgccacttttctagagaagaaagattaccaactgaaaaagaaaagagtagctatgtgaagttgtaaattggtcattcttataaaaatccaacctcaagtggcagaatttctgagataagtgataagataagatagagaaatttctagaggagggcagctatctgtcttccatggaagcttcaaaggtggggcaagatcaccttgttctgacctacatcttcatagacccagagacctaattttaccagcaaatcaaaagcaagaatgaatgacatagctccattctgcctggtaataagtgttattatgaaaaawaatctgaggccaacctgatctttccccctttaa

SEQ ID NO: 15578 - DNA, 821 bp, Homo sapiens
accaccacgcagatgtctaagagaaagaaagaacggctccgtgcagatccaggccactgcaactgaatgcatttcagatctcggccaccccatctttcaattcccatggcccccccactcgcccagccacagctacagcggtggtggccagtcaggtctggtggggtgctgtgatcctgcccttgctggaggccaagaaggcctggctagaagacctgtgcctttaccaccagatcacccgagaagtcatctgtggaaaaatccagaattggagacaatggcgcacatgttaatgtgggggtctgtttccacacaagcaagtcctgttagagggacacatgtcaaaatgctagctcccactccaagttcaagttcccaaagttaacatcacaggaaattacaccaccaactgatttgccccaatgtcggctcctctgtctggaagtcgagtctgagaaggccattggtttagttcagctttggccaaaggaagggaccagctcagacaggaatgagtgaaagtgctggcctgattttttttctttttaaactaacattttccccaaaagttatcttgccattacccaagagtcataagtgaaaagacagccaaataccaaaaagccactgaggccctcaacagtgcctgctcatttcaaagccatttcacggacagccagggggtgcctgggccaccgcagaccacccctcactccaagagcactcctgctccccagagctccatgttccatgtaaagttccacggcatgtgcacaccacttcctaagaatgatgtcagcaaaaaaaaaaaaaaatgcgaa

SEQ ID NO: 15579 - DNA, 446 bp, Homo sapiens
gggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcasaccaccaccatcaaggtcatcattgtcatctacctgtccgtggtgggtgccctgttgctctacatggccttcctgatgctggtggaccctctgatccgaaagccggatgcatacactgagcaactgcac

SEQ ID NO: 15580 - DNA, 488 bp, Homo sapiens
tgtttgatgtaacccgctttcaagttagactcaaaacagattcacttataagttaccactattatttttcgtcctatcaaagaagaaattcccttttgcttctctgaattgcttgttgcctagttagcacttttaaaatctggtctaatcgaatatgaaccttcaaaagatatacttgaagggccatctgctgaccccagctcttgtccatgtgagcaacttgtaatggtggctctgatggccatgtatgtggagtgagaaacagcagatggttgtaaagatttaaaatcttcaacaagtggccgagagtcatctctactttggagttagtcaagatgctggccacatgtggttagtatgttatgaagggtttcacatattctgctcatttcgggtttttttcccctccttgctgttctaacctcttctcttttgttttaagagctagcattctgtctgctgtagattataagaatctgtaaccaagt

SEQ ID NO: 15581 - DNA, 389 bp, Homo sapiens
acaactgaaaggtctggggagaaggcgccgtgtccgggtgtggagaggggcgtcgtggacakcgagaagagtggcycgtccctctcctccccctttccctctttcggaaagtggtttctgcggggcccgggagcctcggagtaccgaacctcgatctccggggcggggtccttggtggggactgarcgccccctcccggggacggkcggtctggccgcggagtcccctgcgggarcgtgattrrctggaaacggtcccgaacccccaggggagcccgatccctgggggactctggcttcggactccagtatctgwcgtcgcagggtccctgccctagtkgcctatgtcccttgctcggggccatggagacactgcggycagtacggcgg

SEQ ID NO: 15582 - DNA, 389 bp, Homo sapiens
agtgtgaggtaacccactgagataggtcgggcctgcggasctggcgagcagcggccctctccctggggcttcccttcaatctccgggacatttccccgacctggagctcctccgcctcaccgccagcctctctgcagattgcaagttcacctgccactaccgctgccgcgcgctcgtctgcctggactgttgcgggccccgggacctgggctgggaaccgcggtggagcgggacacgaacgtgacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctg

SEQ ID NO: 15583 - DNA, 519 bp, Homo sapiens
tgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatcattggagaatttgattaatactcagcttgtgggaggaaatgtcttttcgcgaatggtgtgggctgcctgccccgcagtgaccactccatcgctgggggtatcgtgggtctggataacccgtcagagatggtttttgaatctggggtatagtgggaaggagtgctaatga

SEQ ID NO: 15584 - DNA, 331 bp, Homo sapiens
taagaaaaaaagttgccaatggctgaaagaagagcagattgatcctttacaaaattaactaatatactgcgtttgctgatttaattttttaaaactctgatgttttaaagaagcttgtttgtatagtggttgattgccttaactgtaacagtagcagtcttactgttgtkttkttgtkttgttttggttttggttttkgttttttaaagagacgggtggctaggtgcggtggctcatgcctgtrrtcccagcgctttgggaggccgaggcgggtggatcacgaggtcaggagattaagaccatcctggctagcttggtgaaaccctgtctc

SEQ ID NO: 15585 - DNA, 399 bp, Homo sapiens
atcagagggatcagcagctccagggaaggcctggctgccccgcttctaaatgccactccccccccatcagcgttcgtgctgtcagccttgcagccttctcctactcattccagctcsaatacccagcggctgccagaccgagtgaccggcgtggacacagaccctcacttcatcatccacgtgccccagaaagaggacaccctgtgcttcaacatcaatgaggagcctggtgttatcctgagcctggtacagaccccaacacaggcttctcagtgaatggacagctcattggcaacaaggccaggagccctgggcagsatgacggcacgtasttcgggsggctgggaatcgcaaaccctgcsacggactttcagttggaagtgamtcctcagaacatta

SEQ ID NO: 15586 - DNA, 561 bp, Homo sapiens
aattacatcttgggcacaatacccactgacaggaggaccctggaaagagtcacatcacctaggtatgaaagtcaacacctgtattttgggtctaagtacatgagacacaatggtggacaatctatactgagagcctcaattcttcctgtagacagtgtctcctcagtggagtaaaagcctcacggtgtgttgaatcttggtctgagagtcgccaacccactggtggaccggatccacttacaagagtcaatgttcaaactttcaactgtctccagctgtgagattcagaacctcaacaaatgctgctgtctccatcaataaagtccatgttagccacctagaggataaaataccacgaggaggagtagcaaggtgcccctgttgacagatcttgaagcacaagctcactcccagaagcacagctgcctagtcaacaaacagctgacaatacatgtctgaaggagctcagctgggaacagaagaatggccccactgagcctagcctaaatggcggacatctcaattatgagctaataagttttggatgatttgttatgctgc

SEQ ID NO: 15587 - DNA, 195 bp, Homo sapiens
aggaagaaaaggagcatcacatcatctaggtgataaaccctgagatatctcacaatgacccctttgtgcagagatcacaaagaagaatcatataacctgtgtgctggatccagtgacagtgtctcctcagtggagtaaaagcctcacggtgtgttgaatcttggtctgagagtcgccaacccactggtggaccgg

SEQ ID NO: 15588 - DNA, 311 bp, Homo sapiens
ctctttcatcttcccatcatggccgccgcctgtgcgcctctgctgagtcaccctgcactcattggatcagctgactacctagaccagtaacctggctcaatcagttctgccattccacccaggaacaaaacagcaagaaaacctcactttgactccctgtgattccgtcttcaacctgaccaatcagcactccccgcttcccaagctcctactcgccaaattatctttaagaactctgatcctcaaatgctcagggagactaatttgtgtaataataaaactctggtctcccaaaaaaaaaaaaaaaaaag

SEQ ID NO: 15589 - DNA, 405 bp, Homo sapiens
  misc_feature 45: n=a, g, c or t
aactcccatttctggtgccgtcacgggacagagcagtcggtgacnggacagagcagtcggtgacgggacacagtggttggtgacgggacagagcggtcggtgacagcctcaagggcttcagcaccgcgcccatggcagagccagacccctctcaccctctggagacccaggcagggaaggtgacaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgca

SEQ ID NO: 15590 - DNA, 513 bp, Homo sapiens
  misc_feature 476: n=a, g, c or t
agaaacactctgctacagaacaagtgtcttggttcacagcaaagaggacaaagaaaacagcaagttttagggggttgaatcctggattcccctggcaaacaccattctactttccgtctctacgaatttgactactcgaagtacctcatgtgaaatgttggtgccaaatgaacttttctggttcttctgaatatgccactgttgctggagaaatgtcactgctagagaacagaagactattattccaaagggtatttgagactgactgaatcaggtctggaacattattgaaatgagacccacaaaagaagagatactgagtaattcagcatttccagtgacatccttctggctgtgcttcaaagggaagatgacgctagagctggcagcatgaccagcactgtgtaaatcacccagacagacaacaacacaacatccatgaatagatggcagagttagcaagaaaaaatagcttngaggatggaaaaacccccaaggtgtgaaatctctggc

SEQ ID NO: 15591 - DNA, 569 bp, Homo sapiens
ttttaatgtaccagtaaccttccttctgagccacactgttccagatcctaaagacttcatctctaagctgagaacaacttgatgcagtgggaagagtaatgagcaggagaccaaggttgtagacctggttctgctgcttatctgtgtgttttgtacagtcacttaagcctgctgagcctgaatttcttttaaagttaaatgccagtgatactctaatgttgcaaggtagagtgatttagacagcagcaatgacaatgcagatgtaacgccgtattattttaccaagtttccaatcttggaggctcacaccataaaaccatcaacattgataccttggattgggcccagtagctcttgcctgtaatcccagtgctttggaaggctgaagtgagaggattgcttgatgccaggagttcaagaccagcctgggcaatttagcaagaccccatcttgccaaaaaatttaaaaattagccaggagtggtggcttgtgctgtagtcctacctacctgggaggcagaaggatcacttgagcccaggatttgacgctgaagtaagcaatgatcacac

SEQ ID NO: 15592 - DNA, 368 bp, Homo sapiens
aggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtgggccaggagaccttctatgatgtctaccgtagaaaagcctcagaaagacagtatcagagaaggctggaagatgaatgagactgaacttcagcagtcaataaagtcaatatgaatttttaaaaaaaaaaaaaa

SEQ ID NO: 15593 - DNA, 393 bp, Homo sapiens
  misc_feature 352,370: n=a, g, c or t
atcttttcccagtctcggttcgacgactccattttcctcggtgggggcttagcgcactggaggagcggcgggcttcagacaggcgatgggaagaaagagaacacagctatctttccaagctgtgtgcacatggagcaccagctgcccttgagacagaagaaagctgttgttttcatcaggagacattcaactccttgaaaatgaacaatccggccaggcgcggtggctcacgcctgtaaatcccagcactttgggaggccgaggcgggcagatcgcctgaggtcaggagttcaagaccagcctgaccaacatggagaaaccccctctctactaaaaatgcaaaattagccancatggtggtgcatgcctntaatcccagctactcgggaggct

SEQ ID NO: 15594 - DNA, 493 bp, Homo sapiens
actttgctttaggcagtgcgtgtaacggagaggaaggcaagcatgggaaaagccagttttgaggatttctcatacattgcaaaaacaactgtgtccatcaggacccttttgctgcaagtaacagaaaccctcacaaaagctgggttttaaaaaaaaggggatttattcagagataaagcagtcttcatggttagtcaggcatggtgcctcatgcctttgtaatcccagtgctttgggaggaagaggaaggtgcatcacttgaggccaagagttctagaccagccttggcaacatagcaagaccctgtctctacaaaaatatttaaaaattagcccagtgtggtggcatgaacctatagtcctagctacttgggaagctgaggaggaaagatcatttgagcccagaagtgggaggctgcagtgagatataatctcaccactgcactccagcctaggtgacagagcaagaccctgtctcttaaaaaaaaaaaaaa

SEQ ID NO: 15595 - DNA, 436 bp, Homo sapiens
acttccgaagagagaaccgccatgaagagagaagggggtgccgcccacctctgctccgacagcctcccggagtcccagcagcaagacggcaaccacgcacccaacttctccagccacggctcatgccgccgtcgccagcggsccgacatgacaargcgstgcatgcccgctarggsccaggttttcccctcatccccagccccggggtcgtcgcccccgcgctgccatctgagacccggtagtaccgcccatgctgcagcgggaaagagaacagagagtcctggggacaggaagcagtcaattatagatttcttcaaaccagcttcaaaacaagacagacacatgttggattcaccacaaaaatcaaacatcaaatatggaggaagtagattgtctatcactgggacagagcagtttgaaaggaaactatcctcac

SEQ ID NO: 15596 - DNA, 443 bp, Homo sapiens
acttccgaagagagaaccgccatgaagagagaagggggtgccgcccacctctgctccgacagcctcccggagtcccagcagcaagacggcaaccacgcacccaacttctccagccacggctcatgccgccgtcgccagcggccgacatgacaaggcgctgcatgcccgctagccaggtttcccctcatccccagccccggggtcgtcgcccccgcgctgccatctgagacccggtagtaccgcccatgctgcagcgggaaagagaacagagagtcctggggacaggtaccgtgcagagggcttgagaaggggccgggtcgcgggggcaagggtatgaggggagggctgcagaccgccgctcttccagttcccgccatcctccgcgagctcaggcgttggcatttcggggcctggcaaatccccgccccgsctccgcgcagggg

SEQ ID NO: 15597 - DNA, 504 bp, Homo sapiens
gcacacacaataaagggaaagtgagcrgacaccaccactccagtccactcatagaggaccctctgcgcattagcactccgatgagtggcttgctatgggcaggtcccccagacgcctctcccccagtaagctggccacactgctcctccagggatctcagagagatggcagcttgtcaagttcctgagtcgctgggtatgtactgggaatttcagatttaatccctaattacatccagctcatcacctttgtaataggagccataatcatcttttcattgttgtctttgagtcactggggctgtgtggaacmtatatccatattcatgcatgtgttttctattttgctactacatcctcttccttagacttcaaaatgaagggggattttcttttctcctgcaaaagcctttatgaaagaaggtgtttgcttaacactttcaagcttccccattgacatcctttgttctttctctacacattcatggattaactactttgggtc

SEQ ID NO: 15598 - DNA, 410 bp, Homo sapiens
aagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgc

SEQ ID NO: 15599 - DNA, 362 bp, Homo sapiens
atatccggaagcaactgtcatggctgctgtcagtgagggcccgtaatggagatcgagtcaagggttgcccagggacacttaagagccttcdgcttcaaggaggcctctcaaaggacaaaggatgagactgcctggmggcagagtgccccccacaatcgtaggaactgtgtcgccgcgcttcccgttaacttgccgctaagtttttctagaaaagtmgcccttcttgccaggggtgtcctatagactttgtcatggagtgaaacagaaacaaatgaaaccactgccaagaacgatgttataaaggctttcctccacgttctcatctaggagttttatagtttcagcctcgtgaagtgccagct

SEQ ID NO: 15600 - DNA, 446 bp, Homo sapiens
ctgaatcccatcatgggtgaggctcctgatggcaccaggcaagtcccctggcccaacacaggccacagtcaggaagacttggaggtagccccttcaccccagtatggggacctccttgaaccccaggaatactcagttcccagtgtctgagtgagccggtgggtaccaagcattccctttarttcagtgggtaacggtttacaaagcacttttaaagccattttctgctgcaagcttcacaacagccaatgaagtaggtgggcccattggcccatttttacagtggggaaaagcgaggcccaggaaggccgagtgcaaacccagggtgcagcagctggtgcacagccgagctgacccccagcccagcattcctgccttcacagaggcccctcccttagctaaaagggatgtccaccaaaggcacttcckgtgtgcaggaaaatggc

SEQ ID NO: 15601 - DNA, 346 bp, Homo sapiens
  misc_feature 176: n=a, g, c or t
gagtgcttgggagtctggttctccataagccaggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggntgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttcca

SEQ ID NO: 15602 - DNA, 405 bp, Homo sapiens
  misc_feature 176: n=a, g, c or t
gagtgcttgggagtctggttctccataagccaggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggntgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagccaaaaaaaaaaaaa

SEQ ID NO: 15603 - DNA, 544 bp, Homo sapiens
aagtttacagaatttaagcatctgtggggccaggcgtggtggctcacacctataatcacagtactttgggaggctgaggtaggaggatcacttgagtccaggaggctggggctgtagtgagctatgattgtgccactgcactccagcctgagagacagaacaagaccctgtctccaaaagaaaaagaccataagcatctggagcacctgcaagagcctgtgcatgggctcggcgtgactgagagtcctccgccttgcccgagcatcaggcaggccctcccaagacccctcaagatgctagaatgggactttctgcaaagtttaaacatctgtacaggatttagcttctttggtggcgaacttggattgtgatgccctcaggaagtctggtttcactctttctgtcactgtacgtcagcattcatgaaggacttgtattttctctgccttgtgaggtttggagacttgaaggaggacaaagtgacgcgtcatgatggagccagctcagacgggcacctggcacacatcttcagacatgcggccaa

SEQ ID NO: 15604 - DNA, 489 bp, Homo sapiens
agaggtcagttagctgctttcgggcggccttaggcgacaggagactcctggacccagcacctgcccactgtgcctgtccacctgtggctacagcagctgagaccccagtgggctaagattggacaggggccaccagggacccagcaagtccttcagctctatttttgaaacatgaatccttcactcctcctggctgcctttttcctgggaattgcctcagctgctctaacacgtgaccacagtttagacgcacaatggaccaagtggaaggcaaagcacaagagattatatggcatggttggtggcatctgaaactgtccaggggaatcccagagagatgggcattgctattgggatcatatggccagagagtggcttctagaggctggctcctaccaataacctaacgcaataacttaatagcactgattatgagcacgatatgggcatacacccttgttgtgtctcagcttggaaacatctcctaga

SEQ ID NO: 15605 - DNA, 422 bp, Homo sapiens
aattagctgctttcgggcggccttaggcgacaggagactcctggacccagcacctgcccactgtgcctgtccacctgtggctacagcagctgagaccccagtgggctaagattggacaggggccaccagggacccagcaagtccttcagctctatttttgaaacatgaatccttcactcctcctggctgcctttttcctgggaattgcctcagctgctctaacacgtgaccacagtctagacgcacaatggaccaagtggaaggcaaagcacaagagattatatgacatgaatgaagaaggatggaggagagcagtgtgagagaacatgaagatgactgagcagcacaatcaggaatacagccaagggagatcacagcaacctaaataaaccagataccttttaaaaaaaaaaaaaaaaagg

SEQ ID NO: 15606 - DNA, 487 bp, Homo sapiens
tttattgccccatctgtgaattatttgcaaggttggataaatgtaatatatttaagcagctcaactctgtacatcatcaagggctttttaaaaagaagatgtaagttatctttgcagtaatcttgaacttaggggagggtctatattttaaaactttaaatagaccctggagcaattgtatgaatcactctgagggttttcatcaattatttgggtaattcatgtattggtagacatgtatttgatatattaaaactggtccttggagtgaggatgtattgatttagaaaactgaaaacaattttatttattgcttactatgacattgatactacgtgaagtactaggaataaaaagatttattagatgttgcctttcttcaggtagctcagagtctattgggttatttttacaagtcctctattccatatttcatacacagtcatacactgtataactatgttttggtcaatgacaaaccacatct

SEQ ID NO: 15607 - DNA, 406 bp, Homo sapiens
acttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggagattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagagacagagtttcaccatgttgcccaggctggtctca

SEQ ID NO: 15608 - DNA, 500 bp, Homo sapiens
  misc_feature 485: n=a, g, c or t
caaaggacatcttggttatttcaagttttggctattatcaatacagctgctatgaacattcatgtacaggtttttgtgtaaatataacttctcatttctctgggtaaatgctgtggtttgaatgtctcctctaaaactcttattgaaacttaatccccaatggcagtattgagaagtggggcctttaagaggtgattggaaggccgggcgctgtggctcacgcctgtaatcccaacactttgggaggctgaggcgggtggatcacctgaggtcaggagttcaagaacagcctggccaaaatggcgaaaccccatctctactaaaaatacaaaaattagccaggtgtgttggcatgtgcctgtaatctcagctacttgggaggttgaggcaggagaatcgcatgaacccaggaagcagaggttgcagtgagcttagatcgcaccactgcactcaagcctgggtgacagagcaagactctgtctcanaaaaaaaaaaaaatg

SEQ ID NO: 15609 - DNA, 383 bp, Homo sapiens
  misc_feature 35: n=a, g, c or t
agtctgcttgcaggcggtcgcagcgctccagcggncggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagcctcttatgtgaggagctgaagaggaattaaaatatacaggatgaaaagatggcaatgttgcctcccccaggacctcagagctttgtccatttcacaaaacagtctcttgccctcattgaacaacgcattgctg

SEQ ID NO: 15610 - DNA, 601 bp, Homo sapiens
ttcagtccagggcttagtcagcggggcccggagtggcttccctggctggcatctggacttaggctatttccgtgcacgtaaaagcggaatattggaacggttgcacagaacttccaaataatttttaccgccacgcaagatttagccctgaggtcttaatctcaggatttgggacagtaaaagctgtcgtccctccccctcgtccagccggtggcaagcgggtactgcgggcggttccgtccgtcccctttcgcagaaatggcaacgaatgaccaccagcattagctgagccaggggacgtgggagggttgattgcctaaacgactctgcatcgccgcctctttttgaaactaagagaaaatggtgggagatcaaaagaaaactaaataaacacacaggcaacttgtcctgggacctcaactaagcaaatgaagccttattgtgtgtgctgagcctgcagttcccaaccttccggggaagatgggagggcgacaaagggcacagtaggcttgcctggcagtaagtgtgaccgcagctatccaggcggaagagcagaggactgaaaccaccctccagcaagcgagtgtccgccgcgttgagg

SEQ ID NO: 15611 - DNA, 368 bp, Homo sapiens
actaaaaagaagcgggagaatctgggcgtcgctctagagccactgcagtagcctccgtggggcagggcaggcagaagcaccaagtgtggctgaagacggtctccgctctggagcaggctgtgcacagggctcaggggaacctcccactttcctgagacaagggctaggagcagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctg

SEQ ID NO: 15612 - DNA, 481 bp, Homo sapiens
acatatttccaattaagaggaaagagagaagcaaaagacagagaaatgaagtctgaggcaataacagaatgttgcagtggcacatggtagatgctcaaataatgtttctaaaataaatcacctatttctgcaatttgaaaaatccagtttgtggagtcctgggttctgctgagacacttcagttgcagctgaaggaagaggaggaaggcagaaaagtgaaacagggttctggccgagttttgagccttccattgattcaactggaacatttttgcatttgtttatgcaatggcttccactacatcaaattaagaagaataccacaagcacattctgcacaaagcagatttgaaacgatgtttatgtctggaaaactcaatttatggggagccaaaactctttcagctctaagaaaatatatgtaatgtgcaaatatggaaaattgtctccaatagaactgttcataaagactgtaataaat

SEQ ID NO: 15613 - DNA, 220 bp, Homo sapiens
ccacatttcaaagtgcttgacagtcmacaggtgactaaatggctctcctatgggttatagcccagctcttgactctttgatccacaaggataagaaccacatccacttccacatctcsaggtatgaggcagataaatagcagagagtgattaccacaaaactcttctcamccacggattccggcatttgtgggcagctgcaggaagagtaggtgggagga

SEQ ID NO: 15614 - DNA, 485 bp, Homo sapiens
  misc_feature 430: n=a, g, c or t
atttttttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtagagccactatgaggagggccctgggaaggttagtgtgtaaggggcacggcttcgttgggggagggggcgcttggctgtgactcgcgcacctgcaagccgcctccgggctgtggcgtgggagatgatagccagaaaccaggctgagacgcagactagcattccacttagcccaaggaccagtgaggaagctgggcatcctagcgcgtascgctaaaggaatgggcaggtagatccggaagccctgcctccatnggccacctgacgccccctcccccgccccgcagaaagccctgagatggctcgggga

SEQ ID NO: 15615 - DNA, 450 bp, Homo sapiens
aatagtgatgtgaatatcctaccagcactcaaccacagggggaacactaatatatccctggctcagtattcagctgatgagactctcctgcctggttctactcacagtgtcttctgcagttacattgccttcactgrtcatgagaggaggggctgtggtagggccttgaaggacgcctgtggagccagaggccattggattgcaggcagccaagagctacctcgcccctgctatctgctgtggccctcgccgggatgcgatgccctgacatgggttgcctggagctgtgcgcaatgagcaaggggacggctgatggccctcccagatctgcatggcmtggaaaccataaaactcttgggaactatcacatcttccccagctacaggaagaatagaagtagkgttggagaagtcaaggggtcagaagtactgggggcgttccaggttcagc

SEQ ID NO: 15616 - DNA, 324 bp, Homo sapiens
  misc_feature 76: n=a, g, c or t
ttttttaagcttctcggtctgtggcagcagcgttggcccggccccgggagcggagagcgaggggaggcggagacgnaggaaggtctgaggagcagcttcagtccccgccgagccgccaccgcagtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatc

SEQ ID NO: 15617 - DNA, 372 bp, Homo sapiens
aaaccattattagaaacatgccaggttggttgtcttggtatcgtttagtaagaaacaaagattgaaaatgagtcctggtgggccgggcacggtggctcacgcctgtaatcccagcactttgggaggccgaagcgggtggatcacaaggtcaggagattaagaccatcctggctaacatggtgaaacccgtctctactaaaatacaaaaaaactagctgggcgtggtggtgcacacctgtagtcccagctacttgagaggctgaggcaggggaatcgcttgaacccgggagttggaggttgcagtgagccaagatcatcccgctgcactccagcctggtgacagcgagactctcttaaaaaaaaaaaaaaaaa

SEQ ID NO: 15618 - DNA, 456 bp, Homo sapiens
aattaaatacgatgtgtaactgatagatacatttctaaacttgtatgtttgttagactacaggttatactgtcctcttaaaactctttcaggtgctatctcctctgaagaaataattaagtatgcacataggatcagtgcaagtaatgctgtatgtgctccactgacctgggttccaggtaaacatactcgtcttattatactagatatatgtggttttgaagattcttaggtgactatgtacagacatagatttaatttaaaatgtatttatccttagaaacctctgccacatattttcacatctttaatggtttataagtaatgatataggccatgggttttataaatttggttttctgtgaagccattgttgctagggactgtgtttctttcgtcttttgaaataataaattgataattttttaaagtacgagataataatgtgatgcttcta

SEQ ID NO: 15619 - DNA, 597 bp, Homo sapiens
caaaacttttttcatgtacgaaattatttaaaatactgtataaacttacctttaggctatgcataaggtatatatgatgaataaataaattttgtgtttagacttgggtcccatccccaggttttctcattatgtatgtgcaaacattctaaaacctgaaaatatccaaaattctaaaaacatctggtctgaaacatttcagataagggatccacagcctgtgcatagatcctgttacagtggcaaagtcaggtctattgctttttcaaagaacggcacagcctctttcccttacatttgtgctgaacatcttgaaggaagtagaatcttctctgccttctgctagcccatttcccagtactttaaaactctttgatattgctgaatgagataaatcatttcagatattttttcagatataccaaattctatcttgccagtgcccctctgtcctgtgagccttgcagtgaccttccttgtttctgacaaggaccatgatgaatcactagcttggggtatcttgtgtctcttcacactattgattttaggaaaatactttctgcagcttgcaaagccgtaatgtcatttttctttaga

SEQ ID NO: 15620 - DNA, 162 bp, Homo sapiens
atctatagcttggcacagagagattcacgcaccctcaagagtgtgggtgagacatatacagcctgttagacctgaaggcagatggctcttcttaaggccaataaggatctcatttccgcagattgaaggagttcagcgttctgctgaatcagcagggtcttc

SEQ ID NO: 15621 - DNA, 462 bp, Homo sapiens
acaggaaacatataaaaaggagagcagggaaaggagccagtgagacaggaaaaacctagtaacgtggtgtgatgaagctaggggaggaaggaaggaaggaagggcggcgtggaacgtgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgattgttaggaagaagcatcaagtgaaggagaaaggtgaaaatgctggaaggtggggcttagtgatgaaacaaa

SEQ ID NO: 15622 - DNA, 566 bp, Homo sapiens
attccagaggtgggcactcctagccccaggcaggatgttgtttgggtcctataaatctagggctctcccagccttacgtccctggcactgggcttgccagatgtaagggaactggatgggtggtttatttccatctaatatgagaaaaagaagggtacataccgttttgaggaagaaaacttgaacctgaaggatcacagaatcctgcacctccgctagctgtgaaacactgcacaagttaccttgcttccctgaaccccagcagcttcatctgtaaaatggttgtaacaaaggaatctcttaggttttgtgtctcttgtggctcagagcataatttggcaataattgatgattttcaactgttgaaccattgtacctttataatatgtatggcagaacatctaaccttggcatgaaaccatcaagcaatttcatgtggagtgtgttactcttggggctggaatgagcatggcatgtgcggagatggcactgaagccaacgtctgggccccaaagccggtgcaggctctgctgtcatcgtcaggactcttgtgggctgtggggctg

SEQ ID NO: 15623 - DNA, 504 bp, Homo sapiens
cttctgatgacgcattagtcggctgcaatggcgccggtgagsggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactccttttacaatt

SEQ ID NO: 15624 - DNA, 336 bp, Homo sapiens
aattattcacagatagtaccctagtaagaaaaagaaggtggagcaggtaggaaactatgtgaaagaatctcctgrtgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcac

SEQ ID NO: 15625 - DNA, 183 bp, Homo sapiens
gtcaacatcttcgagcatcggcagctccggagccggggtaactggcagcaggtaggaaactatgtgaaagaatctcctgatgtcataatttccgggtgtcaccggaacatttgatcatcattcctttggcaattccagccttctgtggaaaggccagtagaaagcattgatttatttcacctc

SEQ ID NO: 15626 - DNA, 348 bp, Homo sapiens
attattcacagatagtaccctagtaagaaaaagaaggtggagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaact

SEQ ID NO: 15627 - DNA, 576 bp, Homo sapiens
caaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaa

SEQ ID NO: 15628 - DNA, 476 bp, Homo sapiens
caatgtgaaaataaaacataaaaactgttcttggaattatttctaaacagaactaacatcagagtcatctgaatcatcagaatcatctattttggaaaaatcggattcatcaaaggaatcttcggccagcaactgggaacgatgttaacaccacgtgtgggaacgctgtgtcttctgggatctgacgttttcagcaactgagaattcctatattttgtaaatggaaataccagtactaaaaacagaatgccataaatagaacgaggtcttttgtttccaaagtcgatatactcgagcaatgcagaagtcatcatgaaaacgagagatttcatggcaaacttatctcggggtaaacgctgcagctgcaacactgccggtgagtgttctcagggcaaacaggaaaagggctaaaaacaaatggatgaaaaaaggtataccatgttaatacaaaccgagagaaagctggagtggcgaca

SEQ ID NO: 15629 - DNA, 381 bp, Homo sapiens
aaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggaggcaggcaacaccaggagcagaaatgaaagaggcaagaaataagtgctatgtggcgagaaaaaaagttttaatgtattggagaagttttaaaaaacccagaaaaacgctttttttttttaataaagaagaaatttaaaatcaaaaaaaaaaaaa

SEQ ID NO: 15630 - DNA, 520 bp, Homo sapiens
  misc_feature 73: n=a, g, c or t
ttgattgtattgtatactatattaaatgtgaatttgtaccccttcattttaaaaggtcattgtgttctactgnctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtat

SEQ ID NO: 15631 - DNA, 503 bp, Homo sapiens
gtggaaatgactggtaatcaaaggaaaagaggaggaaatagtagaatgctctagttcttacctaaaaacagataagggaagacaccagggaattgtccttttccttgcacctccatcatctaccccgagacgccaccctgacagcttgcttgtccatggcactgtgggtgtgtatggtgagtggcctcttctgcactggtggctccttgagagccggagcatgtctggctcctcttagtgtccccaacacgtgggatggcaggttcctgctgcagagcaggtgcttggcaagcatttgaaaaacaaatgggaataaaggagtgagtgactgagggagagctgttctgcagcacaggacaggcacagagtcggggccctcgctgtactctcaacgccccactctttcctggggacatttgtagattgctcacttctgtcagtcctcttcatctgagagatgagagtgtcatctctgccctcctcaatttagtggtttagaagac

SEQ ID NO: 15632 - DNA, 63 bp, Homo sapiens
aacaaggtctggattacagacctgcagggtaagggatctttcttcttgggtgcaacactaagg

SEQ ID NO: 15633 - DNA, 396 bp, Homo sapiens
ctcctgccccagcctcccaagtagctgggattacaggcatgcgccaccacgcatggctaattttygtattttttagtagagacggggtttcaccatgttggccaggctggccatgaactcctggcctcaagtgatccaaacgcctgggcctcccaaagtgctgggattacaggcgtgacacccgggcctggccgaacaatgtcttttgtatcccttccctcacactaacaatcctctggagatcatgccctgctagactgcaggtcagtgagaatcctggaatcaacacgcattggctcaaggtgcctcccggctgtttatgtgtctgtggtgtgcacccacgaacttctgcagcctaacatggctcctttcgtcctctaggcatcgtgcctccct

SEQ ID NO: 15634 - DNA, 403 bp, Homo sapiens
aacactcaataaagctcttctttgtcttgttcaccttccacttgtctgcataggcaggatttggcaccactggcagtgacactgtaacattttgggggctcatctgggatctgcaaaagggtgaagaaagagaggattaatgagaaaaacaaattagacggcatagcctggatgcagaaagtctaactccaaaattcatgaaccttccaaaatttaccatgttgtccctcttcacttggaactctagtgacacacaaagatgtatgttttttcatttgtacttcctctgctaagatctctaagtgaggggaaaggactaagccgttgtctattatctgtttccgtgttctttcaaagctctagaaaatacgtgagcataattcaagtaaaaatgttggaagct

SEQ ID NO: 15635 - DNA, 507 bp, Homo sapiens
tcagagcacccacgaaatgagctctcaaagttcaaaggcatgccagaatattttctggaactccagctagtaacatattcaaacattacagggatcatttagtctgtttttcttaaaactgaactaaaagatggaggctataaaatcatacactccaaataagatatgcatatttcattgatatcttgagtctaaaaaaaaataaaaacaaaaacaaaacacattcaggatacaaatattgccttgttaaaaaatactgtctcaaaggtggctgaactttcttttctagacctttcccctccccttcttacagtatcccctctttatccttctctaaacagctgttctaacatactacttaaataaaaacacttgaaaaccagcagatataaaacaaagtcattttgaccttcctactgttttttttttaaagcaaagattaaaatcccatgtaaaaccttcctccctatacaaaaaagaatagcagcatttttatcttcaatgaca

SEQ ID NO: 15636 - DNA, 508 bp, Homo sapiens
aagtaagccatacgtattttcttagaagtatagatgtatgtgcgtgtatacacacacacacacacacagagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagct

SEQ ID NO: 15637 - DNA, 372 bp, Homo sapiens
  misc_feature 315: n=a, g, c or t
acagagaagcggctcccgtcggaggccgagtcgtcgccacgatcgcccccttggtggactcgcaggccgagcggcttccccgcagagctcgaggagggcagacggcggcgggggcgcatgagtcagaggcaggtgctgcaagtgttcgagcaataccagaaggccaggacccagttcgtgcagatggtggcggastggcgactagaccccaaaacatcgagacgctgcagaacgcgggtgtaatgtctttgctgagaactcttcttctggacgtggtccaacaattcaacagactgctgctttggctcttggganactggccaattataatsatgacctagcagaagctgttgtgaagtgcgacattcttcc

SEQ ID NO: 15638 - DNA, 462 bp, Homo sapiens
ctatggtttcttctaattcttattgcttaaagtatgagtatgtcacttacccgtgcttctgtttactgtgtaattaaaatgggtagtactgtttacctaactacctcatggatgtgttaagccatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaataagactatt

SEQ ID NO: 15639 - DNA, 505 bp, Homo sapiens
amaymssryrtsskskryggkysmyssrwsmkyyawgrgkygtsggrcggsrgwmcskwgyrysywgykwkswskkmkkysgkmgtskstrkyrtytskcrkttckyrgwwswkwrmwkrrkmyyyrmkcyscasysysyrrcrkytgmtrgwygckkrmcksstrymtrytrywkmtgacygskgmsckgsrskyygswkwyygkytmctskyksskmsykkssmcytymmcyytywwctctykksyytcrksyytyrtstskkgwgtkksrwsytwsmksytwgcskkwkrmywsagawyammsmwcarmmcamagmrsawwkcsrakkymymakscmycakmscsarsakcgrscctttkyykmtttkcycwkyrccmwscwscaycytgywcyytktwgtcwtkaactytgtyksctkmwymwttctcwtwtwygttrattgagrrgtarragactaaaasamtgttcactctttgaatttcctggatwvkagaagttctg

SEQ ID NO: 15640 - DNA, 224 bp, Homo sapiens
ttagataaagtaagcctaggtgttgtcagcaggcaggctggggaggccagtgttgtgggcttcctgctgggactgagaaggctaacgaagggcatccgcaatgttggtttcactgagagctgcctcctggtctcttcaccactgtagttctctcatttccaaaccatcagctgcttttaaaataagatctctttgtagccatcctgttaaatttgtaaacaagc

SEQ ID NO: 15641 - DNA, 510 bp, Homo sapiens
atctctaggctttgtgcacacattccaagctgttttcttacttcaacaattctataagctacccattgtttcacattttctcaaccaggtgtataaataagagaaaacaggtgttggaatacttggtcccattttatactctgtcttctgatccttgaaccttgaaacatggagtacctctgcctgattaaagaggaagataaaaggctaaagaggaaaagatgcagttgataatgtcgtgttgccagaagaaaggcacagggcaagtgaactatagtgattcagtattcagctggatacacagcacacaggaaaattttcaccatactttaaaggtcagttagcattactgttcagctcactgaagctgtttatgataaggaaaaacaacacatttttactgtgcccaagtcctttcatctcccctaaataattataatcatttcttcttggataatatagactagaaggaaacatattcacacatttagttctcagcaaatctttaaa

SEQ ID NO: 15642 - DNA, 324 bp, Homo sapiens
tagattataactcactaccagccctgtagctcccctgccccttgtacaaggtgggggcacagagaggggcgggaagagtgaatgccaagaggatggcttattagtctgtgtctgctttcctgagctttcctctctaaggcttctgtgccaccctgattttaaactgctgacaaagacatctaggctgttgctgccaatttctgtggctaaggggcaatcaagggggagggaaaggcaaaatcttaaagagcttttagcatatctctcttttaagtcctacctctgcttccctttgctttcaggctccaggttaccagtttcctt

SEQ ID NO: 15643 - DNA, 418 bp, Homo sapiens
atatatgctctaccattataagtacagtcacctgggggacagactggatcctgtgaacaattgagctctctgggtctttgggaactaaagaagagaacagaagggcaaatagtataggacaccagaaggtgtctatatgtttggagtgggggtgtcttgtcttctgccatctactacctatgtgacattaatttaatagtttgcttagcctcacgaagcctcagttcccatatctgcttaaaaaacaaacacgggctgggcgtggtggctcatgcctgtaatcctagcactttgggaggctgaaacgggaggatcacttcagctcaggagtgcgagagcagcctggacaacatagtgagacytcctcctatttaaaataataataactattattcaaaggaaaaaaaaaaaaaaaaag

SEQ ID NO: 15644 - DNA, 422 bp, Homo sapiens
  misc_feature 322: n=a, g, c or t
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcmascaacttgcgcaaaaacaacagacagccctatgctgtcagtgaattagcaggtcatcagactagtgctgagtcttggggtactggcagagctgtggctcgaattcccagagttcgaggtggtgggactcaccgctctggccanggtgcttttggaaacatgtgtcgtggaggccgaatgtttgcaccaaccaaaacctggcgccgttggcatcgtagagtgaacacaacccaaaaaccgatac

SEQ ID NO: 15645 - DNA, 322 bp, Homo sapiens
agagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtctgtrcccatgaaactgaacctaagacccctggtcagccaagaacatggcttcaattcttggccactggtaggctgcatgcttatgagcccactcctgatgatgtggccatatccta

SEQ ID NO: 15646 - DNA, 316 bp, Homo sapiens
acagaaggagaaagcagcttaagggaaacagcctaaaaatcctttcaagacaagtgaagaggcctttcagttgcatttcagaaaatcgccttgattaagagagtggcagaaaagacaaacccacatttttcatccgcatttgaattaacagcccccaggaagacagagcaaaagtgtttgctgctatattatcaaatggcattgccaggggacccttggaaaaaggagactccagttctttgtactcctgagaccagtaataacctggaaccccactcagcaataaaacctctttccaaaaaaaaaaaaaaaaagg

SEQ ID NO: 15647 - DNA, 525 bp, Homo sapiens
taaggtaaagtatctttattgattgaaatctttagtattaaattaaattacatgtgcttacaaaaagaagtacatttttgatgattactatgactttatgccttcccaacagtatgcagtatagttgggcacataataggcatatggaccagtggtagcaaacaaatattaataatagtcctcaaggagtctctgaatcatttatatcctagacaaaggttgcaacatactcctgaatactgggaaggtgtggcctactctgcctatcaatagtatatcttcacacattcaaatcacaaatatttaactacttctcttttaattataaataaaataaattttatttttgccagttgtccttcaatttaagattaggaattagcaatataattataaaatcaaaagtgatttttatgtcctcatgttataaaggaaatagccacagaatcaactagagtatttgttttaagtgtaaaatgtgaggggaggatgattttttaaattgatacaaaataatttatacat
